United States Patent 11,098,302 (IDENTIFICATION OF POLYNUCLEOTIDES ASSOCIATED WITH A SAMPLE) - sequence listing, part 117

SEQ ID NO: 404565 - DNA, 486 bp, Homo sapiens
  misc_feature: GZ8MTXP02F4T4U.39.86.H09.1.454.CMB.2.raw
  modified_base (478)..(486): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcagggtttctaatcgcttctctggctccaagtctggcaacacggcctccctgaccatctctgggctccaggctgaggacgaggctgattatactgcagctcatttgcaatcagtgagcttatgtcttcggaagtgggaccaaggtcatcgtcctaggtcagcccaagctcgccccctggtcactctcgttccccgccctcctcactagtcgcgactgacgcgggctcggcaaggcgacatagnnnnnnnnn

SEQ ID NO: 404566 - DNA, 496 bp, Homo sapiens
  misc_feature: GZ8MTXP02HPJDL.39.86.H09.1.454.CMB.2.raw
  modified_base (236)..(236): a, c, t, g, unknown or other
  modified_base (441)..(441): a, c, t, g, unknown or other
  modified_base (446)..(446): a, c, t, g, unknown or other
  modified_base (487)..(496): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtcccctggtaccagcaatatccaggcacacgcccccaaactcatcatttatgaggtcagtaatcggccctntaggggtttctaatcgcttctctggctccaagtctggcaacacggcctccctgaccatctctgggcctccgaggctgaggacgaggctgattatactgcagctctatttgactaatcagtgaggtcttatcgtcgttacggaagtggaccaaggtcagtcgtccgttagcacgcccaagcccaacccatcgacactctcgtcccncctcncactacgtgcgcgtgagcggcgtggacacggccgctacagnnnnnnnnnn

SEQ ID NO: 404567 - DNA, 688 bp, Homo sapiens
  misc_feature: GZ8MTXP02JESWC.39.86.H09.1.454.CMB.2.raw
  modified_base (305)..(305): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatatccaggcacacgcccccaaactcatcatttangagtcagtaatcgccctgaggggtttcctaatcgtcttctctggcctcgtaagtcgtacggaccaaccgaccggtccctcccgtacgaaccctactccctccgtcggggtcccttacccgacgggtccgtagggaacgggaccggacgggtaccgttaggttaaactttaaacgtttaccgttaggaccgtaacggtccttaccgttaagtttttacggaaccttaaactttaccgaaggttacggtaacgggttacctttaaaggtcggtttaccgttacggggtaaacgggtaacggggtaacccgtaaacgggttaaccgtaacggttaccggttacccggttacggttaccgtaacccggtaaccccgtaaaccccggg

SEQ ID NO: 404568 - DNA, 483 bp, Homo sapiens
  misc_feature: GZ8MTXP02FY3QT.39.86.H09.1.454.CMB.2.raw
  modified_base (416)..(416): a, c, t, g, unknown or other
  modified_base (476)..(483): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggtatgactatgtctcctggtaccagcaatatccaggcacagcccccaaactcatcatttatgaggtcagtaatcggccctcagggtttctaatcgcttctctggctccaagtctggcaacacggcctcccctgaccatctctgggctccaggctgaggacgaggctgattattactgccagctcatttgcaatcagtgaggcttatgtcttcggaaagtgggaccaaggtcatcgtccaggtcagcccaaggccaaccccacngtcactctgttcccgcccctcctcactagtgcgactgagcgggctggcaaggcgcatagnnnnnnnn

SEQ ID NO: 404569 - DNA, 683 bp, Homo sapiens
  misc_feature: GZ8MTXP02JA6ZB.39.86.H09.1.454.CMB.2.raw
  modified_base (302)..(302): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctctggtaccagcaatatccaggccacacgcccccaaatcatcatttangaggtcagtaatcggccctgtaggggtttcctaagtcgtctttctcttggctcctaaagtctggccaacacggtccctccctgaccctattccgtccgttcggggacccttcccgagggccttacggggaacgggacccggaagggtccgttagggtaaagttttaactttaacccgttgggacctaaacggtccttaccgtaatttttcggacctaaaagtttccgaaaggttggtacggggttacctttaagttcggttaccgttttaccggggaaaacgggtttacggggaaaccccgtaaaagggggttccaaacggtttcccggttacccgttaaacggggtttcccgtaaccggtacccccgtaaaaaccccggg

SEQ ID NO: 404570 - DNA, 525 bp, Homo sapiens
  misc_feature: GZ8MTXP02GHA7T.39.86.H09.1.454.CMB.2.raw
  modified_base (302)..(302): a, c, t, g, unknown or other
  modified_base (359)..(359): a, c, t, g, unknown or other
  modified_base (413)..(413): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgcccccaaatcatcatttangagtcagtaatcggcctcgtaggggtttcctaatcgcttctctgctcagtctgcacncgcctccctgaccatctctgggctcgaggctggaggacgaggctgattattacngcagctcagtttgactaatcgaagtgaacggtctttagtcgttacgttacgggtaagtcgggaacctaaagggtctaacgtcgtaccgtaggtaccacgtaccccgaaacgg

SEQ ID NO: 404571 - DNA, 562 bp, Homo sapiens
  misc_feature: GZ8MTXP02I4VA6.39.86.H09.1.454.CMB.2.raw
  modified_base (307)..(307): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatactccaggccacacgcccccaaaatcatcatttangagtcagtaactcggccctgaggggtttcctaatcgcttctctggctccaagtctggaccaacacggccctccctcgaccatctcgtgggcctccgacggctggaggacgaggctgtatttacttacgtcgacagtcctactatttcgactaaacgtcgtaagtggtaacggtctttagtcggttacgttacgggtaaggtacgggacctaaagggtcacgttacgtaccgtaggtaccgacgacccgaaaccgg

SEQ ID NO: 404572 - DNA, 492 bp, Homo sapiens
  misc_feature: GZ8MTXP02FOUMI.39.86.H09.1.454.CMB.2.raw
  modified_base (302)..(302): a, c, t, g, unknown or other
  modified_base (378)..(378): a, c, t, g, unknown or other
  modified_base (397)..(397): a, c, t, g, unknown or other
  modified_base (410)..(410): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaatcatcatttangagtcagtaatcggcctcgagggtttcctaatcgcttctctgctcaagtctggcaacacggcctccctgaccatcnctagactcagctgagacgngctgactattatnacagctcatatactgaatcaaatgtactccactggctcgttcggcggaggaacctaagtcgaccgtctaaggtcacgacccg

SEQ ID NO: 404573 - DNA, 534 bp, Homo sapiens
  misc_feature: GZ8MTXP02GIQWG.39.86.H09.1.454.CMB.2.raw
  modified_base (420)..(420): a, c, t, g, unknown or other
  modified_base (428)..(428): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccagcacagcccccaaaatcatcatttatgaggtcagtaatcggcctcaggggtttcctaaatcgcttctctggctccaaagtctggcaacacggcctccctgacccatctctgggctccaggctgagacgaggctgattattacngacagctntatttgacaatacagtagtacgtacttattacgttcgttacggtaacggtacgggaaccgtaaacggtaacgtacgtacgtaccgtacggtacgacgaccgaaacg

SEQ ID NO: 404574 - DNA, 493 bp, Homo sapiens
  misc_feature: GZ8MTXP02H0QGR.39.86.H09.1.454.CMB.2.raw
  modified_base (216)..(216): a, c, t, g, unknown or other
  modified_base (436)..(436): a, c, t, g, unknown or other
  modified_base (481)..(481): a, c, t, g, unknown or other
  modified_base (484)..(484): a, c, t, g, unknown or other
  modified_base (486)..(493): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttangaggtcagtaatcggcctcgagggtttctaatcgcttctctggctccaagtctggcaacacggccctccctgaccatctctgggctccaggctgaggacgaggctgattatactgccagctcatttgcaatcagtgagcttatgtcttcggagtggaccaggtcagtcgtctaggtcacgcccaagcccaacccatcgtcactctcgtaccccacctccncactagtcgcgacgtgacggcgggctcggcgaaacgggcacgtanagngnnnnnnnn

SEQ ID NO: 404575 - DNA, 512 bp, Homo sapiens
  misc_feature: GZ8MTXP02GS2CI.39.86.H09.1.454.CMB.2.raw
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctcctggtaccaacaatatccaggcacagacccccaaactcatcatttatgagtcagtaatcggcctcgaggggtttctaatcgcttctctggctcagtctggcaacacggcctcctgacctatctctgggctccgagctgagacgagctagattatactgcagtctcatttgacaatcaagtcgaagtcttagtgtcgtaggaagtcggaaccgtaaggtcaacgttcgaccttaggtcacgccccgaaaggaccccc

SEQ ID NO: 404576 - DNA, 545 bp, Homo sapiens
  misc_feature: GZ8MTXP02HEF6U.39.86.H09.1.454.CMB.2.raw
  modified_base (228)..(228): a, c, t, g, unknown or other
  modified_base (308)..(308): a, c, t, g, unknown or other
  modified_base (419)..(419): a, c, t, g, unknown or other
  modified_base (447)..(447): a, c, t, g, unknown or other
tcagtcgcactagtcacgaccggtgctcgatttagtgctatagacttggggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtggacggttggggttatgactatgtctcctggtaccagcaatactccaggcacacgacccccaaatcatcatttangagtcagtactcgcctgtagggttcctaatcgtcttctctgctccaagttctggacaaccgaccggccctccctcgacctactctcgtcggcctcgaggctaggaggacgnggctagtatttacttactgacagtcctntatttgactaatcgagtcggtaggtcttagtcgttacgttacggtaacgtcgggaacctaaggtcctagtccgtcgtaggtaccacgacccgaaccgg

SEQ ID NO: 404577 - DNA, 604 bp, Homo sapiens
  misc_feature: GZ8MTXP02IDWF4.39.86.H09.1.454.CMB.2.raw
  modified_base (305)..(305): a, c, t, g, unknown or other
  modified_base (467)..(467): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctcgtgtctggtctctaggacagtcgatcaccatctcctgcactggaaccagcagtgacggtttggggtatgactatgtctcctggtaccagcaatactccaggccacacgcccccaaatcatctatttangagtcagtatccggcctgtagggttcctaatcgtcttctcgtggctccgaagttctggaccaaccaccggtccctccctacgaccatcctcgtcgggccttaccgaggctaggacgggaccgaggcttaggtaatttaacgtttacgtgactacgtaccttntaagttttcgacctaattacgtaaggttggtaaggttctttaagttcggtttccgttaacgggtaacggtaccggtaaccgtaaaggtcctacgttaccgttaccgttacggacctaaccggaccccgtaaacccgg

SEQ ID NO: 404578 - DNA, 601 bp, Homo sapiens
  misc_feature: GZ8MTXP02IQ4A8.39.86.H09.1.454.CMB.2.raw
  modified_base (215)..(215): a, c, t, g, unknown or other
  modified_base (587)..(587): a, c, t, g, unknown or other
  modified_base (590)..(590): a, c, t, g, unknown or other
  modified_base (594)..(594): a, c, t, g, unknown or other
  modified_base (597)..(597): a, c, t, g, unknown or other
  modified_base (599)..(599): a, c, t, g, unknown or other
  modified_base (601)..(601): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttangagtcagtatcggcctgagggtttcaatcgcttctctggctccaagtctggcaacacggcctccctgaccatctctggtcctccaggctgaggacgaggctgatttatactgccagctcatttgactaatcaagtgaggtctttagtcgttacgtttcgggaaaggttcgggaaccctaaggttcagttcccgttcgtacgggttcaacggaccccgaaacgggccccaaacccccgtacttacggtacctacctttccgttaccggtttcccccgtccccttcccgttacctacccgttaggtccgtaccgacgttacggaacgggtccggggtcgtacgggaccgaaacgggccggacctacgtaacggngcncgcngcncncn

SEQ ID NO: 404579 - DNA, 485 bp, Homo sapiens
  misc_feature: GZ8MTXP02FFKCJ.39.86.H09.1.454.CMB.2.raw
  modified_base (235)..(235): a, c, t, g, unknown or other
  modified_base (350)..(350): a, c, t, g, unknown or other
  modified_base (447)..(447): a, c, t, g, unknown or other
  modified_base (454)..(454): a, c, t, g, unknown or other
  modified_base (475)..(475): a, c, t, g, unknown or other
  modified_base (477)..(485): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaactcatcatttatgaggtcagtaatcggccctnagggtttctaatcgattctctggctccaagtctggcaacacggcctcccctgaccatctctgggctccaggctgaggacgaggctgatatactgccagctcatttgcaatcagtnaggcttatgtcttcggaagtgggaccaaggtcatcgtcaggtcacgcccaaggcccaaacccactgtcactctcgttcccaccctcctacacttagngcgacgngacgcggcgcgcgacgcgcanannnnnnnnn

SEQ ID NO: 404580 - DNA, 507 bp, Homo sapiens
  misc_feature: GZ8MTXP02F0TQI.39.86.H09.1.454.CMB.2.raw
  modified_base (215)..(215): a, c, t, g, unknown or other
  modified_base (275)..(275): a, c, t, g, unknown or other
  modified_base (495)..(495): a, c, t, g, unknown or other
  modified_base (498)..(498): a, c, t, g, unknown or other
  modified_base (500)..(507): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaatatccaggcacacgcccccaaatcatcatttangaggtcagtaatcggccctcgtagggtttctaatcgcttctctggctcagtctggcaacncggcctcctgaccatctcgtggctccaggctggaggacgaggctgattatactgccagctctatttgacaatcagtgaggtctttagtgtcgttcggaagtggaccaaggtctagtcgtactagggtcacgtcccaacgcccaacccactgtacaccttctacgttccccaccctcctacactacgtcgcgactggacgcggctcggacacggccgactnagngnnnnnnnn

SEQ ID NO: 404581 - DNA, 566 bp, Homo sapiens
  misc_feature: GZ8MTXP02GWL6F.39.86.H09.1.454.CMB.2.raw
  modified_base (216)..(216): a, c, t, g, unknown or other
  modified_base (275)..(275): a, c, t, g, unknown or other
  modified_base (556)..(557): a, c, t, g, unknown or other
  modified_base (559)..(566): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttangagtcagtaatcgcctcgtagggtttctaatcgcttctctggctccaagtctggcaacncggcctcctgaccatctctgggcctcgaggctagaggacgaggctgatttatacgtgcctagctctatttcgctaaatcgagtcgaggttacttaagtcggtcgttacgggaagttcgggaaacctaaggtcacttcggtacctacgggtcacggaccccgaacgacccctaaacccctactcgtaccctaccgttccttccgggttccccctcccctcctaccgtacgttacgcggtacgacgtcgggacggcggtacgcgggacgaacgggccgacagnngnnnnnnnn

SEQ ID NO: 404582 - DNA, 543 bp, Homo sapiens
  misc_feature: GZ8MTXP02H0ET3.39.86.H09.1.454.CMB.2.raw
  modified_base (532)..(534): a, c, t, g, unknown or other
  modified_base (536)..(539): a, c, t, g, unknown or other
  modified_base (541)..(543): a, c, t, g, unknown or other
tcagtcgcactagtcacgaccggtgctcgatttagtgctatagacttgggtttggtggtccccagtctgccctgactcaggctgcctccgtgtctgggtctctaggacagtcgatcaccatctcctgcactggaaccagcagtgacgttgggggttatgactatgtctcctggtaccagcaatatccagcacagccccaaatcatcatttatgaggtcagtaatcggccctcgtaggggtttctaatcgcttctctggcctccaagtctggaccaacaccggcctcctgaccatctctgggcctccgaggctgaggacgaggctctctattatgcagctcaatatacaagtcattatcacgtttgggtcgttcggcgggaacggacccgtacgtgaccgttcgttacggtcacgacccgaaggcctaccgtcccccgtcggtacaccttccgtccgtttccccgcccttcctcctacgtacgtcgtccgacgttcggacgtccggggctcgggacgacgggccacgactgcnnngnnnncnnn

SEQ ID NO: 404583 - DNA, 600 bp, Homo sapiens
  misc_feature: GZ8MTXP02GZZKG.39.86.H09.1.454.CMB.2.raw
  modified_base (214)..(214): a, c, t, g, unknown or other
  modified_base (481)..(481): a, c, t, g, unknown or other
  modified_base (513)..(513): a, c, t, g, unknown or other
  modified_base (589)..(589): a, c, t, g, unknown or other
  modified_base (591)..(591): a, c, t, g, unknown or other
  modified_base (593)..(593): a, c, t, g, unknown or other
  modified_base (595)..(597): a, c, t, g, unknown or other
  modified_base (599)..(600): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaatcatcatttangagtcagtatccggcctgtagggtttctaatcgtcttctctggcctaccaagtctggacaaccacggccctccctgaaccctatcctcgtgggcctccgaggctggaggacgaggctgtaattatacgtgaccagtcctactaatttcgactaaatcgtagtgacggtactttaagtcgttaccgttacgggaaagtcgggaaacccgtaaggtccagttcccgttacgtacggtccaacggaccccaaacggaccccctaaacccnttcggtacctaccttccgttccggttcccccnccccttaccgctacgttacgtcgaccgtaacgtcggaacggccggggtctacgggaccaacgggccgacagtacgngncncnnncnn

SEQ ID NO: 404584 - DNA, 426 bp, Homo sapiens
  misc_feature: GZ8MTXP02H04PJ.39.86.H09.1.454.CMB.2.raw
  modified_base (181)..(181): a, c, t, g, unknown or other
  modified_base (214)..(214): a, c, t, g, unknown or other
  modified_base (242)..(242): a, c, t, g, unknown or other
  modified_base (253)..(253): a, c, t, g, unknown or other
  modified_base (269)..(269): a, c, t, g, unknown or other
  modified_base (415)..(426): a, c, t, g, unknown or other
tcagtcgcactagtcacgaccggtgctcgatttagtgctatagacttgggtttggtggtctcccagtctgccctgactcaggctgcctccgtgtctgggtctcctggacagtcgatcaccatctcctgcactggaagcagcagtgacgttggtggttataactatgtctcctggtaccaanagcaccaggcaaacgcccccaaatcatgattangagctgaggacgaggctagattattacngcagctcatanacaagcagcagcactntggtggtatcgggacggaggaccaagctagaccgtgttaggcagaccgaggctcgccccccctggtaccactcctcgttcccccaccttcctactacgtacgtcgaccgacgtgacggccgggcgtcggacgaaggcgacagtagnnnnnnnnnnnn

SEQ ID NO: 404585 - DNA, 553 bp, Homo sapiens
  misc_feature: GZ8MTXP02F3D1P.39.86.H09.1.454.CMB.2.raw
  modified_base (304)..(304): a, c, t, g, unknown or other
  modified_base (315)..(315): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctctggtaccagcaatatccaggcacacgacccccaaatcatcatttangagtcagtaancgcctgtagggtttcctatcgtcttctctcggctcgaagtctggaccaaccgaccggccctccctacgaccctactccgtcgtcgggcctccgaggtcgtaggacggacgaggcttagtaatttactacgtgactagctactatttcgactaatcgagtcgaggttcttagtcgttacgttacggaagtacggaaccgtaaggtcgtacgtcgtacgtaggtccacgaccgaaacccg

SEQ ID NO: 404586 - DNA, 710 bp, Homo sapiens
  misc_feature: GZ8MTXP02JDYS6.39.86.H09.1.454.CMB.2.raw
  modified_base (307)..(307): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatatccgaggccacacgacccccaaatcatctatttangaggtcagtatccgccctgtagggtttcctaatcgcttctctgctcaagtctggacaacgacgtcctccctcgaccattcctcgtcgggccctccgaggtcctaggacgggtacggaggtaccgttaggtaattttaacgtttaccgtacggtacccgtaaaggtcccgttactttaacgttttacggaacccgttaaattacccgttaaagggttagggtaacggggtttaaccctttttaaaggttccggggtttaaccggtttaacccgggggtaaagggttaaccgggggtaaaccccgttaaaacgggggttcccttaaaaccgggtttcccggtttaaccccgggttacggggtaaccccgttaaacccgggtaacccccggtaaaaacccccgggg

SEQ ID NO: 404587 - DNA, 536 bp, Homo sapiens
  misc_feature: GZ8MTXP02GEQBW.39.86.H09.1.454.CMB.2.raw
  modified_base (305)..(305): a, c, t, g, unknown or other
  modified_base (437)..(437): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatatccaggcacacgacccccaaatcatcatttangagtcagtaatcggcctgtagggtttcctaatcgtcttctctggctccaagtctggacctaacgacggccctccctagaccctatcctcgtcgggcctccgaggctggacggacgaggctgtacttattacngcagcctgtattgacaagtcagtcgagtcttatcgtcgttacggagtacgggaacctaaggtctaacgtccgtacgtaggtaccacgacccgaaaccgg

SEQ ID NO: 404588 - DNA, 546 bp, Homo sapiens
  misc_feature: GZ8MTXP02JS6JN.39.86.H09.1.454.CMB.2.raw
  modified_base (214)..(214): a, c, t, g, unknown or other
  modified_base (234)..(234): a, c, t, g, unknown or other
  modified_base (463)..(463): a, c, t, g, unknown or other
  modified_base (532)..(532): a, c, t, g, unknown or other
  modified_base (536)..(536): a, c, t, g, unknown or other
  modified_base (538)..(538): a, c, t, g, unknown or other
  modified_base (540)..(542): a, c, t, g, unknown or other
  modified_base (544)..(546): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaatcatcatttangaggtcagtaatcggccctnagggtttctaatcgcttctctggctccaagtctggcaacacggcctccctgaccatctctggctcaggctgaggacgaggctgattatactgccagctcatttgacaatcagtgaggtcttagtcgtcttacgggaagtcgggaacctaggtcagtcgtacctagggtacacgacccgaacggacccaaacccccgactacggtcctaaccgtccttccggttcccccnccccttcctacctaccgtacgtcgccgtactcggacggcgggccgtacgggacgaacggccgacgtaanacgngncnnncnnn

SEQ ID NO: 404589 - DNA, 512 bp, Homo sapiens
  misc_feature: GZ8MTXP02FQRIZ.39.86.H09.1.454.CMB.2.raw
  modified_base (260)..(260): a, c, t, g, unknown or other
  modified_base (304)..(304): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctccnggtaccagcaatatccaggcacagcccccaaactcatcatttangagtcagtaatcgcctcgtaggggtttcctaatcgcttctctggctccaagtctggccaacacggccctccctgacccatcctctgggcctccaggctgaggacgaggctgattattactgcagcctcatttgcaatcagtgacggtcttatcgtcttacggaagtcggacctaaaggcattcgtacctaggtcacgcccgaaaccgg

SEQ ID NO: 404590 - DNA, 593 bp, Homo sapiens
  misc_feature: GZ8MTXP02GW7BJ.39.86.H09.1.454.CMB.2.raw
  modified_base (306)..(306): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctcctggtaccagcaatatccaggcacacgacccccaaactcatctatttangaggtcaagtaactccggccctcgtaggggtttacctaagtccgtcttctcgtcggctccgtaagtcgtaggaccaaccgaccggtcccctcccgtacgaccctacttctcgtcgggccctccgacggctaggacggacgaggtctaggtaatttagttacgtgacacgtcctactatttcgactaatcgtagtcgacggttacttagtcggttacgttacgggaacgtcgggtaacctagggtctaacgttccggtaccgtaggtaccaccgacccgtaaacccgg

SEQ ID NO: 404591 - DNA, 533 bp, Homo sapiens
  misc_feature: GZ8MTXP02GAQOB.39.86.H09.1.454.CMB.2.raw
  modified_base (225)..(225): a, c, t, g, unknown or other
  modified_base (364)..(364): a, c, t, g, unknown or other
  modified_base (455)..(455): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcatcaccatctcctgcactggaaccngcagtgacgttggggtatgactatgtctcctggtaccagcaatatccaggcacacgcccccaaactcatcattatgagtcagtaatcgcctcgtaggggttcctaatcgcttctctgctcagtctggcacacgcctccngaccatctctcgggctccgacggtctagaggacgagcgtagtattacttactgcagcttcgtatttcgactaatcgtaagtggaacggttnttattcgttacgttacggtacggtacggtaaccgtaaggtcgtacgtccgtacgtacggtaccgaaccgacccgaacg

SEQ ID NO: 404592 - DNA, 554 bp, Homo sapiens
  misc_feature: GZ8MTXP02F9UDS.39.86.H09.1.454.CMB.2.raw
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaatcatcatttatgaggtcagtaatcggccctgaggggtttcctaatcgcttctctggctccaagtctggaccaacgacggcctccctgacctatctcgtgggcctaccgaggctggacggaccgagggccttaggaatttacgttactggactacgccttactatttcgactaaatcgagtgaggtctttaatcggttcgttacgggagttacggggaacctaagggtcaacgttcgtacctaggtcacgacccgaaaccgg

SEQ ID NO: 404593 - DNA, 588 bp, Homo sapiens
  misc_feature: GZ8MTXP02FPBP3.39.86.H09.1.454.CMB.2.raw
  modified_base (228)..(228): a, c, t, g, unknown or other
  modified_base (253)..(253): a, c, t, g, unknown or other
  modified_base (274)..(274): a, c, t, g, unknown or other
  modified_base (306)..(306): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccngcagtgacggttggggttatgactntgtctcgtggtaccagcaatnccaggcacacgacccccaaatcatctatttangagtcagtactccgcctgtagggtttacctagtcgctttctcgtcggtctccgaagtcgtgaccaaccgcgtccctccgtacgacctactctcgtcggcctcgacggctggaggacgagtcgtagtattacgtactcgcgacgtactcgtattgtactacgtacgtaggtacggtacgtacgtttagtcggtttaccgttaacgggtaacgggttacgggaaccgttaaacggtcgtacgttaccggtaccgttacggtaccgaaccgtacccgaaacccgg

SEQ ID NO: 404594 - DNA, 505 bp, Homo sapiens
  misc_feature: GZ8MTXP02JZFYI.39.86.H09.1.454.CMB.2.raw
  modified_base (303)..(303): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgcccccaaactcatcatttangagtcagtaatcggcctgaggggtttccaatcgctttctctggctccaagtctggcctaacacggccctccctgacccatctctcgggctccaggcctgacggacgaggctgattattacgtgcagctcatttgacatcagtgacggtcttagcgtctaggagtcggaccaaggtcagtcgtcgtaggtcacgacctaaccg

SEQ ID NO: 404595 - DNA, 535 bp, Homo sapiens
  misc_feature: GZ8MTXP02IS9W3.39.86.H09.1.454.CMB.2.raw
  modified_base (309)..(309): a, c, t, g, unknown or other
  modified_base (370)..(370): a, c, t, g, unknown or other
  modified_base (379)..(379): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgcccctgactcaggctgcctccgtgtctgggtctctaggacagtcgatcaccatctcctgcactggaaccagcagtgacggttgggggttatgactatgtctcctggtaccagcaatactccaggccacacgcccccaaactcatcatttangaggtcagtaactccgccctgtaggggtttctaatcgtcttctctggctcagtctggcacncgcctcccnaccatctcgtgggcctcgagctaggaggacgagctgtagttattacctgctacgctactagtttcgactaatcgagttcgaggtactttagtcgttacgttacgggaacgtcggaaccgtaaggtcacgttcggtcgtagtaccacgacccgaacg

SEQ ID NO: 404596 - DNA, 517 bp, Homo sapiens
  misc_feature: GZ8MTXP02F7YG4.39.86.H09.1.454.CMB.2.raw
  modified_base (271)..(271): a, c, t, g, unknown or other
  modified_base (305)..(305): a, c, t, g, unknown or other
  modified_base (310)..(310): a, c, t, g, unknown or other
  modified_base (317)..(317): a, c, t, g, unknown or other
  modified_base (459)..(459): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctctgcactggaaccagcagtgacggttggggtatgactatgtctctggtaccagcaatanccaggcacacgacccccaaatcatactatttacngagtnagtaacncggcctagtagggtttacctaatcgtcttctctgctcaagtctggaccacacggtcctcctacgaccatctcgtgggctccgagctggacggacgaggctagattatactgcagtctactattgactaatcagtagacggtnttagtcgtactacggagtcggaactaggtcacgtcgtactaggtcacgaccgaacccg

SEQ ID NO: 404597 - DNA, 569 bp, Homo sapiens
  misc_feature: GZ8MTXP02GZL8B.39.86.H09.1.454.CMB.2.raw
  modified_base (227)..(227): a, c, t, g, unknown or other
  modified_base (304)..(304): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttggtagttataactatgtctcttgtaccaacatcacccaggccaaagtccccaaactgatgatttangaggtcacgtaaacggcctcgtagggtttcaatcgccttctctggcctcaagtctggtcaactaccggcctccctgaccatctcgtgggctcgaggctaggacggacgacggcttactacttattattggctagctacaatactacgaatctaattactcgtaacgtttggggttcgttacggggacggtacgggtaccgtaccgtacgtaccgttcgttaacggccgacggacccgaacggtcctccgcccccgttggttaccc

SEQ ID NO: 404598 - DNA, 555 bp, Homo sapiens
  misc_feature: GZ8MTXP02IP7SZ.39.86.H09.1.454.CMB.2.raw
  modified_base (304)..(304): a, c, t, g, unknown or other
  modified_base (315)..(315): a, c, t, g, unknown or other
  modified_base (342)..(342): a, c, t, g, unknown or other
  modified_base (425)..(425): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactcgaaccagcagtgacgttggggtatggactatgtctcctggtaccagccaatactccaggcacagcccccaaactcatcatttangaggtcaagtntcgccctgagggttccaatcgctttcnctggctcagtctggcaacacggcctccctagaccctatcctcgtcggcctccaggctcggaggacgaggtctgattacttacngtcacgtcctagtaattttcgactaagtccgtaaggtgaacggtcttagtcggttacgttacgggaaacgttcgggaaccctaaagggtctaacgttccggtaccgtaggtaccgacgacccgaaaccgg

SEQ ID NO: 404599 - DNA, 683 bp, Homo sapiens
  misc_feature: GZ8MTXP02G2CUM.39.86.H09.1.454.CMB.2.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttgggggttatggactagtgtcctcccgtacgtaccagactaatactaccgagaccacgaccccgaaccccctaaactacactactatttagaggtacgtactaagtaacgtccgtcctaggttacggttacctaacgtcttcttacgtcgtcgtctacgtacgtcgtacggacctaaccggacccgtcccttacccgacgtacctacttccgtcgggtcggcccttacgacggtacgtacgggaacggacggacgtaacgtagttaaactttacgttaacgcgaccggtactccttaacgttacgtttacgaaactaaacgttccgtaaggtcggtaaacggtttccttaaggttccgttacgggttaaacgggaacggtaaccgtaacgtacggtaacgtacgttacccgtacgtacggacccgaccgaacccgtaaacccgg

SEQ ID NO: 404600 - DNA, 565 bp, Homo sapiens
  misc_feature: GZ8MTXP02GHTA6.39.86.H09.1.454.CMB.2.raw
  modified_base (226)..(226): a, c, t, g, unknown or other
  modified_base (305)..(305): a, c, t, g, unknown or other
  modified_base (416)..(416): a, c, t, g, unknown or other
  modified_base (438)..(438): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatctcctgcactggaaccngcagtgacggttggggttatgactatgtctcctggtaccagcaatatccaggcacacgacccccaaatccatcatttangagtcagtaactcggcctgtagggttccaatcgcttctcgtgctccaagtctaggaccaacgacgtccctccacgaccctatctcgtgggcctccgagggctgggacgagngtacgtagtaatttacgttacngacgtagccttattagtttccgaatacgtagtagtgtacgttatttaggttcgttacggttacggtaggtacggaaccgtaggtaacgtacgtccgttacggtacgtacgacccgaaccgtaacccg

SEQ ID NO: 404601 - DNA, 497 bp, Homo sapiens
  misc_feature: GZ8MTXP02F287I.39.86.H09.1.454.CMB.2.raw
  modified_base (301)..(301): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacagcccccaaatcatcatttangagtcagtaatcggcctcgaggggtttcctaatcgcttctctgctcagtctgcaacacgcctcctgaccatctctggctccgagctgagacgaggctagattatactgacagctcatttgactaatcagtgaggtcttagtcgtcttacggaagtcgggaccaaggtcagtccgtactaggtcacgacccaaacgg

SEQ ID NO: 404602 - DNA, 554 bp, Homo sapiens
  misc_feature: GZ8MTXP02HJSFC.39.86.H09.1.454.CMB.2.raw
  modified_base (307)..(307): a, c, t, g, unknown or other
  modified_base (370)..(370): a, c, t, g, unknown or other
  modified_base (381)..(381): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgacgttggggtatgactatgtctcctggtaccagcaatatccgaggccacacgacccccaaactcatcatttangagtcagtaactcggcctgtaggggtttcctaatcgtcttctctggctcgaagtctggcaacnccgtcctcccncgaccactctcgtcgggcctccgaggtctaggaacggacgaggtctagtactttattacgtgaccagtcctactatttcgactaaagtcgaggtagtacgtctttagtcgttacgttacgggaaggtcgggtaacctaaggtctacgtcgtcgtagcgacgtacccgaaccgg

SEQ ID NO: 404603 - DNA, 487 bp, Homo sapiens
  misc_feature: GZ8MTXP02JPEKC.39.86.H09.1.454.CMB.2.raw
  modified_base (415)..(415): a, c, t, g, unknown or other
  modified_base (480)..(487): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaactcatcatttatgaggtcagtaatcggccctcaggggtttctaatcgcttctctggctccaagtctggcaacacggcctccctgaccatctctggctcaggctgaggacgagctgattatactgccagctcatttgcaatcagtgaggtcttagtgtcttacggagtgggaccaaggtcatcgtctaggtcacgcccaaggcccaaccccnctgtcactctcgtcccgccctacctcactagcgtcgactgacgcgggctggcgaacgcgcatagnnnnnnnn

SEQ ID NO: 404604 - DNA, 747 bp, Homo sapiens
  misc_feature: GZ8MTXP02I5E6J.39.86.H09.1.454.CMB.2.raw
  modified_base (218)..(218): a, c, t, g, unknown or other
  modified_base (231)..(231): a, c, t, g, unknown or other
  modified_base (256)..(256): a, c, t, g, unknown or other
  modified_base (279)..(279): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgactccactctcctctnacacgtacgaacngacgtagtcggtaggggttagggtnacgtatgtctcctcgtacgacanataatcacgacgaccacaccccaaaccctaactactactactttaatttagaggtacgtacgtaagtaccggtcccgtaccgtaggggtttacggttaacctacgtccgttacttcgttcggtaccgtaccctacgtacgttcggtaccgaaacccgaacccggtcccgtccccttaccggaacctaacccttcgtttcccgtacggggtccggtacccctacggggccggtaggtaacggggaacgggacgtacggttacttaaagtttaaactttaccggtcgcgaccggtaacttccttaagtttacggttaccaaaacgttacgtaggtaggtacgggtactttacgtttaggtccggtttacgggggtaaaggtacggggtaacccggtaaacgttacggtaaccttaccggttcccggttaaacggtacggaacccgaaccccggaaacggtaaaccccccg

SEQ ID NO: 404605 - DNA, 514 bp, Homo sapiens
  misc_feature: GZ8MTXP02GDX72.39.86.H09.1.454.CMB.2.raw
  modified_base (267)..(267): a, c, t, g, unknown or other
  modified_base (294)..(294): a, c, t, g, unknown or other
  modified_base (304)..(304): a, c, t, g, unknown or other
  modified_base (315)..(315): a, c, t, g, unknown or other
  modified_base (368)..(368): a, c, t, g, unknown or other
  modified_base (376)..(376): a, c, t, g, unknown or other
  modified_base (393)..(393): a, c, t, g, unknown or other
  modified_base (400)..(400): a, c, t, g, unknown or other
  modified_base (413)..(413): a, c, t, g, unknown or other
  modified_base (421)..(421): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccagcagtgacggttggggtatgactatgtctcctggtaccngcaatatccaggcacacgcccccaaancatcatttangagtcagtaanccggcctgtaggttctaatcgcttctctgctcaatctggcaacgcgcctcccngaccatcncgtggctccgagctagngaacggngctagtattatcngacatctntattgactatcgagtagtacgtcttagttcgtacgttacggacggtacggaacgtaagtcgtacgtcggtaccgacgtacaccgacccgaacg

SEQ ID NO: 404606 - DNA, 515 bp, Homo sapiens
  misc_feature: GZ8MTXP02JPBKL.39.86.H09.1.454.CMB.2.raw
  modified_base (301)..(301): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctggtctctaggacagtcgatcaccatctcctgcactggaaccagcagtgacgttggggttatgactatgtctcctgtaccagcaatatccagcacacgcccccaaactcatcatttangagtcagtaatcgcctcgtagggtttcctaatcgcttctctgctccaagtctggcaacacgcctccctgacccatctctggcctcgagctgaggacgaggctgattattactgcagtctactatttgactaatcgtagtgaggtcttagtcgttcgttacggtagtacggtaaccaggtctacgttcgtcgtacggtacacgacccgaaaccgg

SEQ ID NO: 404607 - DNA, 531 bp, Homo sapiens
  misc_feature: GZ8MTXP02F8RAJ.39.86.H09.1.454.CMB.2.raw
  modified_base (304)..(304): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgcccccaaactcatcatttangagtcagtaatcgcctcgaggggtttcctatcgcttctctgctcaagtctggacaacacggcctccctgaccatctcgtcgggctcccgaggctggaggacgaggctagtattattactgacagccttcatttgacaatcgagtgacggtctttatcgttacgttacggaacggttcggaacctaagggtctacgtccgtaccgtaggtaccaacgcccaaacccgg

SEQ ID NO: 404608 - DNA, 527 bp, Homo sapiens
  misc_feature: GZ8MTXP02I0IDX.39.86.H09.1.454.CMB.2.raw
  modified_base (216)..(216): a, c, t, g, unknown or other
  modified_base (339)..(339): a, c, t, g, unknown or other
  modified_base (350)..(350): a, c, t, g, unknown or other
  modified_base (368)..(368): a, c, t, g, unknown or other
  modified_base (516)..(516): a, c, t, g, unknown or other
  modified_base (518)..(519): a, c, t, g, unknown or other
  modified_base (521)..(522): a, c, t, g, unknown or other
  modified_base (524)..(524): a, c, t, g, unknown or other
  modified_base (526)..(527): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaaatatccaggcacacgcccccaaatcatcatttangaggtcagtaatcggccctcgagggtttctaatcgcttctctggctccaagtctggcaacacggcctccctgaccatctctggcctccaggctgaggacgaggctgattatactgccagtctnatttgacaatnagttgaggtcttatcgtnttacgggaagtcggacaggtcacgtcgtcgtacggtacacgacccgaagacccaaaccctactcgtactactccgttccgtccccgtccctcctacactacgcgcgtacgtgacggcgggtcgtcgggacgaacggcgacgtagtagngnncnncncnn

SEQ ID NO: 404609 - DNA, 557 bp, Homo sapiens
  misc_feature: GZ8MTXP02HY8RH.39.86.H09.1.454.CMB.2.raw
  modified_base (227)..(227): a, c, t, g, unknown or other
  modified_base (306)..(306): a, c, t, g, unknown or other
  modified_base (369)..(369): a, c, t, g, unknown or other
  modified_base (447)..(447): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttggggttatgactatgtctcctggtaccagcaatatccaggcaccacgccccccaaatcaatcatttangagtcagtaatcggccctgtaggggtttcctaatcgcttctctggctccaagtctggccaacnccggcctccctgacccatctcgcgggtcctccgaggctggacggacgaggcttggaactttattactgtacagtcctntaatttcgactaaatcgaagttgacggtctttaagtcgtcgtttacggaaggttcggaacccaaagggttctaacgtcgttacccgtaaggtccaacgccccgaaaccgg

SEQ ID NO: 404610 - DNA, 663 bp, Homo sapiens
  misc_feature: GZ8MTXP02HNAJD.39.86.H09.1.454.CMB.2.raw
  modified_base (227)..(227): a, c, t, g, unknown or other
  modified_base (306)..(306): a, c, t, g, unknown or other
  modified_base (336)..(336): a, c, t, g, unknown or other
tcagtcgcactagtcacgaccggtgctcgatttagtgctatagacttgggtttgggggggtctcaggaggcagcgctctcaggacatctccaccatggcctggactctgctgctcctcaccctcctcactcagggcacagggtcctgggcccagtctggcctgactcagcctgcctccgtgtctgggtctcctggacagtcgatcaccatctcctgcactggaaccngccagtgactagttggtagtgataactatgtctctgtaaccaacaactaccgaggaaccgaccccaaatcatcatttangagtacaatacgccgcctgaggtacttcgngtactcgtcttcgtctcggctccgtaagtcgtcgaccaacgacccggccttacccgtcgaacctctctcgtcgggtcctacgaggtatggaacggaacggtacgtactacggttaatttaacgtttacgtcggttaccttaacgttcttaacgttttacggaacggttacgaccgtaaccggtaccccttacccccgttcggttaccgggtttcccggtttaccgggggacggggtaaaccggtaacccgggtaacgggttcccggtaacccgtttccggttacggtaccgaccgtacccggaaggtccccgttaccgtccccccgg

SEQ ID NO: 404611 - DNA, 583 bp, Homo sapiens
  misc_feature: GZ8MTXP02IBUGR.39.86.H09.1.454.CMB.2.raw
  modified_base (408)..(408): a, c, t, g, unknown or other
  modified_base (463)..(463): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccagcacacgcccccaaactcatcatttatgaggtcagtaatccggtccctagtaggggtttaccctaagtccgtcttctcgtcggctcctaagtctcggtaccaaaccgccggtcccttccccgtcgaaacccncttctcgtcgggcctccgaggctggaggtcgagctgattattacgtgacagcctntactttgactaatcgtagtagtaggtctttagtcggttcttacgggaaacgttcggggaaccctaaaggtcccgtaagttcccggttacgtacggttaccgaccggacccgaaacccggg

SEQ ID NO: 404612 - DNA, 501 bp, Homo sapiens
  misc_feature: GZ8MTXP02J2401.39.86.H09.1.454.CMB.2.raw
  modified_base (303)..(303): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctcctggtaccagcaatatccaggcacacgacccccaaatcatcatttangagtcagtaatcgaccctgagggtttccaatcgcttctctggctccaagtctggcaacacgcctccctgaccatctctcgggctcgagctgacggacgaggctgtattatactgcagctctattgacaatcagtgaggtcttagcgtacttcggagtcgggaacaaggtcagtcgtacgtaggtccacgcccaaaccg

SEQ ID NO: 404613 - DNA, 549 bp, Homo sapiens
  misc_feature: GZ8MTXP02FYFFG.39.86.H09.1.454.CMB.2.raw
  modified_base (306)..(306): a, c, t, g, unknown or other
  modified_base (426)..(426): a, c, t, g, unknown or other
  modified_base (455)..(455): a, c, t, g, unknown or other
  modified_base (461)..(461): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctcctggtaccagcaatatccaggcacacgacccccaaatcatcatttangagtcagtaatccggcctagtagggttcctaatccgtcttctctcggctccgaagtctaggaccaaccgaccggtccctccctgaccctatcctcgtggcctaccgaggctggaggacgnggtactagtattacttactgacagtcctntatttnactatcgagtggagtcttagtcgttacgttaggacggttacggaacctaaggtctacgtccgtacgtaggtacacgacccaaacccgg

SEQ ID NO: 404614 - DNA, 630 bp, Homo sapiens
  misc_feature: GZ8MTXP02FO2CZ.39.86.H09.1.454.CMB.2.raw
  modified_base (228)..(228): a, c, t, g, unknown or other
  modified_base (306)..(306): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacggttggggtatgactatgtctctggtaccagacaatatccaggcacacgacccccaaatcatctatttangagtcagtactcgcctagtagggtttcctagtcgtcttctcgtcgctccaagtctacgacctaaccaccggtcctaccctcgaccctatccgtcgtcgggccctaccgaggtcgtacgggacgggacggtacggtacgttaggtaactttacgttacgttcggacctaacgtcttacgttaatttcgaactaacgtacgtaggttaggtacgggttactttaagttcggttacggttacggggtaaacgggtacggggaacccgttaaggtccgtaacgttccggttaccgtaacggtaccgaaccgaaccccggtaaacccgg

SEQ ID NO: 404615 - DNA, 607 bp, Homo sapiens
  misc_feature: GZ8MTXP02HXG1Z.39.86.H09.1.454.CMB.2.raw
  modified_base (226)..(226): a, c, t, g, unknown or other
  modified_base (271)..(271): a, c, t, g, unknown or other
  modified_base (304)..(304): a, c, t, g, unknown or other
  modified_base (317)..(317): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatctcctgcactggaaccngcagtgacggttggggtatgactatgtctctggtaccagacaatntccaggcacacgacccccaaatcatctatttangagtacagtaacnccggtaccctgtacgggtttcctaacgtcgtcttctctcggctcgaagtctggacctaacgaccgtcctccctagacctacgtcctcgcgggtccctaccgaggtcctagggaacgggacgaacgggtcttaggtaaactttacgttacgtgactaacgtctacgtagtttacgacttaagtacgaggtacgtacggtctttaaagtcgttaccggttaaggtacggttacggaacgtaaggtaacgtaacgttacgtacccgtacggtaccacggacccgtaaacccgg

SEQ ID NO: 404616 - DNA, 656 bp, Homo sapiens
  misc_feature: GZ8MTXP02GKWKG.39.86.H09.1.454.CMB.2.raw
  modified_base (227)..(227): a, c, t, g, unknown or other
  modified_base (350)..(350): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctctgcactggaaccngcagtgacggttggggttatgactatgtctctggtacagcaatatccagcacacgaccccaaactcatctatttatgagtcaagtactccggcctagtagggtttacctaagtccgtcttctntcggctcctaagtcgtaggaccaaccgtaccggtccctccctacgtaccctaacgtccgtcggtcggtcccgttacccgaggtccgtaggaacgggtacggacggtcttaggtaaatttacgtttaccaggacctagtaccttacgtaatttcgacttaaaccgtacgtaaggttggtaacggttactttaaggttccgtttacggttaacggggtaacgggtacgggtaaacccgttaacgggtaaccttaaacgtccggtttaaaaccggtcggtaccgtaaccggaccccggtaaaaccccgg

SEQ ID NO: 404617 - DNA, 551 bp, Homo sapiens
  misc_feature: GZ8MTXP02FLM27.39.86.H09.1.454.CMB.2.raw
  modified_base (324)..(324): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcttggtaccaacatcacccaggcaaagtccccaaactgatgatttatgaggtcactaaacggccctnaggggtttctaatcgccttctctgctccaagtctggcaacacggcctccctgaccatctcgtggctccaggctgaggacgagctctcttattattgcagctactatacttacaaagctaaattactactacgttgggttcggttcggggcggacggggtaccggaccgtcggaccgttccgttaaggtccgacggcccgaaacggcctacgcccccgtcggtacccg

SEQ ID NO: 404618 - DNA, 509 bp, Homo sapiens
  misc_feature: GZ8MTXP02JTI3A.39.86.H09.1.454.CMB.2.raw
  modified_base (343)..(343): a, c, t, g, unknown or other
  modified_base (376)..(376): a, c, t, g, unknown or other
  modified_base (404)..(404): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcacttgaaccagcagtgacgttggggttatgactatgtctctggtaccagcaatatccaggcacacgcccccaaactcatcatttatgagtcagtaatcgcctagaggggtttcctatcgcttctcngctcagtctgcacacgcctcctgaccatctcgnggcctcgagctagagaccgagctgattntactgcagctgtactttgactaatcagtcgaggtcttagtcgtacgtttagggaacgtcggtaaccaggtcacgttacgtcgtaacgtccgacgacccgaaacgg

SEQ ID NO: 404619 - DNA, 668 bp, Homo sapiens
  misc_feature: GZ8MTXP02G0EY3.39.86.H09.1.454.CMB.2.raw
  modified_base (248)..(248): a, c, t, g, unknown or other
  modified_base (310)..(310): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctctgcactggaaccagcagtggacggttggggttangactatgtctctggtaccagacaatactccaggcacacgacccccaaactcatctaatttangaggtcagtaactccggcctagtacgggtttcctaagtcgtcttcttcgtacgcttccaaagtctagggacccaaacgaccggtcccctacccgtacgaaccctactccgttcgtcggggtaccctcccgaagggtccgtagggaacgggaaaccggtagggtacttaaggtaatttttaaacttcgacggtacaacgtccctaggttaaccgtttaactaacgtaacgtacgtaaggtacggtacggttacgtttacgttcggttaacgggttaacgggtaacggtacgggtaaaccgtaacggtaacgtaacgttaccggttaccgtacggtaaccgaacccgaacccgaaaccgg

SEQ ID NO: 404620 - DNA, 547 bp, Homo sapiens
  misc_feature: GZ8MTXP02JHOKX.39.86.H09.1.454.CMB.2.raw
  modified_base (284)..(284): a, c, t, g, unknown or other
  modified_base (303)..(303): a, c, t, g, unknown or other
  modified_base (430)..(430): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttatgactatgtctctggtaccagcaatatccaggcacgacnccccaaatcatctatttangagtcagtaactccggcctgtagggtttaccatcgtcttctcgtcgctccaagtcgtagaccaacgcggtccctcctacgaccatctcgtggcctcgaggctggaggacgagcgtgtattacttacncgtacgagtctactatttgacctaatcgtagtagacggtctttaagtcgttacgttacgggtaagttacgggaacctaaggtcgagtccgttacgtacggtacaccgacccgaaccg

SEQ ID NO: 404621 - DNA, 663 bp, Homo sapiens
  misc_feature: GZ8MTXP02I0NJU.39.86.H09.1.454.CMB.2.raw
  modified_base (288)..(288): a, c, t, g, unknown or other
  modified_base (655)..(655): a, c, t, g, unknown or other
  modified_base (659)..(659): a, c, t, g, unknown or other
  modified_base (663)..(663): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaatatccaggcacagccccaaatcatcatttatgaggtcagtaatcggcctcagggtttctaatcgcttctcgtggctccagtctggcaacacgcctcctgaccatcnctggctccagctgaggaccgaggctgacttatactgccagctctatttcgacaatcgagtggtacggtctttagtcgttcgtttacgggtaaagttcggggaaacccgtaaggttacctagttacccggttaccgtacggggttccaaccggacccccgaaaacgggaccccctaaaacccccgtaacctttcggttacccctaaccttcccgtttaccggtttaccccccctaacccccgttcccgttaaccctaaccgttaacggttccggacccgtaaaccgttgggaaaccgggccgggggtacccgttcgggggtaaccaaaacgggggcccgaaacgttaacggtaacgcgtacgacgacncgcncacn

SEQ ID NO: 404622 - DNA, 641 bp, Homo sapiens
  misc_feature: GZ8MTXP02HF6BV.39.86.H09.1.454.CMB.2.raw
  modified_base (228)..(228): a, c, t, g, unknown or other
  modified_base (318)..(318): a, c, t, g, unknown or other
  modified_base (331)..(331): a, c, t, g, unknown or other
  modified_base (349)..(349): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcaggcacagggtcctgggcccagtctgccctgactcaggctgcctccgtgtctgggtctctaggacagtcgatcaccatcctcctgcactggaaccngcagtggtacggttggggttaatgactagtgtctccgtggtaccagacaatactccgaggccaacaccgacccccaaatcatctatttangagtacaagtacnccgcctagaggtacttcngtactcgtcttctcgtggaccttaccgaagtccgtacggaccaaaccgtcccggtcccttacccgtacgacctacgtccgtccgtcggacctaccgaggaacgtaggaacggacgacggtcgtagttaactttacgttacgtacgtaccttaacgtacgttaacgtttacggaaacggtacgacgaccgtacccgtacccgttcgttacgggtccggttacgggaccgggtaacggacccgtaaggtccgtacccgttcggttacggtacgaccggacccgtaacggccccg

SEQ ID NO: 404623 - DNA, 685 bp, Homo sapiens
  misc_feature: GZ8MTXP02JJP2S.39.86.H09.1.454.CMB.2.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgtacggttggggtatgactatgtctcctggtaccagcaatatccaggcacacgacccccaaactcataccccctatttatagtaggtacaagtaacgtccggtccctacggtacgggtttacctaactcgtcttctctcggtctccgtaagtcgtacggaccaacgaccggtccctcccgtacgtaccctacgtccgtcgtcgggtccgtacccgacgggtccgtagggacgggacggacggtaccgtagttaacgtttaacgttaccgtagtaccggtagtacccttacgttaacgtttacggtaactaaacgtaccgtaggtaaccgggtaggttaccgtttaagttcgggttaccggtttaagggtaaacgggttacggggtaaccgtaacggttaacgtacggttaccggtaccgttaacggtaccgtaaccgtacccgaaaccccgg

SEQ ID NO: 404624 - DNA, 695 bp, Homo sapiens
  misc_feature: GZ8MTXP02I850D.39.86.H09.1.454.CMB.2.raw
  modified_base (304)..(304): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggttatgactatgtctctggtaccagcaatactccaggcacacgacccccaaatcatcatttangagtcagtaatcggccctagtacggggtttcctaagtccgtacttctcttcggcctcctaaagtcctgggacctaaaccgaccgggtcccttaccccgtacgtaaccctaacgttcccgtaccgtccgggggccctttacccggacggggtccgttagggaacgggaacgggacggggtccttacggtaaatttttacgtttaaccgtggacctaaacggtcctttacgtaatttttacggacctaaatttccgaaggttacggtaacggtctttaaagttcggttaccgtttacgggggtaaacggttcgggggaaacccgaaaaggggtttccaacggttaccggtaccccggttaagggttaccaaccggtaaccccctaaacccggg

SEQ ID NO: 404625 - DNA, 586 bp, Homo sapiens
  misc_feature: GZ8MTXP02JCXF8.39.86.H09.1.454.CMB.2.raw
  modified_base (312)..(312): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctcgtgtctgggtctctaggacagtcgatcaccatctcctgcactggaaccagcagtgacggttggggttatgactatgtctcctggtaccagcaatactccaggcaccgacgacccccaaatcctatctaattttanggacgttacagttaaacgtccggcccttgtaggggtttctaactcgtcttctcgtcgctccgaagtctggactaaccgacggtccctccctgaccctatcctcggtcggtcctccgcggtctagggaacggacgacggtcttaggtatttaacgtttagcggtacacgtctacgttatttcgactagtactagtgtacgtctttagtcgttacgtacggtagtacgggaaccgtaggtcgtacgtacgttctacggtacaccgaccgtaaaccg

SEQ ID NO: 404626 - DNA, 554 bp, Homo sapiens
  misc_feature: GZ8MTXP02JZ86Y.39.86.H09.1.454.CMB.2.raw
  modified_base (303)..(303): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctggtctctaggacagtcgatcaccatctcctgcactggaaccagcagtgacggttggggtatgactatgtctcctggtaccagcaatatccaggcacacgacccccaaatcatcatttangagtcagtaatccggccctgtaggggtttcctaagtcgcttctctggctcaagtctggacaacgccggccctcccgtcgaccatcctcgtcgggcctccgaggccgtaggacgggaccgaggtctagtatttagtactgcctagctactatttcgactaatcgtaagtgtaggtctttagtcgttacgttacgggaacgtacgggaaccaaggtctaacgtcgtaccgtaggtccacgacccgaaacccgg

SEQ ID NO: 404627 - DNA, 564 bp, Homo sapiens
  misc_feature: GZ8MTXP02G4PZF.39.86.H09.1.454.CMB.2.raw
  modified_base (227)..(227): a, c, t, g, unknown or other
  modified_base (303)..(303): a, c, t, g, unknown or other
  modified_base (434)..(434): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttggggttatgactatgtctcctggtaccagcaatatccaggcacacgcccccaaatcatcatttangagtcagtatcgcctgtagggtttcctaatcgtcttctctggctccaagtctaggaccaacacggccctccctgacccatctcgtgggctcccgaggctggacggacgaggctagtaatttacgtttaacncgacagtctactaattacttaacgaagtactaaagttaacttacgttacgtttccgtttacgggacggtaacggaccacgtccgtacgaaccgtacgtacggtacgaccgacccgtacggtcccgtcccg

SEQ ID NO: 404628 - DNA, 710 bp, Homo sapiens
  misc_feature: GZ8MTXP02F1ZG9.39.86.H09.1.454.CMB.2.raw
  modified_base (247)..(247): a, c, t, g, unknown or other
  modified_base (272)..(272): a, c, t, g, unknown or other
  modified_base (304)..(304): a, c, t, g, unknown or other
  modified_base (315)..(315): a, c, t, g, unknown or other
  modified_base (341)..(341): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacggttggggttanggactatgtctctggtacagcaatnccaggcacacgacccccaaatcatcaatttangagtcagtacnccgtcctgtagggttacctagtcgtnttctctcggctccgtaaagtctacggaccaacgtaccggtcccctaccctacgtaacccctagttcccgttacgttcgggtcccgttacccgacggtccgtacgggaagggaccgaggggtaccttaggtaaacttttaacgtttaacccgtagtacccggtacgttaccccgtactttaaagttttcggaaaccttaaacgttcccgtaaaagggtttccggtaagggtttacccgttttaggttaaccggttttacggttaaccggtaaaacggggtttacccgggaaaccgttaaaacggtaaccgtaaccgttaccggtaccggttaacggttaccgaaaccggttaccccgaaaacccccgggg

SEQ ID NO: 404629 - DNA, 650 bp, Homo sapiens
  misc_feature: GZ8MTXP02JHRZB.39.86.H09.1.454.CMB.2.raw
  modified_base (226)..(226): a, c, t, g, unknown or other
  modified_base (313)..(313): a, c, t, g, unknown or other
tcagtcgcactagtcacgaccggtgctcgatttagtgctatagacttgggtttggggggggtctcaggaggcagtgctctcaggacatctccaccatggcctgggctctgctgctcctcaccctctcactcagggcacagggtcctgggcccagtctgccctgactcaggctgcctccgtgtctgggtctctaggacagtcgatcaccatctctgcactggaaccngcagtgtacggttggggtatgactatgtctccgtggtaccagactaatacgtccaggcacaaccgacccccaaatcaatctatttangtacggtctagtaacgtcgccctacggtaggggtttacctaacgtcgtcttccgtcgtcggctccgtaagtcgtacggacctaacgtcggtccctacccgtacgacccgtaacgttccgtcgtcgggtccctaccgaggtcgtaggacgggacgtaggtacttaggtactttacgtactcggtctaacctcgtaccgttatttacgactaagtacgtaggtaggtagttccgtttaagttcggttacggtttaacgggaacggtacggtaaccgtaacggttaacgtacgttacggtttaccgacgggttacctaaccgggtaccctaaaacccggg

SEQ ID NO: 404630 - DNA, 653 bp, Homo sapiens
  misc_feature: GZ8MTXP02FTO50.39.86.H09.1.454.CMB.2.raw
  modified_base (229)..(229): a, c, t, g, unknown or other
  modified_base (248)..(248): a, c, t, g, unknown or other
  modified_base (276)..(276): a, c, t, g, unknown or other
  modified_base (308)..(308): a, c, t, g, unknown or other
  modified_base (432)..(432): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatcctcctgcactggaaccngcagtgacggttggggtangactatgtctcctggtaccagcaatacnccaggcacacgacccccaaatcatctatttangaggtcagtaactccggcctagtagggtttccctaagtcgtcttctcgtcggtctccgaagttccgtaggacccaacgaccggccctcccgtacgacctacttccgtcgtcgggtccctaccgnggtcgtagggacggaacggacggtaccgttaggtaaatttacgttaacgtggtaaccgtaagtccttacttaagtttcgaacctaagtcgtacggtagtaacggttatttacggttcggttaccggttacgggtaaacgggttaccgggaaacccgtaaggggttaacctacggttaccgttacccggtaggtaccgaaccggttaaccccgaaaccccgg

SEQ ID NO: 404631 - DNA, 662 bp, Homo sapiens
  misc_feature: GZ8MTXP02JJRL0.39.86.H09.1.454.CMB.2.raw
  modified_base (230)..(230): a, c, t, g, unknown or other
  modified_base (258)..(258): a, c, t, g, unknown or other
  modified_base (274)..(274): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcaccatcctcctgcactggaaccngcaggtggtacggttggggttatgactntgtctcctaggtaccngactaatactccgaggccacaccgacccccaaactccatactaatttataggacgtcaagtaactccggtccctacggtacgggtttacctaacgttccgtactttccgtcgtcggtcctaccgtagtcgtacggacctaaaccgccggtcccctcccgtacgaacctcttccgtcgtcgggccctacgacggtcgtagggacgacgacggtctacgtatttagttacgtcggctaagtcctacttagtttcaactacgtagtagtaggtaacggttcgtttacgttcggttaacggtttaccgggaagggtacccggtaacgtaaccggtaacgtaacggttaccggttaccggtacgtaccggaaccgaacccggtaaacccccgg

SEQ ID NO: 404632 - DNA, 505 bp, Homo sapiens
  misc_feature: GZ8MTXP02F6OQL.39.86.H09.1.454.CMB.2.raw
  modified_base (346)..(346): a, c, t, g, unknown or other
  modified_base (437)..(437): a, c, t, g, unknown or other
  modified_base (496)..(496): a, c, t, g, unknown or other
  modified_base (498)..(499): a, c, t, g, unknown or other
  modified_base (501)..(505): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaatatccaggcacacgcccccaaatcatcatttatgaggtcagtaatcggccctgtagggtttctaatcgtcttctctggctccaagtctggcaacacggccctccctgaccatcctctgggcctccgaggctggaggacgaggctgtaattattactgccagctntatttgacaatcgagtgagtcttagtgtcgttaggaagtggaaccagtcagtcgtcagtcacgccagctcgcccctggcactctcgtcccnccctcctacacgtgtcgcgtacgtgacggtcgggcgtcggacgaacggccgacgatagngnncnnnnn

SEQ ID NO: 404633 - DNA, 597 bp, Homo sapiens
  misc_feature: GZ8MTXP02ICR84.39.86.H09.1.454.CMB.2.raw
  modified_base (273)..(273): a, c, t, g, unknown or other
  modified_base (304)..(304): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttggggtatgactatgtctctggtaccagcaatacnccaggcacacgccccaaactcatcatttacngacggtcaagtaactcggacccctgtaggggtttccctaagtcgctttctcgttggcctcgaagtcgtcggccaaaccgaccgggccctacccctacgaccctaacttccgtcgtcggggccttacccgacggtcgttaggaacgggacgtaagggtctagttaagttaactttactggacagtctctatttgacaatcgagtagtaggttacttagtcgttagtaccggtaagtacgggtaaccgtacggtaactacgtacgtaccgtaggtaccgacgacccgaaaaccgg

SEQ ID NO: 404634 - DNA, 570 bp, Homo sapiens
  misc_feature: GZ8MTXP02HLA22.39.86.H09.1.454.CMB.2.raw
  modified_base (226)..(226): a, c, t, g, unknown or other
  modified_base (314)..(314): a, c, t, g, unknown or other
  modified_base (421)..(421): a, c, t, g, unknown or other
tcagtcgcactagtcacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttggggtatgactatgtctcctggtaccagccaatatccaggcacacgcccccaaatcatcatttactgagtcagtacncggccctgtaggggtttcctaagtcgtcttcgtctggctccgaagtctcggacaacgacggccctccctagaccatcctcgtggggcctacgaggctacggagacgnggtactacggtattacttacgtgacctaggtcctctagtttcgctaagtcgtagtcgtaaaggtctttaagtcgttacgttacgggtaagttcgggaacctaagggtctacgtaccggttacgtacggtactacggacccgaaacccgg

SEQ ID NO: 404635 - DNA, 750 bp, Homo sapiens
  misc_feature: GZ8MTXP02IGJNZ.39.86.H09.1.454.CMB.2.raw
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtcgtgggtctcgtaggacagtcgatcaccatctcctgcacgtgaacagcagtgtacggttggggtatgatatgtctcgtggtaccagacaatactccgaggaccacaccgaccccctaaactccaattacctatttagtggacggttactaacgttaaacgtcccgggtacccgttacggttacggggttttacctaaacgttccgtcctttccgtcggttacggttacccttaccgtaacggttccgtacgggtacccgtaaacccgtcccggggtacccccttccccgtaaccggtaaaccctacccgtttacccgtccggttacggggtacccctacccgggtaaccggggtccgtaacggggtaaacgggaccgggtaacgggtcgttaaacggttaaacttttacgttacgttaccggactacggttacttactagttttacgacttaaagtcgaggttaggtaaacgttgtttacgtacggttacggttaacgggtacggtaacggtaaccgtaggtaacgttacgtaccggtacgtaacggtccaacgaccgtaaacccgg

SEQ ID NO: 404636 - DNA, 695 bp, Homo sapiens
  misc_feature: GZ8MTXP02IZWKK.39.86.H09.1.454.CMB.2.raw
  modified_base (236)..(236): a, c, t, g, unknown or other
  modified_base (481)..(481): a, c, t, g, unknown or other
  modified_base (526)..(526): a, c, t, g, unknown or other
tcagtcgcactagtcacgaccggtgctcgatttagtgctatagacttggggtttgggggggggtctcaggaggcagcgctctcaggacatctccaccatggcctgggctctgctgctcctcaccctcctcactcagggcacgagggtcctgggcccagtctgccctgactcaggctcgcctccgtgtcgtgggtctcgtaggacagtcgatcacatcctcctgcacgtaggaaccngcaggtggtacgggttggggttatgtactagtcgtacctccgtggtaaccagactaaagtactaccgaagcccaacgaccgaaccccctaaaactcaactacttaatttagcggtaagtacaacgtaaacgtcccggtacccttacggtacgggtttcccaacgttccgtactttcgtctacggtccttaccgtagttcccgtaggacccaaccgtacccggtccctacccgtaccgtaaccctntcccgtcggtacggccgtaccgtagggcgtagggaccgggtacgngggtaccttaggttaaactttacgttacgtaacggcgtaactccttacgttactttacgattaacgtacgagtacggtacgtacttaggtcggttacgttaacgggtaacggtacgtaacgaacgttcgtacgttacggtccgtaacggtccaaccggtaccgaacccg

SEQ ID NO: 404637 - DNA, 580 bp, Homo sapiens
  misc_feature: GZ8MTXP02F1E6N.39.86.H09.1.454.CMB.2.raw
  modified_base (249)..(249): a, c, t, g, unknown or other
  modified_base (272)..(272): a, c, t, g, unknown or other
  modified_base (285)..(285): a, c, t, g, unknown or other
  modified_base (572)..(572): a, c, t, g, unknown or other
  modified_base (574)..(575): a, c, t, g, unknown or other
  modified_base (577)..(578): a, c, t, g, unknown or other
  modified_base (580)..(580): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatatccaggcacagcccccaaatcatcatttatgaggtcaagtaatcggcctgagggtttcaatcgnttctctggctcaagtctggcacncgcctcctgaccntctcgtggcctcaggctggaggacgaggtctagattattactgaccagtctactatttcgactaatcgagtgtagttcttagttacgttcgttacgggaagtcgggtaaacgtaacggtctaacgttcccgtacgtacggtacacggaccccgaaacggccccaaaaccccgtcgttcgtacctaccgtttccgttaccgtttcccccacccttccgtacacgtttacgcgacgtacgtcggacggtccgggctcggggacaaacgggccactacggtaagcgcgcncnncnncn

SEQ ID NO: 404638 - DNA, 550 bp, Homo sapiens
  misc_feature: GZ8MTXP02HYDMJ.39.86.H09.1.454.CMB.2.raw
  modified_base (218)..(218): a, c, t, g, unknown or other
  modified_base (338)..(338): a, c, t, g, unknown or other
  modified_base (496)..(496): a, c, t, g, unknown or other
  modified_base (540)..(541): a, c, t, g, unknown or other
  modified_base (543)..(547): a, c, t, g, unknown or other
  modified_base (549)..(550): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagacaatatccaggcacacgacccccaaatcatcatttangagtcagtactcggcctgtagggtttcatcgcttctctggcctccaagtctggcaacgcgcctccctgacccatccttcgtcggttccaggcgtgaggacgaggcttagatttattacgngcacgtcttcgtatttcgacaacttcgagtgaggttcttagtcgttccgtaggacggtcgggaaccaggtctagtcgtacgttaggccacgaccccaaggccccaaacccgtcgttcgcctactcgttcccttacccacctccctacgacgttcggcncgtagtcggcggtcgggactcgggacaaacgggctacgtacagnngnnnnncnn

SEQ ID NO: 404639 - DNA, 598 bp, Homo sapiens
  misc_feature: GZ8MTXP02G7FUV.39.86.H09.1.454.CMB.2.raw
  modified_base (477)..(477): a, c, t, g, unknown or other
  modified_base (584)..(584): a, c, t, g, unknown or other
  modified_base (588)..(588): a, c, t, g, unknown or other
  modified_base (592)..(593): a, c, t, g, unknown or other
  modified_base (595)..(595): a, c, t, g, unknown or other
  modified_base (598)..(598): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaatatccaggcacacgaccccaaatcatctatttatgagtcagtaatccggccctgtagggtttctaatcgtcttctcgtggctaccaagtacgtggacaaacaccggccctacccctgaccatctcgtcggcctcgaggctggaggacgaggtctagatttatactgccctagctacgtatttgacaatcaggtgaacggttcttaagtcgttacgttaaccgggtaagtacgggaaacctagggtacacgtccgttaccgtaggaccaacgacccgaacgaccccaaaacccccngttacgtacccttaccgttcgttacccggttccccaccccttctacaccttagcgtaccgacgtggacggccgggtactacgggaccgaaaggtcccgaacgtaagngcgnacgnncncan

SEQ ID NO: 404640 - DNA, 601 bp, Homo sapiens
  misc_feature: GZ8MTXP02FQCHJ.39.86.H09.1.454.CMB.2.raw
  modified_base (226)..(226): a, c, t, g, unknown or other
  modified_base (245)..(245): a, c, t, g, unknown or other
  modified_base (312)..(312): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctctgcacttgaaccngcagtgacgttggggttangactatgtctcctggtaccagcaagtactccgagcaaccacgccccctaaaactcatcctaatttanggagtcaagtactcgcctacgtaggggtttccattccgtctttaccgtcgtggtactcccgaaagttccgtaggaccctaaccgaccgggtccctcccgtagacccacttccgtcgtgggtccttaccgaggtcgttcggaaggtaccgagggtacttggaactttaagtcgtgactacgctacgttattcgaacagttcaggtcgacggtctttatcggttacgttacggtagtacggacctaggtaacccgagttacggtacctaaggtcaaccgtacccgaaaccg

SEQ ID NO: 404641 - DNA, 562 bp, Homo sapiens
  misc_feature: GZ8MTXP02FWCDA.39.86.H09.1.454.CMB.2.raw
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgtacggttggggttatgactatgtctcgtgtaccagcaatactccaggcacgaccgcccccaaaatcaatctatttagtggacgtcaagtactccgtcctaggtacggttacctacgtcctcttctcgcgtctactagtcgtcgacctaaccgaccgtcctcccgtataccctacttctcggcggtccctacgagtcgaggacggacgagtcttagtatttacgtacgcgtaacagtccttagtacttacgactacgtacgagtacgtagtcttagtcgtacgtacggacgtacgacgtatcgtacgtcgtacgtcacgacaccgaaccg

SEQ ID NO: 404642 - DNA, 507 bp, Homo sapiens
  misc_feature: GZ8MTXP02FGVF9.39.86.H09.1.454.CMB.2.raw
  modified_base (227)..(227): a, c, t, g, unknown or other
  modified_base (342)..(342): a, c, t, g, unknown or other
  modified_base (408)..(408): a, c, t, g, unknown or other
  modified_base (411)..(411): a, c, t, g, unknown or other
  modified_base (421)..(421): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngcagtgacgttgggggttatggactatgtctcctggtaccagcaatatccaggcacacgcccccaaactcatcatttatgagtcagtaatcggcctcgtaggggtttccaatcgnttctctggctcaagtctggcaacacggcctccctcgaccctatctctgggctccaggctgagacgngcngattatactncagctcatttgacatcagtcgagtcttatgtcgtacggagtacgggaccaagggtccagtaccgtcgtacgctacgaccgtaaacg

SEQ ID NO: 404643 - DNA, 621 bp, Homo sapiens
  misc_feature: GZ8MTXP02HTN7Y.39.86.H09.1.454.CMB.2.raw
  modified_base (224)..(224): a, c, t, g, unknown or other
  modified_base (300)..(300): a, c, t, g, unknown or other
tcagtcgcactagtcacgaccggtgctcgatttagtgctatagacttgggtttgggggggtctcaggaggcagcgctctcaggacatctccaccatggcctgggctctgctgctcctcaccctcctcactcaggcacagggtcctgggcccagtctgccctgactcaggctgcctccgtgtctggtctctaggacagtcgatcaccatctcctgcatggaaccngcagtgacgttggggtatgactatgtctctggtaccagcaatatccagcacacgacccccaaatcatctatttacngtagtctaagtactccgtccgtagtacggggtttacctaagtccgtcttcttcgtcggcctccgaacgtctgacctaacgaccggtccctcccgcgacctatcctcggtcggtcctccgacggcgtagggaccggagacggtacgtggtaatttaacttacgtagcgaacgttctaccgtagtttacgacctaacgttacgaagttcggtaggttacctttaagttccgttacggttacggggtaacgtacggggtaaccccgtaaagttccgtacgttaccggtaccggtttacggaccaccggttaaccccgaaacccg

SEQ ID NO: 404644 - DNA, 614 bp, Homo sapiens
  misc_feature: GZ8MTXP02F8WV7.39.86.H09.1.454.CMB.2.raw
  modified_base (227)..(227): a, c, t, g, unknown or other
  modified_base (317)..(317): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctcgtgtctgggtctctaggacagtcgatcaccatcctctgcactggaaccngcaggtgtacggttggggtatggactatcgtctccgtacggtacagactaatactccaggcaccaaccgaccccaaatcatactatttangtagtcaagtacaccgtcctacgtagggtttacctagtcgtacttctcgtcgctaccgtacgtcgtcgaccaaccgaccggtccctacccgtacgacctacgttcgtcgtcggctaccgaggtcgtacggacggacgtacgtacgttagtaacgttattaccgtagactactcgttacttacttcgtaactaacgttagaggtgtaaggttcttaagttcggttaacgttacgggtaacgtacggtaacgttaaagcgttacgtccgttacgtacggtcaacggtaccggaaacccg

SEQ ID NO: 404645 - DNA, 557 bp, Homo sapiens
  misc_feature: GZ8MTXP02HVUBR.39.86.H09.1.454.CMB.2.raw
  modified_base (217)..(217): a, c, t, g, unknown or other
  modified_base (295)..(295): a, c, t, g, unknown or other
  modified_base (545)..(545): a, c, t, g, unknown or other
  modified_base (547)..(557): a, c, t, g, unknown or other
tcagtcgcactagtcacgaccggtgctcgatttagtgctatagacttgggtttggtgctctcccagtctgccctgactcaggctgcctccgtgtctgggtctctaggacagtcgatcaccatctcctgcactggaaccagcagtgacgttggtggttataactatgtctcttggtaccaacatcacccaggacaaacgtccccaaatgatgatttangagtcactaaacggcctcgagggtttcaatcgcttctctggctcaagtctggcaacacggcctccctgaccatctcgngggcctcgaggctggaggacgaggctctctattatgcagcctcatacaacagctattctctacgttggggttcgtcgggcggacgggacccgtaccgtacgtacccggtcgttacggtaccacgacccgaacggtcctcccgtcccccgttcgtacctaccgttccgttccgttccccctaccccttccctacctacgtacgtcgacgtacgtcggacggcgggtcgtacggacgacggcgacagtcgcncnnnnnnnnnnn

SEQ ID NO: 404646 - DNA, 614 bp, Homo sapiens
  misc_feature: GZ8MTXP02FO0TX.39.86.H09.1.454.CMB.2.raw
  modified_base (228)..(228): a, c, t, g, unknown or other
  modified_base (251)..(251): a, c, t, g, unknown or other
  modified_base (270)..(270): a, c, t, g, unknown or other
  modified_base (278)..(278): a, c, t, g, unknown or other
  modified_base (316)..(316): a, c, t, g, unknown or other
  modified_base (449)..(449): a, c, t, g, unknown or other
  modified_base (532)..(532): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccngctagtggtacggttggggttangactatgtctcgtgtaccngactaatnaccaggaccacgaccacccccaaatctatactatttangtaggtcaagtactccggcctaggttacgggtttactaacgtcgtacttctcgtcgtacctcgtaacgtcgtacgacccaaccgtaccggtacccttacccgacgacctacgttcgtcgtacgggcctaccgnggcgtaggacgggaacgcgtacgtagtaacttacttcgtgacgtatccttagtacttagactagtacgagtagtaaccgtttnttacggtcgttacggttacggtaacggaccgtaacgtacgtcgtacgtaccgtaccggtacgaccgaacccgaccgaaaccg

SEQ ID NO: 404647 - DNA, 674 bp, Homo sapiens
  misc_feature: GZ8MTXP02GWDOG.39.86.H09.1.454.CMB.2.raw
  modified_base (229)..(229): a, c, t, g, unknown or other
  modified_base (231)..(231): a, c, t, g, unknown or other
  modified_base (256)..(256): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaaccngnaggtggtagggttggggtatgtatntcgtctcgtacgtacagactaatacacgagacaaccgaccaaccccaaactctactactaattagtgtacgtacgtaagttacgtccgtaccgtacggtaacggttacctaacgtctcttctcgtcgtctcgtacgtcgtacgaccgaaccgtccgtccctacccgtactaccctacttccgtacgtccggtcctacgacggtcgtacggacggtacgtacggtacttagttaactttaacgtacgtcgacgtacgtcttacgttaacgttacgtaactaagttacgtaggtacgttaacggttacgtttaggttccgggttaacggttaaccgggtaacgggtaaccggtaacggtaaacgtcgttaaccggtaccggtaaccgtaacggtacccgaacccggtaaccccgaacccg

SEQ ID NO: 404648 - DNA, 570 bp, Homo sapiens
  misc_feature: GZ8MTXP02JY5DW.39.86.H09.1.454.CMB.2.raw
  modified_base (219)..(219): a, c, t, g, unknown or other
  modified_base (338)..(338): a, c, t, g, unknown or other
  modified_base (346)..(346): a, c, t, g, unknown or other
  modified_base (559)..(559): a, c, t, g, unknown or other
  modified_base (561)..(561): a, c, t, g, unknown or other
  modified_base (563)..(563): a, c, t, g, unknown or other
  modified_base (565)..(566): a, c, t, g, unknown or other
  modified_base (568)..(570): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacggttgggggttatgactatgtctcctggtaccagcaatatccaggcacacgacccccaaactcatcatttangagtcagtaactcggcctcgtagggtttctaatcgcttctcgtggctccaagtctggacaacacggccctcctgaccatctcgtcggctcgaggctggaggacgaggctagattatacngccagctntattgactatcgagtgtagtcttatcgttacgttcggaaagtcgggtaacctaaggtactacgttccgtaccgttacggtccgaaccgtaccccgaaaccgacccctaaaacccctcgttacgtacctaccgttccttccccgttacccacccctccgtactaacgtcgtacgcgtacgtgacggcggtcgacggacgtaacggcgacagtangncncnncnnn

SEQ ID NO: 404649 - DNA, 586 bp, Homo sapiens
  misc_feature: GZ8MTXP02I7KVC.39.86.H09.1.454.CMB.2.raw
  modified_base (272)..(272): a, c, t, g, unknown or other
  modified_base (303)..(303): a, c, t, g, unknown or other
  modified_base (351)..(351): a, c, t, g, unknown or other
  modified_base (435)..(435): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcaggctgcctccgtgtctgggtctcgtaggacagtcgatcaccatctcctgcactggaaccagcagtgacggttggggtatgactatgtctctggtacagcaatncaggcacacgaccccaaatcactctatttangaggtcagtaacgccgtccctgtacgggttacctacgtcgtacttctntcggcctcgaacgttcgtaggacctaaaccgccggtccctaccgtacgacctactcgtacgtcggctaccgcgcgtgaggacgngtacgtatacgttacttacgagctacgtctacgttagttcgactagttcgaagttgaacggtctttagtcggtttaccgttaggaacggtacgggtaacgtaaacggtcctacgttccgtacgtacggtaccgacggtacccgaaacccgg

SEQ ID NO: 404650 - DNA, 603 bp, Homo sapiens
  misc_feature: GZ8MTXP02JM7X2.39.86.H09.1.454.CMB.2.raw
  modified_base (228)..(228): a, c, t, g, unknown or other
  modified_base (324)..(324): a, c, t, g, unknown or other
  modified_base (482)..(482): a, c, t, g, unknown or other
  modified_base (488)..(488): a, c, t, g, unknown or other
  modified_base (496)..(496): a, c, t, g, unknown or other
tcagtcgcactagtcacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgactcaggctgcctcgtgtctgggtctctaggacagtcgatcaccatctcctgcactggaaccngctaggtgacggtttggggtatgactatgtctccgtaggtaccagtacaataatccgaaggccaccgacgtaccccccaaatcatctaatttacgngtagggtactaagtaaccgtcggtccctaggttacggggtttacccctatccgtcgttctcgttcggctaccgtaagtcctacggccaaacgtccggacccttccgatacctatcgtcgtcggacctccgagctagacgtacgaggtactgtaacttntaacgngacgtacncttacgtacgtacgactagagtagtacgtcgtacttgtacggttacgtacgggtacgtacggtaacgtagtctacggttacgtacgtacgtaccgaccgaccgtacg

SEQ ID NO: 404651 - DNA, 791 bp, Homo sapiens
  misc_feature: GZ8MTXP02FXOXR.39.86.H09.1.454.CMB.2.raw
  modified_base (216)..(216): a, c, t, g, unknown or other
  modified_base (780)..(780): a, c, t, g, unknown or other
  modified_base (785)..(785): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaatatccaggcacacgcccccaaactcatcatttangaggtcagtaatccggccctcgtagggtttcaatccgtcttctctggcctccaagtctggaccaacgaccggccctccccgtagacccattccgtcggttcgggccttaccgaagggtccgtagggaacgggaccggtaggtccgttaaggtatttaaccttacggtgaccctaacgtcttacctagttttcgaccgtaaattccgaaggttcgtacgggttaccttagtttcggtttaccgttaaaggggaaacgggtttcggggaaaccctaaagggttacgaaccggttttcccgtacccggtaagggttacccgaacccggtaacccccgaaaccgggacccccctaaaacccccgtcggtttacccgtaccgtaaccctttcccgtttaacccccggggtttacccccccctacccccgtttacccgtacccgttaaccggttaccgggtacccggtaacccgggtacggttacggggtacccggggtaccgggtacccgggtaaccgggaaccggtaaaccggggtcccggtaacgttacgtacgtaacgtcacgcgnacganacgtcg

SEQ ID NO: 404652 - DNA, 601 bp, Homo sapiens
  misc_feature: GZ8MTXP02IFF0B.39.86.H09.1.454.CMB.2.raw
  modified_base (226)..(226): a, c, t, g, unknown or other
  modified_base (273)..(273): a, c, t, g, unknown or other
  modified_base (307)..(307): a, c, t, g, unknown or other
  modified_base (350)..(350): a, c, t, g, unknown or other
  modified_base (397)..(397): a, c, t, g, unknown or other
  modified_base (456)..(456): a, c, t, g, unknown or other
tcagtcgcactagtcacgaccggtgctcgatttagtgctatagacttgggtttggggggggtctcaggaggcagcgctctcaggacatctccaccatggcctgggctctgctgctcctcaccctcctcactcagggcacgagggtcctgggcccagtctgccctgactcaggctgccttcgtgtctgggtctcgtaggacagtcgatcacatctctgcactgaacngcagtgtacggttggggtatgactatgtctcgtgtaccagacaatcnccgagcacaccgaccccaaatcatactatttagngagtacagtactccgacctggtaggtttaccacgtcgtcttcncgtcgctcaagtcgtacgaccaaccgccgtccctcccgactaacccncgttccgtcgacggtcctacgaggcgtaggacggacgacggtgtacgtatttattaacngactagtcttaagtacgtttacgactaacgtcgtagtacggtacgtttactttagtacgtttaccggttaacggaaacgggttacggtaaactacggtaacgtacgttacggttaccgacggtacccgacgtacccgaaacccgg

SEQ ID NO: 404653 - DNA, 601 bp, Homo sapiens
  misc_feature: GZ8MTXP02ICQA1.39.86.H09.1.454.CMB.2.raw
  modified_base (186)..(186): a, c, t, g, unknown or other
  modified_base (233)..(233): a, c, t, g, unknown or other
  modified_base (252)..(252): a, c, t, g, unknown or other
  modified_base (273)..(273): a, c, t, g, unknown or other
  modified_base (586)..(586): a, c, t, g, unknown or other
  modified_base (591)..(591): a, c, t, g, unknown or other
  modified_base (593)..(593): a, c, t, g, unknown or other
  modified_base (595)..(595): a, c, t, g, unknown or other
  modified_base (597)..(597): a, c, t, g, unknown or other
  modified_base (599)..(599): a, c, t, g, unknown or other
  modified_base (601)..(601): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttgggggttatgactatgtctcctggtaccagcaatanccaggcacagcccccaaatcatcatttatgagtcagtaatcggcctnagggtttcaatcgctttcnctggctccaagtctggcaacncggcctcctgaccatcctctggctccaggctggacggacgaggtctgatttatacgtgacctagctcaatttgcaatcaagtgacgctttaatcgtctttcggaagttgggacctaaagggttcaagttcgtaccgttaggaccacgcccccgaaagggcctacccggtccccccgtttcgggtccctaaccgtttcccttaccgggttttcccccccgtccccttacccttaccgttaccgttacgtcggtaccgtaccgttacgggacgggtccgggtcgtacggaccgtaacggcgaccgttaagtacgngcgcncncncncncn

SEQ ID NO: 404654 - DNA, 663 bp, Homo sapiens
  misc_feature: GZ8MTXP02FIGKL.39.86.H09.1.454.CMB.2.raw
  modified_base (217)..(217): a, c, t, g, unknown or other
  modified_base (258)..(258): a, c, t, g, unknown or other
  modified_base (562)..(562): a, c, t, g, unknown or other
  modified_base (653)..(657): a, c, t, g, unknown or other
  modified_base (659)..(663): a, c, t, g, unknown or other
tcagtcgcactagtcacgaccggtgctcgatttagtgctatagacttgggtttggtggtctcccagtctgccctgactcaggctgcctccgtgtctgggtctctaggacagtcgatcaccatctcctgcactggaaccagcagtgacgttggggttatgactatgtctcctggtaccagcaatatccaggcacacgacccccaaatcatctatttangagtcagtactccggcctgtagggttctaatcgtcttctcnggctcgtaagtcgtcggaccaaacgccggtaccctccccgtagaacctacttccgtcggtccggggtcccttaccgaggtcgtagggacgggtaccgggaggtacttaggtaactttaactttacggcgacccgtacgtccttacttactttcggaacctaaagttcgaacgggttaggtaacgggttactttagttacggtttaccggtttaacggggaaacgggttaccggaaaccgttacgggtactacggttacgtacccgtaagcccgaaccgacccgtaaaacgcccccaaacccgtntcgtacctaccgttcgttaccccgtcccctaccctgtacctacgttcgaccgtacgtacgcggacgtcgggcgacgaccgaacggcaacgnnnnncnnnnn

SEQ ID NO: 404655 - DNA, 505 bp, Homo sapiens
  misc_feature: GZ8MTXP01EVZUS.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttgccgggcgagtcaggacattagcaactattaaatggatcagcagaaaccaggaaacgcccctaaatcctgatctacgatgcatccaatttggagacaggggtcccatccaaggttcacgtggaagtgatcgtgggactactattttacttcactatcagcgctgcagcctgtaagatttgacaactatattactgtacaaactaatatgaaagacttcctcccctctaccgtttcgggacggaagggaaccagggtggagatcgagcgaacgtgtggctgcactgttcgtg

SEQ ID NO: 404656 - DNA, 531 bp, Homo sapiens
  misc_feature: GZ8MTXP01C6EAB.52.23.C01.1.454.CMB.2.raw
  modified_base (468)..(468): a, c, t, g, unknown or other
  modified_base (513)..(513): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaaggacattagctaaacttatttaaatggtatcagacaagaaaccagggaaacgcccctaaactcctagactcacgatgctatcccaatttggagacgaggggtcccagtccaaaggttcacgtaggaagtggatcgtagggactactattttacttcactatcagcgctgcagacctgtaagtatttgactaactattacttaactgtaacaaacaattaatagaatactcctccccctntacgttcggacgggtaaggaccgaaggtgagatcgagcgaagtgngctcgcactaattcgtcg

SEQ ID NO: 404657 - DNA, 535 bp, Homo sapiens
  misc_feature: GZ8MTXP01B8ZG4.52.23.C01.1.454.CMB.2.raw
  modified_base (210)..(210): a, c, t, g, unknown or other
  modified_base (279)..(279): a, c, t, g, unknown or other
  modified_base (307)..(307): a, c, t, g, unknown or other
  modified_base (389)..(389): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttnacttgccgggcagtcaggacattagcaactatttaaattggatcagcagaaacaggaaagcccctaaancctgatctacgatgcatccaatttgganacaggggtcccatccaaggttcacgtggaagtggatcgtgggacactatttacttcaccatcagcggcctgcagcctgaagntttgcaacatattactgttacaacaattatagaacgtatacctccccttcaccgtttaccggcgggaacggggacccttaaaggggtggacgaagttcaacgacggaaacctgggttgggcttgggaccaccctaagttctttccg

SEQ ID NO: 404658 - DNA, 679 bp, Homo sapiens
  misc_feature: GZ8MTXP01BELWR.52.23.C01.1.454.CMB.2.raw
  modified_base (197)..(197): a, c, t, g, unknown or other
  modified_base (223)..(223): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctcctgtctgcatctgtagganacagactcaccttcacttggccgggngagtcaggactattagactaacttatttaaagttggtatacagacaagaaaccgaagggaaaccgacccctaaactcctagactactaacgatcgactatacctaagtttggacgacgacggggtcccaagtacccgtaacggttacaacgtaggtaaggtgggtaacttcggtagggaacctaacgttactttttaccgttaccaacctacgggggtactacggtccggtcctcggccacgtaccctaggtaagtacgttttagaactaactaattaacttaacgttacgttaactaaactaaattaataagtaaacgtaccttacccttaccccttaccgttaccgtttaccgggacgggtaacggggtaaccgttaaggggtacggaggtaacgtacgaacgttacggttaccgtaagggtcggtcgtcgaccgttaccgtaacgttcgttcg

SEQ ID NO: 404659 - DNA, 567 bp, Homo sapiens
  misc_feature: GZ8MTXP01CIDIK.52.23.C01.1.454.CMB.2.raw
  modified_base (222)..(222): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggnagtcaggacattagcaactatttaaatggatcagcaagaaaccagggaaacgcccctaaactcctagatctacgatgcatccaatttggagacgaggggtcccatccaaggttcacgtggaaagtcgggatcgtagggactactattttacttcaccatcagcggctgcagcctagaagtatttgactaacatattactgtacaaacaatatagaactatacctccccctctaccgtttccggcgggtaacgggacccgttaaagggttggaacgtaagttcgaacggttacggttaaaccgtggttacgggccttcggccgttaaccgtaacgttctttaaccg

SEQ ID NO: 404660 - DNA, 536 bp, Homo sapiens
  misc_feature: GZ8MTXP01BUOGZ.52.23.C01.1.454.CMB.2.raw
  modified_base (222)..(222): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggnagtcaggacattagcaactattaaatggtatcagcagaaaccaggaaagcccctaaactcctagatccacgatgcatccaatttggagacaggggtcccatccaaggttcactggaagtggatcgtgggacactattttacttcactatcagcgcctgcagacctgaagtattttgactaactattattactagttacaaactaattatagtaaagactacctccccctctacctttcgggcgggaagggaacccaaggggtggagacgtcgaaggacgaaacgttggacggcgtcggcaccgtaattcgttcg

SEQ ID NO: 404661 - DNA, 573 bp, Homo sapiens
  misc_feature: GZ8MTXP01BSXII.52.23.C01.1.454.CMB.2.raw
  modified_base (196)..(196): a, c, t, g, unknown or other
  modified_base (210)..(210): a, c, t, g, unknown or other
  modified_base (221)..(221): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagganacagagtcaccttnacttgccgggnagtcaggacattagcaactattaattggtatcagcaagaaaccgaggaaacgacccctaaactcctgatctacgatcgcataccaatttggagacgaggggtcccagtccaaggttcacgtggaagtggatcgtagggactacgtatttttaccttcacgtatcgagcggactgacagacctagaagtatttgactaactattacttacttgtactaaacaataatgaactacttccctacccctcgtaccgtttcgggcgggtaacgggacccttaaggggtcggagaacgttcgaagttacggaaacgttcgggtaggtccgttcggacttacccgtaattccgtttccg

SEQ ID NO: 404662 - DNA, 544 bp, Homo sapiens
  misc_feature: GZ8MTXP01AMTDS.52.23.C01.1.454.CMB.2.raw
  modified_base (421)..(421): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttgccgggcagtcaggacattagcaactatttaaatggtatcagcagaaaccagggaaagcccctaaactcctgatctacgatgcatccaatttggagacaggggtcccagtccaaggttcactgggaagtgggatctgggacactattttactttacaccatcagcggctgcagcctgaatatttgacaacattattactgtaccaanaatatgaatactcctcccctctaccgtttccgggcgggaacgggaccgttaagggtggaggtactacgacggaccgttaaacgttggttgggccttgggaccttacccgtaagttcgtttccg

SEQ ID NO: 404663 - DNA, 505 bp, Homo sapiens
  misc_feature: GZ8MTXP01DJXFL.52.23.C01.1.454.CMB.2.raw
  modified_base (209)..(209): a, c, t, g, unknown or other
  modified_base (221)..(221): a, c, t, g, unknown or other
  modified_base (268)..(268): a, c, t, g, unknown or other
  modified_base (277)..(277): a, c, t, g, unknown or other
  modified_base (387)..(389): a, c, t, g, unknown or other
  modified_base (399)..(399): a, c, t, g, unknown or other
  modified_base (413)..(413): a, c, t, g, unknown or other
  modified_base (416)..(416): a, c, t, g, unknown or other
  modified_base (421)..(421): a, c, t, g, unknown or other
  modified_base (423)..(423): a, c, t, g, unknown or other
  modified_base (425)..(425): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagatcaccttnacttggccgggnagtcaggacattagcaatattaaatgatcagcaagaaacaggaaacncccctaaancctagatctacgatgacataccaatttggagacgacggggtacccatacccaaggttcagtaggaagtaggatcgtagggactacctattttacttacacatcagcggcnnnacatatatanacatatatatatanaanaatanananactacctccctcctacgtcggcggaacggaacgaggtagagagtacgacgacgacgtgtcgcgtcgcactaacttcgtcg

SEQ ID NO: 404664 - DNA, 519 bp, Homo sapiens
  misc_feature: GZ8MTXP01DPM9Y.52.23.C01.1.454.CMB.2.raw
  modified_base (197)..(197): a, c, t, g, unknown or other
  modified_base (273)..(273): a, c, t, g, unknown or other
  modified_base (397)..(397): a, c, t, g, unknown or other
  modified_base (419)..(419): a, c, t, g, unknown or other
  modified_base (449)..(449): a, c, t, g, unknown or other
  modified_base (497)..(497): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcagtcaggacattagcaactattaaatggatcagcaagaaaccagggaaacncccctaaaactcctagatctacgatgcatccaatttggagacaggggtcccatccaaggttcacgtggaagtggatcgtgggaactactattttacttcactatcagcgctgcagctagaagtntttgactaactattattacgtntacaaactaatatagaatactcctcccctntacgttcggacgggtaaggaaccgaaggtcgagatcgagcgaactggngctgcttacctaagttcgttcg

SEQ ID NO: 404665 - DNA, 536 bp, Homo sapiens
  misc_feature: GZ8MTXP01EBZVJ.52.23.C01.1.454.CMB.2.raw
  modified_base (197)..(197): a, c, t, g, unknown or other
  modified_base (467)..(467): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcagtcaggacattagcaactatttaaatgtatcagcaagaaaccagggaaacgcccctaaactcctagatctacgatgcatccaaatttggagacaggggtcccagtccaaggttcacgtggaaagttgggaattcgtgggaactactattttacttacactatcagtcggcctgcagtcctagtaagtatttcgactaaactattattaacgtattacaaataatatagaatactacctcccctntaccttgggcgggaaggaccaagggtgggttaagagtacgaagacttagtgtgctcgacactgttcgtc

SEQ ID NO: 404666 - DNA, 495 bp, Homo sapiens
  misc_feature: GZ8MTXP01AQXA8.52.23.C01.1.454.CMB.2.raw
  modified_base (428)..(428): a, c, t, g, unknown or other
  modified_base (438)..(438): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttgccgggcagtcaggacattagcaactatttaaattggatcagcagaaaccagggaaagcccctaaactcctgatctacgatgcatccaatttggagacaggggtcccatccaaggttcactggaagtggatctgggacactattttacttcacatcagcggcctgcagcctgaagtatttgcaaacataattactgttacaaacaatatagaanatctcccctnactttcggcggaaggtaccaagggtgagatcagcgactgtggctgcacctaattctg

SEQ ID NO: 404667 - DNA, 545 bp, Homo sapiens
  misc_feature: GZ8MTXP01BF2SB.52.23.C01.1.454.CMB.2.raw
  modified_base (256)..(257): a, c, t, g, unknown or other
  modified_base (276)..(276): a, c, t, g, unknown or other
  modified_base (417)..(417): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagacgtcaccttcacgttggccgggcgagtcaggactattagctaatattaaatggannagcaagaaaccaggaaacnccctaaatcctagatctacgatgactactacaagtttggacgtacgacgggtcccagtacccgtaaggtcagtaggaacgtggatcgtagggtactacttattttctacgactatcagcggctgcagtctagaagtatttnactaatatacttacgtataactaaactaatatacgaaactactccctacccctcgtaaccgttcgggacggtaacggaaccgagggtcgagatacgaaggttacacgtgagctgcaccttcgttcgtc

SEQ ID NO: 404668 - DNA, 600 bp, Homo sapiens
  misc_feature: GZ8MTXP01CIQ6H.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactattaaatggatcagcagaaaccagggaaacgcccctaaatcctgatctacgatgcatccaatttggagacaggggtccatccaaggttcacgtggaagtggatcgtgggactactattttacttcactatcagcgctgcagcctagaagtatttagactaactattaattaactgtaactaaactaaattaataggaaatacttaccctcccccttacgtaccgttttccgggcgggtaaacggggtaacccgaaagggggttcggaaaggtaaacgttacgaacggttaaccggttaaaccgttgggtacgggtaaccgttacgggtacccgaacccgttaacgttccgtttaaccg

SEQ ID NO: 404669 - DNA, 578 bp, Homo sapiens
  misc_feature: GZ8MTXP01BURXV.52.23.C01.1.454.CMB.2.raw
  modified_base (317)..(317): a, c, t, g, unknown or other
  modified_base (404)..(404): a, c, t, g, unknown or other
  modified_base (547)..(547): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtcaccttcacttgcgtgggcagtcaggacattagctaactattaaatggtatcagcaagaaaccagggaaacgcccctaaactcctagatctacgatgcatcctaatttgganacgaggggtccatcgaagttcacgtggaaaagtggaatcgtagggacactatttacttcactatcagtcgctgcacgcctagaagtntttcgaactaactacttaatttaaccgttataactaaactaaattataggaaactaacttccctacccccttacgtaccgtttaccggggcgggtaacgggttaacccgaaagggttcggagaacttacgaggaacgtaacgnggttaaggctaggcctaaccgttaatttccg

SEQ ID NO: 404670 - DNA, 527 bp, Homo sapiens
  misc_feature: GZ8MTXP01DWBIN.52.23.C01.1.454.CMB.2.raw
  modified_base (273)..(273): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacattagcaactattaaatggatcagcaagaaaccagggaaacncccctaaatcctgatctacgatgcatccaatttggagacaggggtcccatccaaggttcacgtggaagtggatgtgggacactattttacttcacatcagcggctgcagcctagaacgtattttgactaaactatattactgtacaaactaataatgaaatactacctccccctctaccgtttcgggcgggaagggacccgaagggtaggagactcgaaggacgaacgtggtcgctcggcacctaagttcttcg

SEQ ID NO: 404671 - DNA, 604 bp, Homo sapiens
  misc_feature: GZ8MTXP01DA37M.52.23.C01.1.454.CMB.2.raw
  modified_base (223)..(223): a, c, t, g, unknown or other
  modified_base (255)..(255): a, c, t, g, unknown or other
  modified_base (582)..(582): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttggccgggngagtcaggacatagcaactatttaaattgatnagacaagaaaccgagggaaacacccctaaactcctagactactaacgattcgacataccctaaagtttcggaagaccgtacgggggtacccagtaccccgtaaagggtttacacgtagggaagttagggaacttcggtagggaacctactttaacttttacctttacaccattccagccggtctcgcacgactagtaagtatttagactaataattattactagtaacaaactaatatacgaatacctccctcccctctaccgttcgggcgggaaacgggaccgttaaggggtggagaacgtccgaaggacgttaacttgggtgtcncggaccaccttcttcgtttccg

SEQ ID NO: 404672 - DNA, 526 bp, Homo sapiens
  misc_feature: GZ8MTXP01DKXWG.52.23.C01.1.454.CMB.2.raw
  modified_base (451)..(451): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactattaaattggtatcagcaagaaaccagggaaacgcccctaaactcctgatctacgatgcatccaatttggagacaggggtcccatccaaggttcactggaagtcggatcgtgggacactatttacttcacatcagcggcctgcaggcctgaagtatttgacaactatattactgttacaaactaatatagaaagtactacctccccctntacgttcggcggtaacgggaccttaagggtgagtactcgaaggttcaaacgtggtggctggcacctaattccttg

SEQ ID NO: 404673 - DNA, 550 bp, Homo sapiens
  misc_feature: GZ8MTXP01D7SHZ.52.23.C01.1.454.CMB.2.raw
  modified_base (197)..(197): a, c, t, g, unknown or other
  modified_base (278)..(278): a, c, t, g, unknown or other
  modified_base (462)..(462): a, c, t, g, unknown or other
  modified_base (537)..(537): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcgagtcaaggacattagctaacttatttaaatggtatcagcaagaaacagggaaacncccctaaatcctgactctacgatgctatccctaagtttggagacgaggggtcccagtaccaaggttacagtaggagtaggatcgtagggacctacgttacttttacttcactatcagcggcctgcagtactagtaagtatttacgacaatattactttacggtattacaaactaatatgaactntaccctcccctatacgttcggacgggaacggtaccaagggtgagacgtacgaagcgttaacgtgtcggctgaccnctaattcttaacg

SEQ ID NO: 404674 - DNA, 570 bp, Homo sapiens
  misc_feature: GZ8MTXP01AK730.52.23.C01.1.454.CMB.2.raw
  modified_base (406)..(406): a, c, t, g, unknown or other
  modified_base (436)..(436): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttgccgggcgagtcaggacattagcaactattaaattggatcagcaagaaaccaggaaacgacccctaaactcctgatctacgatgactataccaagtttggagacgacggggtcccataccgaaggttcacgtgggaagtggatcgtagggactactattttacttcactatcagcgctgcagcctagaagtntttagactaactattacttactagtacaanaatactagaactacttccctcccctgtaccgtttcgggccgggtaacgggaaccgaagggtcggaagacgtaccgaaggaccggttaacgttgggtacgggaaccttacggaccttaacccttcgttccgttcg

SEQ ID NO: 404675 - DNA, 626 bp, Homo sapiens
  misc_feature: GZ8MTXP01DZ1K7.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagacgtcacctttcacgttgccgggcgagtcagggacattagcaacttattaaattggtatcagcaagaaaccatacggaaacgcccctaaaactcctagatctacgatgcatccaatttggagacaggggtcccatcaaggttcacgtggaaagtgaatcgtagggactactattttacttcaccatcagtcggcctgcagcctagaagtatttcgactaaactattaacgttactaggttaacaaactaaataattaggaaactaacttcccgtacccccctacgttacccgtttccggggaaccggggtaaagggggaccccgaaaggggttcgggaaaggtacgttacccgaaagggaaccggtaacccgttaagggttaacggggacccttcggggaccctaaccccgttaacgttttcccg

SEQ ID NO: 404676 - DNA, 569 bp, Homo sapiens
  misc_feature: GZ8MTXP01CNCMR.52.23.C01.1.454.CMB.2.raw
  modified_base (223)..(223): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtccaccttcacttgccgggngagtcaggactattagctaactatttaaattggtatcagcaagaaaccagggaaacgcccctaaactcctagatctacgatgcatcccaatttggagacgaggggtcccatccgaaggttcacgtggaagtggatcgtgggactacgtatttacttcacatcagcggctgcagcctagtaagtatttagactaactatacgtttactagttacaaactaatattagaaacgtattaccctcccctcgtaccgtttcggaccgggtaagggaacccgttagggtacggagtacgtcgaaggttcgaacgttcggcgggtaactcggaccacgtaacgttcgtttccg

SEQ ID NO: 404677 - DNA, 587 bp, Homo sapiens
  misc_feature: GZ8MTXP01BMBS4.52.23.C01.1.454.CMB.2.raw
  modified_base (197)..(197): a, c, t, g, unknown or other
  modified_base (275)..(275): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcagtcaggacattagctaacttattaaatggtatcagacaagaaacaggaaacncccctaatcctagactctacgatgctataccaagtttggagacgaggggtcccaagtccaagggttcaacgtgggaagtggactgtagggtaactacttacttttacttacactatcagcggcctgcagacctagaacttagtttacactaactattacttacggtataccaaataattaatacgaactacttacccctcccctacgtaaccggttcgggacgggtaacgggtaaccgaagggtcgaagtacgtaccgaaggacgttaaaccgtttgggcggtctacggacttaccctaaggttctttaacg

SEQ ID NO: 404678 - DNA, 632 bp, Homo sapiens
  misc_feature: GZ8MTXP01BADKS.52.23.C01.1.454.CMB.2.raw
  modified_base (197)..(197): a, c, t, g, unknown or other
  modified_base (290)..(290): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttggccgggcagtcagggactaattagactaaacttaatttaaattggtatcagacaacgaaaaccgagggaaaacncccctaaaactcctagaacttcgtaacgatcgactatcccgaaagttttggagacgacggggtcccaagttaccgaaggttcaacgtaggaagtagatcgtagggaactacgtactttttacttcactatcgagtcggactcgcacggtcctagtaagtatttacgactaaactattacttagtacttacaaactaattatagaactacttaccctcccctacgtaccgtttccggacgggaacgggaaccgaagggttacggaagtaacgttacgaacgttacggttaaaccgtgggtcgggtaaccttcgggaccgttaccgtaacgttccgtttaaccg

SEQ ID NO: 404679 - DNA, 532 bp, Homo sapiens
  misc_feature: GZ8MTXP01BOJMH.52.23.C01.1.454.CMB.2.raw
  modified_base (197)..(197): a, c, t, g, unknown or other
  modified_base (269)..(269): a, c, t, g, unknown or other
  modified_base (278)..(278): a, c, t, g, unknown or other
  modified_base (413)..(413): a, c, t, g, unknown or other
  modified_base (444)..(444): a, c, t, g, unknown or other
  modified_base (461)..(461): a, c, t, g, unknown or other
  modified_base (499)..(499): a, c, t, g, unknown or other
  modified_base (517)..(517): a, c, t, g, unknown or other
  modified_base (532)..(532): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcagtcaggacattagcaatattaaatgatcagcagaaaccaggaaacncccctaaancctagactctacgatgctatccaagtttggagacgaggggttcccagtaccaagggttacacgtaggaagtaggatcgtagggactacttacttttacttcactatcgagcggcctgcagtctagaagtactttnactaactattacttactagtaacaaatatanagaactctcctcccctntacgttcgggacggaacgggtaacgagggtgagtacgngaacgagttacgtgcggntcgcacctgttcgtn

SEQ ID NO: 404680 - DNA, 554 bp, Homo sapiens
  misc_feature: GZ8MTXP01AFVWC.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagatcaccttcacttgccgggcgagtcaggacattagcaactatttaaatggtatcagcagaaaccagggaaagcccctaaactcctgactctacgatgcatccaatttggagacaggggtccatccaaggttcacgtggaagtggaatcgtgggacactatttacttcacatcagcgctgcagcctgaatatttgactaacatattacgtctacaaactaataattgaaatactccctaccccgtctaccgtttcgggcggaacggggtaaccttaggggttacggaagacgttacgaacggaccgttaaaccgtgggtacggccgttagggaccacccgtaagttcgtttccg

SEQ ID NO: 404681 - DNA, 541 bp, Homo sapiens
  misc_feature: GZ8MTXP01DXX8K.52.23.C01.1.454.CMB.2.raw
  modified_base (198)..(198): a, c, t, g, unknown or other
  modified_base (211)..(211): a, c, t, g, unknown or other
  modified_base (386)..(386): a, c, t, g, unknown or other
  modified_base (390)..(390): a, c, t, g, unknown or other
  modified_base (399)..(399): a, c, t, g, unknown or other
  modified_base (419)..(419): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatccctcctgtctgcatctgtagganacagatcaccttnacgttgccgggcagtcaaggtactattagctaaacttatttaaatggatcagacaaagaaaccgagggaaaccacccctaaactcctgaactctacgatgactatcctaaagttggagacgagggtcccagtcgaaggttcacgtaggacgtgatcgtaggactactatttactnactntcagtcgcngctacgtactagtatattanactaatattacttacgtataactaatatatagactacctacctcctacgtacgtcgggaggaacggacgttaggtagagtacgtacgaagttcgttagtgcgtctcgacttactcgttcgtc

SEQ ID NO: 404682 - DNA, 570 bp, Homo sapiens
  misc_feature: GZ8MTXP01B16BG.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagacaaacttatttaaattggtatcagcaagaaaccagggaaacgacccctaaactcctgatctacgatgcatccaatttggagacacggggtccataccaaggttcacgtggaagtagatcgtgggaactactacttttacttcactatctagccggcctgaccgagtaccgtagtaacgtagttttacgactaaactattaacttaacttcgttaacaaactaattaatagaaacgtacttaccctccccttactaccgtttaccggacgggtaacggaccgaagggtcggaagtacgtacgagacgacgtgtggctgcacctaacttcgtcg

SEQ ID NO: 404683 - DNA, 578 bp, Homo sapiens
  misc_feature: GZ8MTXP01B3WX4.52.23.C01.1.454.CMB.2.raw
  modified_base (406)..(406): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactattaaatggtatcagcagaaaccagggaaacgcccctaaaatcctgactctacgatgcatccaatttggagacgaggggtcccagtaccaaggtttcacgtggaagtggaatcgtagggactacgtattttacttcactatcagcggcctgcagcctgaacgtntttgactaatattaacttacgtatacctaaataattaatagaactacttccctcccctataaccgtttcgggcgggtaagggaacccgttagggtcggaagacgttacgaacggttaaccgaacgttgggttagggccttacgggaccttaaccgtaacgtttccgtttccg

SEQ ID NO: 404684 - DNA, 578 bp, Homo sapiens
  misc_feature: GZ8MTXP01EA7ZP.52.23.C01.1.454.CMB.2.raw
  modified_base (451)..(451): a, c, t, g, unknown or other
  modified_base (571)..(571): a, c, t, g, unknown or other
tcagcgcagtacgacacgaccggtgctcgatttagtacacgtgattagggattggggggagtcagtcccaaccaggacacagcatggacatgagggtccctgctcagctcctggggctcctgctgctctggctctcaggtgccagatgtgacatccagatgacccagtctccatccctcctgtctgcatctgtaggagacagagtcaccttcacttggccgggcagtcaggacattagcaacttattaaattggtatcagcaagaaacccagggaaacgacccctaaactcctgatctaacgattgactatccctaaatttgggagacgagggggtccccaagttcccaagggtttcacgtggaaacgtggatcgtagggactacttattttacttcaccatcgagcggctgcagacctagtaatatttagactaactattacttagggtnttaaccaaataatataagaactactacccttacccctctaacgtttccgggacgggaaacgggtaccgttaaggggtagacgagtaccgaagcgttaacgtggtacgcgtcgacaccttnttcgttg

SEQ ID NO: 404685 - DNA, 545 bp, Homo sapiens
  misc_feature: GZ8MTXP01D8I4G.52.23.C01.1.454.CMB.2.raw
  modified_base (281)..(281): a, c, t, g, unknown or other
  modified_base (455)..(455): a, c, t, g, unknown or other
  modified_base (458)..(458): a, c, t, g, unknown or other
  modified_base (521)..(521): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttggccgggcgagtcaggacattagcaaacttatttaaatggtatcagacaagaaaccaggggaaacncccctaaaactcctagactctacgatgacatcccaaatttggagacaggggtcccagtccaaggttcacgtggaaagtcgggaatcgtgggaactacttattttacttcactatcagcggctgcagcctagaagtatttgacctaatattacttactagtacaaactaatatanaanacttaccctcccctataccgttcggcggtaaggaccaggtggagatcgagttacgaacttggnggctcggacacctaagttcgttcg

SEQ ID NO: 404686 - DNA, 606 bp, Homo sapiens
  misc_feature: GZ8MTXP01CB291.52.23.C01.1.454.CMB.2.raw
  modified_base (278)..(278): a, c, t, g, unknown or other
  modified_base (287)..(287): a, c, t, g, unknown or other
  modified_base (473)..(473): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtccaccttcacttgccgggcgagtcaggactattagcaacttattaaatggtatcagcaagaaaccagggaaacncccctaaancctgactctacgatgactatcctaatttgggagtaccgagggggtaccccagttacccgaaagggttcaacgtgggaacgtgggatcggtggggtaacctacttattttacctttcaactactcaggcggctgcagtccgtagtaagtatttcgactaactattaacttactgtacaaacaattanagtaacgacttacccttccccctactaccggtttccggcggggtaacgggaaccgaggggttcggaagtacgttacgaacgttacggttaaccggtggtacgggtcttaggacccttaacgtcgttctttccg

SEQ ID NO: 404687 - DNA, 547 bp, Homo sapiens
  misc_feature: GZ8MTXP01AEYC2.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagctaactattaaattggatcagcagaaaccaggaaagcccctaaatcctgatctacgatgcatccaatttggagacaggggtcccatccaaggttcacgtaggaagtaggatcgtgggactagtatttacttcactatcagcgctgcagcctagaacgtatttagactaactattattacgtgtaacaactaatatagaaactacttcccttcccctctacgtttccgggacgggaacgggaaccgttaagggtacgaagtaactacgacgttacgaacgtggttgcgttgccaccgtaattcgtttaacg

SEQ ID NO: 404688 - DNA, 691 bp, Homo sapiens
  misc_feature: GZ8MTXP01EMFMU.52.23.C01.1.454.CMB.2.raw
  modified_base (197)..(197): a, c, t, g, unknown or other
  modified_base (221)..(221): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctcctgtctgcatctgtagganacagatcacttcacgttgccgggnagtcaggacattagcaactatttaaatggtatcagacaagaaaccgagggaaacgcccctaaactcctagactctacgatgactataccctaaatttgggagtacgacgggggtacccaagttacccgtaaagggtttcaacggtagggaaggttagggaacttcggtaggggtaacctaacgttaacttttttaacctttacaacctaattcccgaaggtccggaccttcggaccagggtacccttaggtaaaggttacgtttttagacctaaactaatttaactttaacggggttacgttaaactaaacctaaattataaggtaaactaccttaccccttaccccctacgttaccgttttccggggaccgggtaacgggaacccaaagggttacgaacggtaactaaccgaaacgttaccttgggttaacgggctaacggactaccgttacttctttcggtttaaccc

SEQ ID NO: 404689 - DNA, 586 bp, Homo sapiens
  misc_feature: GZ8MTXP01DO9YU.52.23.C01.1.454.CMB.2.raw
  modified_base (196)..(196): a, c, t, g, unknown or other
  modified_base (414)..(414): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagganacagatcaccttcacttgccgggcgagtcaggactattagcaactattaaattggtatcagcaagaaaccagggaaacgcccctaaactcctgatctacgatgctataccctaagtttggagtacgagggggtcccaagtccaaggttcacgtggaagtgggatcgtagggactaacgtattttacttcactatcagcgtctgcagtcctagtaagtntttagactaactatacttacgtacgtactaaactaatactagaaacgtactacccttaccccgtactaccgttttccggggacgggtaaaccggggtaaccgaaaggggttcggaaggtacttacgaacggttacgaacgtggtacggctggaccacctaacttcgtttccg

SEQ ID NO: 404690 - DNA, 657 bp, Homo sapiens
  misc_feature: GZ8MTXP01DFN3G.52.23.C01.1.454.CMB.2.raw
  modified_base (198)..(198): a, c, t, g, unknown or other
  modified_base (211)..(211): a, c, t, g, unknown or other
  modified_base (221)..(221): a, c, t, g, unknown or other
  modified_base (406)..(406): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtagganacagatcaccttnacttgcgggnagtcagacatagcaatattaatgatcagcaagaacgaggaaacgacccctaaactcctagactactacgatcgacactacctaagtttcggagaccgacgggggtccagtacccgaaggttcaacgtggaagtgggaatcgtagggactacttatttttactactacctaatcaaggtccggtcngacgtaggaccttagggtaaattacgttttacgactaaaccgtatttaaaccgttacttacggttaacctaaaactaaacttaactaaggtaaacgttaccttaccccgtaccccttaccgtaaaccggtttccggggaacggggtaaaccgggttaacccgaaagggggttacggaacgggttaaacgtacggttaacggttacggttaacgtgggtacgtaacgtacgaccttacgtaacgttcgttcg

SEQ ID NO: 404691 - DNA, 591 bp, Homo sapiens
  misc_feature: GZ8MTXP01A8H05.52.23.C01.1.454.CMB.2.raw
  modified_base (222)..(222): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatcctcctgtctgcatctgtagagacagagtcaccttcacgttgccgggngagtcaggactattagactaacttatttaaattggtatcagacaagaaaccgaggaaacgcccctaaactcctgatactacgatagctataccctaagtttggaacgtacgtacggggtacccagtaccgaaggtttcgacgttagggaagttgggaacttcgtagggactacttattttacttcaacctatcgagccggtactgacagacctagtaacgtatttacgactaaactattaacttacgggtactaactaaacaattaatacgtaactaactccctacccctgtaaccgtttcggacgggaacggtaacgagggtcgagactacgagttcgacgtggacgtcgtacgcacccttgttcgtg

SEQ ID NO: 404692 - DNA, 755 bp, Homo sapiens
  misc_feature: GZ8MTXP01EZNTS.52.23.C01.1.454.CMB.2.raw
  modified_base (197)..(197): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacgttgccgggcgagtcaaggactattagactaattaatttaaatggatcagacaagaaaccgagggaaaccaccccttaaactcctagtactacgtacgatcgactacgtaccttaagtttacgggaacgtaccggtaccgggggtaccctagttaacccgtaacgggtttacaaggttaggggtaaacggtagggtaacttcggtaaacgggtaaaccttaactttactttttttaaccttaccaactacttacgtacgccgggtcccttggacctacggtaccgttaagggtaaacgtttagttttaccgaaacctaaacttaggtttaaacgtttaccttaaggtttaaacccaaaagtaaacttaagggtaacgtaaaaccgttaccctttcccccgttacccccctaaaggtttcccggtttacccggggaacggggttaacgggtaaacccgttaaaggggtacggagttaacgtacgaacggttaacccgggttacttcggggcggtcgtacgtaccgttacctaacgttcgttcg

SEQ ID NO: 404693 - DNA, 635 bp, Homo sapiens
  misc_feature: GZ8MTXP01BRPHX.52.23.C01.1.454.CMB.2.raw
  modified_base (225)..(225): a, c, t, g, unknown or other
  modified_base (475)..(475): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatccctccctgtctgcatctgtaggagacagagtcaccttcacgttgccgggnagtcaggacatagactaattattaatgatcgagacaagaaaccgaaggaaaccgtacccctaaactcctagaactctaacgatcgactattacccgtaaagtttgggaacgtaaccggtacgggggtaccccagttacccgtaaacgggtttcaacggtagggaagtacgggtacttcggtagggtaacctaacgttactttttaccttacacctatcgacgccgtactgtacagtccgtagtaacgttntttacgactaactattacgttactagtaccaaataattagtacaactacctaccccttaccccgtataccgttcggggacggtaacgggaaccgttagggtacgagtaacgtcgaacggttacgacggttggtacgcgtacgcccttactcttcgttccg

SEQ ID NO: 404694 - DNA, 544 bp, Homo sapiens
  misc_feature: GZ8MTXP01CT8A8.52.23.C01.1.454.CMB.2.raw
  modified_base (197)..(197): a, c, t, g, unknown or other
  modified_base (222)..(222): a, c, t, g, unknown or other
  modified_base (401)..(401): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggnagtcaggacattagcaacttattaaattggatcagacaagaaaccaggaaacgcccctaaactcctagatctacgatgacatccaatttggagacgacgggtccagtaccgaaggttcacgtggaagtggatcgtgggactacgtactttacttcactatcagcgctgcagctgaagtnttgacaatatatactagtacaaataatactagaactacttccctcccctactacgttcggacggtaagggtaaccgagggttagagtaactcgaacggttacgttaacgttggaggtccttcgaccaccgtaattcgtttccg

SEQ ID NO: 404695 - DNA, 574 bp, Homo sapiens
  misc_feature: GZ8MTXP01CO5Z4.52.23.C01.1.454.CMB.2.raw
  modified_base (198)..(198): a, c, t, g, unknown or other
  modified_base (224)..(224): a, c, t, g, unknown or other
  modified_base (320)..(320): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtcctccatcctccctgtctgcatctgtagganacagagtcaccttcacttggccgggngagtcaggacattagactaaacttatttaaatggatacagacaagaaaccagggaaacacccctaaatcctgatcacgatgacatcctaattgganacgagggtcccatacccgaggtcagtaggaagtggatgtgggactacttatttactcacatctagcgctgcagctagtaagtatttgactaactaattacttactagtaactaaactaaataagttacgaaacgtacttacccttaccccgttacgtaaccgtttcgggaccggggaacgggtaaccgttaaaggggttacgaagtaacgtacgacgacgaacgtggtagtcgcgtaccactaacgttcttccg

SEQ ID NO: 404696 - DNA, 661 bp, Homo sapiens
  misc_feature: GZ8MTXP01A6BNW.52.23.C01.1.454.CMB.2.raw
  modified_base (224)..(224): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctcctgtctgcatctggtaggagacagagtcaccttcacttggccgggnagtcaggactattagactaacttaatttaaattggtatacagacaagaaaccgaagggaaacgacccctaaactcctagactctacgatgactatacctaagtttgggagacgacggggtcccagtacccgaaggttacacgtagggaacggtaggactcgtagggaactaacttactttttacctttacactactacgacggccggtccctgacgacgtcccgttagaacgttattttacgacctaaactatttaacgtttaccgtagttaaccaaactaaattaattacggaaactaaccttccccttacccccttccgttaaccgtttcccggggacgggtaaacggggaacccgttaaaggggttacggaagttacgtacgaacggttaaccgaacgtggttcgggcttcggaccaaccccttcgttcgttcg

SEQ ID NO: 404697 - DNA, 586 bp, Homo sapiens
  misc_feature: GZ8MTXP01BHRJL.52.23.C01.1.454.CMB.2.raw
  modified_base (434)..(434): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagacgtcaccttcacgttggccgggcgagtcgaggactattagactaaacttatttaaatggtatacagacaagaaaaccgagggaaacctacccctaaatcctagactctacgatgactatacctaagtttggacgacgtacgggtcccagtacccgtaaggttcagtaggaagtgggatcgtaggactaacttacttttactcactatcagcgctgcagtcctagtaagttntttacgactaactattacttacgtattaacaaactaaatatagaactacttccccgttcccctagttaccggttcgggacgggaacggtacaaaggggtgacgtatccgaagttcgaacgtgggtgaaccgtcgcttaacctcgttcttccg

SEQ ID NO: 404698 - DNA, 638 bp, Homo sapiens
  misc_feature: GZ8MTXP01AEO8X.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacgttggccgggcgagtcaggacattagacaacttatttaaattggtatcagacaagaaaccgagggaaacacccctaaactcctagactactaacgatgactatacctaagtttggacgacgtacggggtacccagtccgtaaaggtcacgtagggagtagacgtcgtagggactacgttattttaccttacacctatcgacggccgggtacctcgactacggtaccttaggtaagttactttagacctaaatactttaattacgttataacaaacttaaataagttagaaacgttaccttccccttaccccgtgttaaccggttccggggacgggtaacgggaaccgttaaggggttagaacgtacgtacgaacggttacgttaacgtggtcggcgtcggacttaccgtaacgttcgtttaaccg

SEQ ID NO: 404699 - DNA, 619 bp, Homo sapiens
  misc_feature: GZ8MTXP01BDSZ6.52.23.C01.1.454.CMB.2.raw
  modified_base (199)..(199): a, c, t, g, unknown or other
  modified_base (225)..(225): a, c, t, g, unknown or other
  modified_base (593)..(593): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatccctccctgtctgcatctgtagganacagatcaccttcacgttggccgggnagtcaggactattagactaaacttatttaaatggtatcagacaaagaaaccgaagggaaacctaccccctaaatcctagactcgtacgatgactatacctaagtttaggacgacgtacggggtccaagtaccgaagggttcaagtacggaagtagtatcggtagggtaacctacttacttttactacgactatcagtccggcctgacctagtacccttaggtaagttactttagaactaaactatttacttaacgtactaaactaaactaaagttatacgaactccttacccctccctacgttacgttcgggacggtaacggtaacgagggtgaagtacgtacgaacggaccgttagttgaccgggtntacccgacttaacccttcgttcgtcg

SEQ ID NO: 404700 - DNA, 605 bp, Homo sapiens
  misc_feature: GZ8MTXP01DORSK.52.23.C01.1.454.CMB.2.raw
  modified_base (197)..(197): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcagtcaggacattagcaactatttaaattggatcagcaagaaaccagggaaacgcccctaaaactcctagatccacgatagcataccaatttggagacgaggggtcccatcccaaggttcacgtggaagtggatcgtgggactactattttacttcacatcagcgctgcagcctagtaagtatttgactaactattaactttacggtattaactaaactaaattaataacgtaaacgtactttaccccttacccccttacgttaacccgttttccgggaccgggtaaacggggtaacccgttaaaggggttacgggaagtaacgtaccgaaggaacggttaaaccgtggtacggcgttacggaccacctaacttaacgtttccg

SEQ ID NO: 404701 - DNA, 512 bp, Homo sapiens
  misc_feature: GZ8MTXP01EDDLF.52.23.C01.1.454.CMB.2.raw
  modified_base (211)..(211): a, c, t, g, unknown or other
  modified_base (396)..(396): a, c, t, g, unknown or other
  modified_base (400)..(400): a, c, t, g, unknown or other
  modified_base (447)..(447): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctcctgtctgcatctgtaggagacagagtcaccttnacttgccgggcagtcaggacattagcaactattaaatggtatcagcaagaaaccagggaaagcccctaaatcctagatctacgatgcatccaatttggagacaggggtcccatccaaggttcacgtggaagtggatcgtgggactactatttacttcactatcagcggctgcagtcctagaagtntttnactaacattattacggtatacaaataatatgaatactacctcccctntacgtttcggcggtaagggaccaagggtgagatcgagacgactgtaggctgcactaattcgttcg

SEQ ID NO: 404702 - DNA, 711 bp, Homo sapiens
  misc_feature: GZ8MTXP01E05V2.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatcctccctgtctgcatctgtaggagacagagtcaccttcacgttgccgggcagtcaggactattagactaatatttaatggatcagacaagaaaccgaggaaacgacccctaaactcctagatctacgatcgactactacccgtaaagtttgggaagtaccgtacgggggtaccctaagttacccgtaaagggtttaccaacgtaggggtaaagtcgggtaattccggttaacggggtaaacctaacctttaattttttaacccgtttaccaaccgttaacttccgtaaacgcccgggtacttcgggactacggtacccgtaagggtaaacgtttatttacgaccctaaacttatttaaacggtttcgtaacgtttaacaaacctaaaggtaattaacggaaacttccttaccccgttacccctacgttaccggtttcggggacgggtaaaccggggtaaccgttaaaggggtacgaacgtacgtaacgaacggttacgttacgtgggtacgtccgtacgaccgttactcgttcgtcg

SEQ ID NO: 404703 - DNA, 535 bp, Homo sapiens
  misc_feature: GZ8MTXP01EJANE.52.23.C01.1.454.CMB.2.raw
  modified_base (196)..(196): a, c, t, g, unknown or other
  modified_base (221)..(221): a, c, t, g, unknown or other
  modified_base (277)..(277): a, c, t, g, unknown or other
  modified_base (402)..(402): a, c, t, g, unknown or other
  modified_base (437)..(437): a, c, t, g, unknown or other
  modified_base (457)..(457): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagganacagagtcaccttcacttgccgggnagtcaggacattagctaactattaaattggtatcagcaagaaaccagtaggaaacncccctaaatcctgatctacgatgcatctaagtttggacgacgacggggtcccatcaaggttcacgtggaaagtggaatcgtgggactactattttactcactatcgagcggcctgcagctgaatntttgactaatattagttactgttacaaactaatangtaactacttcctacccctntaacgtttcgggaacgggtagggaccgaagggttcgagtattcgagacgaacgtggtgctcgactaaccgttaagttc

SEQ ID NO: 404704 - DNA, 595 bp, Homo sapiens
  misc_feature: GZ8MTXP01CSOWE.52.23.C01.1.454.CMB.2.raw
  modified_base (226)..(226): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcctaccttcacgttggccggggngtagtacgaaggactattacgactaaacttaattaaatggatcagacaagaaaccgaggaaacctacccctaatctagatcagatcgactatactaagtggacacggtacggtcctagtaccgaggttacaggtaggagtacgggtatcggtaggtacctacgtttatttacctacactactcgacgccgctagacctagtactagtaacttattacactaatattacttacgactaacaaataagtagtagactcttacccctccgttctacgggttcgggagggtaaccgggacgaggggtagacgtacgacttaaacgggttacgttaacgtggtcggaactcgaccccttagttcttccgttccg

SEQ ID NO: 404705 - DNA, 607 bp, Homo sapiens
  misc_feature: GZ8MTXP01DF5WD.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctagtaggagacagacgtcaccttcacgttggccgggcgagtcaaggactattagactaacttaattaaattggtatcagacaagaaaaccgagggaaacacccctaaactcctagatacacgatgactatacctaagtttggacgacgtacggggtacccagtacccgaaggtttcacgtaggaagtaggatcgtagggtaactactttaacttttacttacaacctattacgagtccggcctgcctagacccgttagtaagttagtttacactaaactattaacttaccgtataacctaaataatatagtaactacttaccctcccctacgtaccgtttacgggcgggaacggtaaccggaggttacggaagtacgtacgagttacgacgttgaggctcgcacctaagttcgttaacg

SEQ ID NO: 404706 - DNA, 630 bp, Homo sapiens
  misc_feature: GZ8MTXP01CSWE8.52.23.C01.1.454.CMB.2.raw
tcagcgcagtacgacacgaccggtgctcgatttagtacacgtgattagggattgggggagtcagtcccaacaggacacagcatggacatgagggtccctgctcagctcctggggctcctgctgctctggctctcaggtgccagatgtgacatccagatgacccagtctcatcctcctgtctgcatctgtaggagacagagtccaccttcacttgccgggcagtcaaggactagttagactaaattaatttaaatggatcagacaaagaaaccaagggaaactcccctaaatcctagacttcaacgatcgacattaccgtaagttcggaagacgacggggttacccataccgaaggttcagttaggaagttgggaacttcgtagggtaactaacttactttttacctacaactacttcaacggccggtccgtacgacgacgtacgttagtaacgttactttacgaacttaattaacgtttaacttacggtacttaaactaaactaagtaactacgtaacgtaccttaccctaccctaccgtaccgttacggtacgggtaacgggtaacggttacggtaggacgtacgtacgacgacgttacgtcgtcgtcgtcgacttactcgttcgttcg

SEQ ID NO: 404707 - DNA, 577 bp, Homo sapiens
  misc_feature: GZ8MTXP01CEWPI.52.23.C01.1.454.CMB.2.raw
  modified_base (222)..(222): a, c, t, g, unknown or other
  modified_base (468)..(468): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggngaggtcgggactattagactaacttatttaaattggtatcagcaagaaaccagggaaacacccctaaatcctagatctacgatgacactacctaagtttggagtacgagggtccagtcaacggttcagtggaagtggaatcgtgggactacgtattttactcacctatcagcgcctgcagcctagtaagtatttgacaactatattactgtaacaaataatactagaactcctacccttacccctntaaccgtttcgggacgggtacgggaaaccgtagggttaggaacgacgtacgaaggaccgttaacgttgggtaacggctaacggacctacacgttccgttcgtttaaccc

SEQ ID NO: 404708 - DNA, 608 bp, Homo sapiens
  misc_feature: GZ8MTXP01BTHT2.52.23.C01.1.454.CMB.2.raw
  modified_base (199)..(199): a, c, t, g, unknown or other
  modified_base (409)..(409): a, c, t, g, unknown or other
  modified_base (482)..(482): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatccctccctgtctgcatctgtagganacagacgtcaccttcacgttcgccgggcgagtcaggactattagactaacttatttaaatggtatcagacaacgaaaccatacggaaacgtacccctaaactcctagactctacgatgcactccgtaagtttggacgacgacggggtacccatacgaaggttcagtaggaaacgtggaatcgtagggactacttacttttacttcacctntacgacgcggtcctgacagtcctagaagtatttgactaaactattaacttacgttctaactaaactagttaanacggtaactacttccccttccccgtacgtaccgtttccgggaacgggtaacggttaaccggtagggttgaacgtacgttacgagttaccgtaacgtgggtcggcctacgacctaaccttcgttccg

SEQ ID NO: 404709 - DNA, 730 bp, Homo sapiens
  misc_feature: GZ8MTXP01A5LW7.52.23.C01.1.454.CMB.2.raw
  modified_base (228)..(228): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatccctcctgtcctgcatctgtaggagacagacgtcaccttcacgttcggccgggngagtcaggactattagactaacttaatttaaatggtatacgagacaaagaaaccgaaggaaaccgacccctaaatcctagactactacgatcgactactacccgtaagtttgggaacgtacgtacggggtacccaagttaccccgtaaacggtttacaacggtagggtaaacggttacgggtaacgttccggtacggggtaaacccttaaccgttttaactttttttaacccgtttaccaaacccgttaacgttacccgaaccgggtcccggggtaaccccttggaacccgtacgggttaccccgttaaaggtaaacgttttacgttttacgaaccttaaaaccttatttaaacgttaaccctagtaaactaaactaataattaacggaacttacccttccccgtacccctacgttaccggttacggggacggtaacgggtaacgttagggtagacgtactacgaacgttacgcgttaaggcgcgtcgacacctgttcgttc

SEQ ID NO: 404710 - DNA, 557 bp, Homo sapiens
  misc_feature: GZ8MTXP01DCYWR.52.23.C01.1.454.CMB.2.raw
  modified_base (284)..(284): a, c, t, g, unknown or other
  modified_base (465)..(465): a, c, t, g, unknown or other
  modified_base (539)..(539): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtccaccttcacgttggccgggcgagtcaaggactattagctaaacttatttaaattggatcagacaagaaaccaggaaacncccctaaatcctgactctacgatgacatacctaaagttggacgacgtacggggtcccagtcccaaggttcagtaggaagtcgatcgtagggtaactacttattttacttcaacgtatcagcgctgcagctagaacgtatttagacaactattattacgtatacaaactaatagtagtaacncttaccctccccttactaccgttcgggacgggtaacggaccgaagggtgagtaatcgaagcgttaacgtggcgntcgacactaagttccttg

SEQ ID NO: 404711 - DNA, 608 bp, Homo sapiens
  misc_feature: GZ8MTXP01EXB9R.52.23.C01.1.454.CMB.2.raw
  modified_base (196)..(196): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagganacagacgtcaccttcacttggccgggcgagtcaggacattagcaacttatttaaattggtatcagacaagaaaccgaggaaacgacccctaaactcctagactactacgatgacatacctaagtttcggacgacgagggggtcccagtacccaaggttcacgtggaagtgggaatcgtagggactactattttaccttcactatcacgcgcctgcagaccctgtaagtatttgactaaactatacttacgtgttaacaaactaattaagtagtaacgtaaccttccctacccccgttagtaccgtttacggggaccgggaaggggtaacccgttaaggggtaggttacggaacgttcgaaaggttaccgaacgtttgggcggtaactcggaccttaccgtaacgttcttccg

SEQ ID NO: 404712 - DNA, 534 bp, Homo sapiens
  misc_feature: GZ8MTXP01DXOI2.52.23.C01.1.454.CMB.2.raw
  modified_base (198)..(198): a, c, t, g, unknown or other
  modified_base (447)..(447): a, c, t, g, unknown or other
  modified_base (466)..(466): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtagganacagagtcaccttcacgttgccgggcgagtcaagggacattagactaacttatttaaattggtatcagacaagaaaccgaggaaacgcccctaaactcctgatctacgatgcatcctaagtttggagacgaggggtcccatccaaggttcagtggaagtggatcgtagggactactattttacttcactatcagccgctgcagtctagtaacgtatttgacaactattacttactgttacaaataatanagaatacttacctcccctntcgttcggcggaaggtacaggtcggagactgacgcttacgtggtacgcttggacttacctgttcttcg

SEQ ID NO: 404713 - DNA, 565 bp, Homo sapiens
  misc_feature: GZ8MTXP01BXUBX.52.23.C01.1.454.CMB.2.raw
  modified_base (221)..(221): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagatcaccttcacttgccgggngagtcaggacattagctaatattaatggatcagcaagaaaccgaggaaacgcccctaaactcctagactctacgatgacataccaatttggagacgtagggtcccatcccgaaggttcacgtagggaagtacgaagtcgtagggaactacttatttttaccttcacctatcagccggctgccagcctagaagtactttagactaaactattaacttactagttacaaacaaattatacggaaatacttcctaccccgtctacgtttccggcggggtaacggaaccgttaggggtcgaagtacgtacgaggcgttaacgttgcggctagcactaacgttcgttcg

SEQ ID NO: 404714 - DNA, 583 bp, Homo sapiens
  misc_feature: GZ8MTXP01ARO86.52.23.C01.1.454.CMB.2.raw
  modified_base (277)..(277): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacattagcaacttatttaaattggatcagcaagaaaccataggaaacncccctaaactcctagatctacgatgcatccaatttggagacagggtccatacaggttcacgtggaaagtggaatcgtagggactacttattttacttcacctatcgagcggctgcacgtcctagaagttatttagactaaactattactttactgttacaaacgtaatacgtaggaactaccttccctcccccttagtaccgtttcggggaacggtaacggggaacccgtaaaggggttggaaacgtacttaccggacgttacggaaccgttgggtaacgcttcggacctaaccgttaactttccg

SEQ ID NO: 404715 - DNA, 533 bp, Homo sapiens
  misc_feature: GZ8MTXP01EXK26.52.23.C01.1.454.CMB.2.raw
  modified_base (414)..(414): a, c, t, g, unknown or other
  modified_base (425)..(425): a, c, t, g, unknown or other
  modified_base (443)..(443): a, c, t, g, unknown or other
  modified_base (456)..(456): a, c, t, g, unknown or other
  modified_base (527)..(527): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggatcagcaagaaaccagggaaacgcccctaaatcctgatctacgatgcatcccaagtttggagacgaggggtcccatcccaaggtttcacgtaggaagtggaatcgtgggactactattttacttcacatcagcggctgcagtcctagagtatttgactaanattattacgtntactaacaatatagaaanctaccctcccctnttaccgttccggacggaacgggtaaccgaaggtggagtacgcgaacgcgaacttgaggctagccaaccgtnttcgtg

SEQ ID NO: 404716 - DNA, 506 bp, Homo sapiens
  misc_feature: GZ8MTXP01BS122.52.23.C01.1.454.CMB.2.raw
  modified_base (196)..(196): a, c, t, g, unknown or other
  modified_base (221)..(221): a, c, t, g, unknown or other
  modified_base (278)..(278): a, c, t, g, unknown or other
  modified_base (390)..(390): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagganacagagtcaccttcacttgccgggngagtcaggacattagcaactattaaatggatcagcagaaccaggaaagcccctaaancctgatctacgatgcatccaatttggagacaggggtcccatccaaggttcacgtggaagtggatcgtgggactactattttacttcactatcagcggctgcagcctgaagtntttgctaactatattacgtgtacaaacaatatagaacactcctcccctctactttcgacggtaacggaccaagggtcgagactcagacgaactggtagctcgcactaattcgttcg

SEQ ID NO: 404717 - DNA, 593 bp, Homo sapiens
  misc_feature: GZ8MTXP01DKZ9X.52.23.C01.1.454.CMB.2.raw
  modified_base (287)..(287): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtccaccttcacgttggccgggcgagtcagggactattagctaaacttatttaaatggtatcagacaagaaaccgagggaaaccncccctaaactcctagactctacgatgactaatcctaaagtttggaacgtaccgacggggtcccagtacccgaaggttcacgtaggtaagtgatcgtagggactacttattttacctacactatcagcgcctgcagtcctagtaagtatttacgactaactattaacttactacgtaacaaactaatatagaactacttccctcccctataccgttcgggacggaacgggtaaccgaagggtcggaagtaacgtacgaacggttacgttaacgtggtcggtctcggacttaacctcgttcttaaccg

SEQ ID NO: 404718 - DNA, 596 bp, Homo sapiens
  misc_feature: GZ8MTXP01BDLU8.52.23.C01.1.454.CMB.2.raw
  modified_base (223)..(223): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatcctcctgtctgcatctgtaggagacagagtcaccttcacgttgccgggnagtcaggacattagctaacttattaaatggatcagacaagaaaccgagggaaactcccctaaacgtctagactctacgatgacataccaagtttggacgtacgacgggtcccagtaccgaaggttcagtacggagtaggactcgtagggtaactacttatttttaccttacaacctattcgacgcggtctcgcacgaccgtagtaagtacttttacgactaactattaacttacgtacgttacaaataattaagtagaacgtaccttacctccccttagaccggtttacgggacggtaacggacgaaagggtcgaagacgtacgaacgttacgttaccgtggtacggtcacgccttaacgtcgttcttaaccg

SEQ ID NO: 404719 - DNA, 709 bp, Homo sapiens
  misc_feature: GZ8MTXP01B8380.52.23.C01.1.454.CMB.2.raw
  modified_base (197)..(197): a, c, t, g, unknown or other
  modified_base (226)..(226): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtccaccttcacgttcggccgggnagtcaggactatagactaacttatttaaatggtatcagacaaagaaaccgaagggaaaccgacccctaaactcctagactactacgatgactactacctaaagtttcggagacgtacggggtaccctagtacccgtaaggttcaacgtaggtaagtagggactcggtagggaacttacgtttactttttaaccttaccaacctagttaccgaacgggtccggtaccgttacgacccgtacggtacccgttaggtaaagtttacgttttacgaacccttaaacttaatttaaactttaacgggtacgttaaactaaaacctaaattaacgtacggtaaacgtacctttacccctacccccttagttacccggtttacggggaccggggtaaacgggtaccggttaaaggggttacggaacgtaacgttcgaacggttacgttacggtggtacggtctacggaccttacgttaacttcgtttccg

SEQ ID NO: 404720 - DNA, 684 bp, Homo sapiens
  misc_feature: GZ8MTXP01B4TQC.52.23.C01.1.454.CMB.2.raw
  modified_base (199)..(199): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatccctccctgtctgcatctgtagganacagagtcaccttcacgttggccgggcagtcaggactattagactaacttatttaaattggtatcgagacaagaaaccgaagggaaaccacccctaaactcctagactactacgatgacactacctaagtttcggacgacgtacggggtccccagtaccgaacggtttcacgtaggaacgtgggacttcggtagggtaacctaacgtttactttttaccttaccactaactccgaaggtccgccgttcgaccgtacgtacccgttaaggtaacgttactttacgacctaaacttattaacgtttactagttaacctaaactaagttaactacgaactaccttaccccttccccctaacgttaccggtttccggggaaccggggtaacgggaacccgttaaggggttacggacgtaacgtaccgaacggttaccggttaaccgttggtacgggccttacggaccaacccgtttcgttccgttaacg

SEQ ID NO: 404721 - DNA, 565 bp, Homo sapiens
  misc_feature: GZ8MTXP01D1NLH.52.23.C01.1.454.CMB.2.raw
  modified_base (372)..(372): a, c, t, g, unknown or other
  modified_base (411)..(411): a, c, t, g, unknown or other
  modified_base (436)..(436): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggactattagacaactatttaaattggatcagcaagaaccaggaaacgcccctaaactcctgatctacgatgcataccctaatttggagacgtagggggtacccatccaaggttcaacgtggaagtggatcgttgggactaactnttttaccttcaccattcagtcggcctgcagcctgtaagnttttcgacaactattaattacgttnttaacaaacctaataatagaaagtacttcccttaccccctctaaccgtttccgggacgggaacgggtaaccgaaagggtgggttaagtataccgaagacgaacgtgtaggctgccactaacttctttcg

SEQ ID NO: 404722 - DNA, 683 bp, Homo sapiens
  misc_feature: GZ8MTXP01DOT46.52.23.C01.1.454.CMB.2.raw
  modified_base (198)..(198): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgaccagtctccatccctcctgtctgcatctgtaggganacagacgtccaccttcacgttggccgggagagtcaaggactatagactaaattatttaaatggtatcagacaaacgaaacgaacgggaaaccacccctaaacgtcctagactactaacgatagactactaccgtaagtttaggagaaccgtagggggtaccccaagttacccgaaaggtttacgaacgtagggaaaggttggaagttcggtagggtaaccttaaactttactttttaccttacaaccgttatacgtacggccggtccgtcgacgtagtacgttaagttaattacgttacgaactaacttaagttaacttaacgtaacgttaactaaaataattaagtaacgtaacgttacccttaccccgttccccttacggttaccggtaccggggaacgggtaacgggtaacggttagggtaggaacgtacgtaacgaacggttacgttacgtcggacgtccgcgtaccttactcgttcgtcg

SEQ ID NO: 404723 - DNA, 579 bp, Homo sapiens
  misc_feature: GZ8MTXP01BBG5H.52.23.C01.1.454.CMB.2.raw
  modified_base (196)..(196): a, c, t, g, unknown or other
  modified_base (532)..(532): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagganacagatcaccttcacttgccgggcgagtcaagggacattagactaaacttatttaaattggtatacagcaagaaaaccgagggaaacgacccctaaactcctagactctacgatgactatacctaagtttggagtacgaggggtcccatccctaaggttcacgtagaaggtggatcgtagggaactactacttttacttacactatcgagccgtctgcagtcctagtaagttactttagactaactattaacttacggtatacaaactaatatacgaatactccctccccgtctacggtttcgggacggtaagggacccttaaggggtacgagtanacgaagcgaacgtgggttcgaacttcggcaacccgttcgttcgttcg

SEQ ID NO: 404724 - DNA, 563 bp, Homo sapiens
  misc_feature: GZ8MTXP01B3NHQ.52.23.C01.1.454.CMB.2.raw
  modified_base (477)..(477): a, c, t, g, unknown or other
  modified_base (544)..(544): a, c, t, g, unknown or other
  modified_base (548)..(548): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagacgtcaccttcacgttgccgggcagtcaggactattagctaaacttattaaattggtatcagacaagaaaccgaagggaaacaccccctaaatcctagactctacatcgactactacctaagtttgggaagacgacgggggtccccataccgaaggttcagtagggaagtaggtactcgtagggactacgttatttttaccttacacctattccgagtccggctgccagcctaggtaatactttgataactatacttactgtaactaacatatanaacgtacctcctacccctcgtacgttcggcggtaagggaacagggtagagacgtcagttcgacgtgnggcngcactcgttcgttcc

SEQ ID NO: 404725 - DNA, 600 bp, Homo sapiens
  misc_feature: GZ8MTXP01B3XMS.52.23.C01.1.454.CMB.2.raw
  modified_base (481)..(481): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagacgtcaccttcacgttggccgggcgagtcaggactattagctaacttattaaattggatcagacaagaaaccagggaaccacccctaaactctagactctacgatcgactactccgtaagtttaggagacgacggggtcccagtaccgaaggttcacgtaggaagtgtactcgtgggaactacttattttaccgttacactactctaggccgtactgaccaggtacctaggtaattattacgactaaactattaacttacgtagtaacctaaatagtaanagaactacttaccccttcccctagtaccgttcggggacggaacggtaccgaagggtcggaacgtacgacgttaacgacggttaacgttggaggtcttcggcttaccgtaattcgttaac

SEQ ID NO: 404726 - DNA, 575 bp, Homo sapiens
  misc_feature: GZ8MTXP01C4GVV.52.23.C01.1.454.CMB.2.raw
  modified_base (197)..(197): a, c, t, g, unknown or other
  modified_base (211)..(211): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttnacttgccgggcagtcaggacatagcaactattaaattggatcagacaagaaaccgagggaaacgacccctaaactcctagactctacgatgacatacctaagtttggagacgtacggggtccaagtccaaggttacacgtaggaagtaggatcgtgggaactactattttacttacacatcagtcggctgcagcctagaagtatttagactaaactattaattactagttacaaataattaatagaatacttaccctccccttacgtacgtttccgggacgggtaacgggtaaccgaagggtcggaagacgtcgaaggttaccggttaaagtggtagcgttcggaccactaacgttctttcccg

SEQ ID NO: 404727 - DNA, 576 bp, Homo sapiens
  misc_feature: GZ8MTXP01ETUK7.52.23.C01.1.454.CMB.2.raw
  modified_base (197)..(197): a, c, t, g, unknown or other
  modified_base (221)..(221): a, c, t, g, unknown or other
  modified_base (284)..(284): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagatcaccttcacttgccgggnagtcaggacattagcaactattaaatggatcagacaagaaaccagggaaacgacccctaaacncctgatctacgatgactatccctaaatttggacgtacgaggggtcccaatccaaggttcacgtaggaagtgatcgtgggaactactattttaccttcacctatcagcgctgcagcctagtaatatttagacaactaatattactacgttactaaacaatataggtaaactactacccttcccctacctaccgtttccgggacgggaacgggtaccgaaagggtaggaagagtaacgaacgttaacgaaacccgtggtacggtaacggtcgaccttactaacgtttccttcgg

SEQ ID NO: 404728 - DNA, 806 bp, Homo sapiens
  misc_feature: GZ8MTXP01DV65U.52.23.C01.1.454.CMB.2.raw
  modified_base (198)..(198): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtagganacagacgtcaccttcacttggccgggcgagtcaaggactatagactaacttattaaatggtatcagacaaagaaaccgaagggaaaccgtacccctaaactccctagtactacgtaccgatacgactatacccgtaaagtttcgggaacgtaccgtaacgggggtcccaacgttaccgtaaacgggttaccgaacggttagggaaacggttacgggaacgttcggtaacggggtaaacctaaaccgtttaacgttttttaacccttaccaaaccgtaacttaccgaacggtcccggtaccgttcggacctaacggtacccgttaaggttaaaggtttacttttaacgaacctaaaacttaagtttaaccgtttaacgttaacgttaaacctaaaaacgtttaacttaaagttaaccggtaaaccgttaccctttaaccccctttacccccgttaacggtttaaccggtttcccgggggaaaccggggaaacggggtaacccggttaagggggtaggttaacgtaaacgtaccggttaaacggttacccggttaaagttcgggtaacgggtcttacccggacgttaaccgtaacgtttcgtttaacccg

SEQ ID NO: 404729 - DNA, 582 bp, Homo sapiens
  misc_feature: GZ8MTXP01A7RQP.52.23.C01.1.454.CMB.2.raw
  modified_base (225)..(225): a, c, t, g, unknown or other
  modified_base (422)..(422): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtccaccttcacgttgccgggngagtcaggactattagctaacttatttaaattggtatcagacaagaaaccgagggaaactcccctaaatcctagatctacgatgactatacctaagtttggagtacgacggggtcccatccgaaggttcacgtgggaacgtggactcggtagggactacttattttacttcacatcagcgctgcagactagtaagtntttacgactaactatactttacgtagtaacaaataattataggaactaccttaccctaccccgtctaaccggtttcgggaccgggaacgggtaaccgaaggggtcgaagtacgacgaacggccgttaacgtggtacgggctcggtaccactcgttcttcg

SEQ ID NO: 404730 - DNA, 916 bp, Homo sapiens
  misc_feature: GZ8MTXP01BIZUV.52.23.C01.1.454.CMB.2.raw
  modified_base (230)..(230): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagacgtcctaccttcacgttggcccggggngagtcaggacattagacctaaattaatttaaagttggtatcgagacgaaacgaaaccgaggggaaacctaccccctaaactcccgtagtacttacgtaaccgtatcgactaacttacccgtaaagttttcgggggaacgtaaccggtaccggggggttacccctaaagtttaacccccggtaaaacggggtttaccgaaaccgggttaggggtaaaggttacggggtaacttccggggtaaacggggttaaacccttaaactttttaacgttttttaaccctttaccgaaaccccttaaacgttcccgaaacgggtccccgggtcccgttacgggtacccacggttaaccccggttaaggttaaacgggtttaacgtttttaccgaaaccttaaaacccgttaaattttaaacctttaaacgggggtttaacgtttaaacccgtaaaaaacccttaacgggtttaaaattccgggtaaaacccgtttaaccctttaacccccctttaccccccgtttaaccggttaacccgggtttttaaccccgggggaaccgggggaaacgggggttaaccccttaaaaggggggttccaaggggtaaactacccgggttaaggttaaaccccgggttaggtttcgggaaccggtcttaccgggaaccccttaggtaactttccggtttaaccg

SEQ ID NO: 404731 - DNA, 681 bp, Homo sapiens
  misc_feature: GZ8MTXP01BG9JX.52.23.C01.1.454.CMB.2.raw
  modified_base (261)..(261): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccactccctccctgtctgcatcgtgtaggagacagagtcaccttcacttggccgggcagtcaggactatagacaacttaattaaatgtatnacgacaagaaaccgaggaaaccgtacccctaaactcctagtactactacgatagacctaactaccctaagtttggaacgtaccgacggggtacccctaagtaccccgtaaggtttaccaaggtagggaaggtacggacgttcgtagggtaacctaactttatttttaacctcaaacgacttcgacggtccgtccgtaggaccaacggttacccttagggtaagtttactttacggaacctaacttaactttaacgttacgttaacgttaaaccaaaccttaattaaagttacggaaacttaaccttcccctaccccgttacgttacccggtttacgggacgggaacgggtaaccgttagggtcgaagtaacgtcgaacggttcgacgtgtacgggtctacggccttactcgttcttcccg

SEQ ID NO: 404732 - DNA, 623 bp, Homo sapiens
  misc_feature: GZ8MTXP01AZOI4.52.23.C01.1.454.CMB.2.raw
  modified_base (197)..(197): a, c, t, g, unknown or other
  modified_base (614)..(614): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctcctgtctgcatctgtagganacagagtccaccttcacgttggccgggcgagtcgaaggactattagactaacttaatttaaattggtatcgagacaagaaaccgaagggaaaccacccctaaaactcctagactactaacgatgactatacctaagtttggacgacgacggggtaccagtaccgaaggttcacgtaggaagtaggactcgtagggtactacgttaacttttaccgttacaactacgtcctaaggccggtcctggcctaacggtccgttagtaacgttactttagactaaactattaacttacgtacgtaactaaactaattaatagaaactacttacccttcccctacgtaccgttccgggcgggaaggtaaccggttagggtgacgaagtccgaagttacggaacgtgggacgctcgacaccgttnttcgtttcg

SEQ ID NO: 404733 - DNA, 592 bp, Homo sapiens
  misc_feature: GZ8MTXP01A4JZL.52.23.C01.1.454.CMB.2.raw
  modified_base (471)..(471): a, c, t, g, unknown or other
  modified_base (484)..(484): a, c, t, g, unknown or other
  modified_base (487)..(487): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttgccgggcgagtcaggacattagactaactatttaaatggtatcagcaagaaaccagggaaacacccctaaactcctagactcgtacgaattgacattaccctaaagttttacgggagttaccgacgggggttacccaagtaccccgaaaggttccaagtaggaaacggtgggaactcgtagggaacctaacttacttttacttcacatcgaagcggacctgcagtccgtagtaagtatttgactaacattatacgtntacaaactattanganctcctccctactacgttcggcggtaaggaccaagggtcgaagtactcgaacggttcgttaaccgtgggttagggccttaacggcccttaacccgttcgttcgtcg

SEQ ID NO: 404734 - DNA, 632 bp, Homo sapiens
  misc_feature: GZ8MTXP01CJTE4.52.23.C01.1.454.CMB.2.raw
  modified_base (197)..(197): a, c, t, g, unknown or other
  modified_base (223)..(223): a, c, t, g, unknown or other
  modified_base (384)..(384): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctggtaganacagagtcaccttcacgttgccgggngagtcaggactatagactaactatttaaatggatcagacaagaaaccgaggaaacgtcccctaaactccgtagactactacgatcgactataccctaaagtttgggagtaccgacgggggtacccagttacccgaaggttcacgtaggaagtggtatcggngggtaactacgttatttaccttacgtacatcgagcggactgacagtccgtagaatgtttagactaacattacttacttgtaaccaaataataatacgtaactaccttacccgttacccctaccgttaccgtttcggggaccgggtaacgggtaacccggttaagggtacggttagtaacgttacggaacggttaacgaacgttcggtacggttccgacggttacccgaaccttcgtttccggtttccg

SEQ ID NO: 404735 - DNA, 732 bp, Homo sapiens
  misc_feature: GZ8MTXP01CXRGN.52.23.C01.1.454.CMB.2.raw
  modified_base (198)..(198): a, c, t, g, unknown or other
  modified_base (270)..(270): a, c, t, g, unknown or other
  modified_base (706)..(706): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatcctccctgtctgcatctgtagganacagtacgtctaccttcacgttcggccgggacgagtcgaaggactaattagactaaacttaattaaatgtanacagacaaacgaaaccgaacggaaacctacccctaaatcctagactacgtaacgatacgactatacctaaaggtttcgggaacgtaacggtacggggtccctaagtaccccggtaaggttacacgtagggaaagtcggtagtcggtacggaacttaaacttacgttttaccttacaaccgtatcgaacggtccgtacgtgtaccgagtaccgtttaagtaaggtttactttaacgaaccttaaacttaaagtttaccttaaacggggttaacgttaaccctaaaaaattaagttaaacttaacggtaaaccttccttaccccggtccccttacggtaaccgtttaccgggggacgggaaacgggtaaccgttaaagggggttcgaacgtaacgtccgttaaacgggaccgttaaaggtcggtacgggtaacgtacnccggttaccttaacgttcgtttcccg

SEQ ID NO: 404736 - DNA, 684 bp, Homo sapiens
  misc_feature: GZ8MTXP01AHNWW.52.23.C01.1.454.CMB.2.raw
  modified_base (184)..(184): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtcctccatcctcctgtcngcatctgtaggagacagagtcctaccttcacgttcggccgggcgagtcaggactatagactaactaatttaaatggtatacagtacaagaaaccgagggaaacgacccctaaactcctagactaccgtacgatagacctactacctaaagtttgggaacgtacgtacgggggtacccacgttaccaaacggtttcaacggttaggaaaggtttggaagttccgtaggggaaaccttaacgttaatttttaccttaccaacctactacgacggtccgacctcgctacgtcctagtaaacgttacgtttacgactaaacttacttaacgtttactagttaaacctaactaaattagtaacgtaacgtaccttaccccgtacccctcgttaaccggtttcggggaacgggtaacgggtaaccgaagggttcggaaacgtacttaacggaacgttacgttaaccggttgtacggtcgtacgaccttactaacgttcgttaaccg

SEQ ID NO: 404737 - DNA, 581 bp, Homo sapiens
  misc_feature: GZ8MTXP01AKZM9.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttgccgggcagtcaggacattagctaactattaatggatcagacaagaaaccagggaaacgcccctaaactcctagactactacgatcgcatacctaagtttggagacgacggggtaccatccctaaggttcacgtggagtggatcgtgggactacgtattttacttcactatctagcgctgcacgcctagaagttatttcgactaactattatacgtagtaacaactaatatagaacgtactacccttccccgtcgtaccgtttccgggacggtaacgggaaccgttaaggggaggaagtaacgttacgaacggttacccgttaaggtcggtacgggcttacgggcccttaaccgtcgttcctttccg

SEQ ID NO: 404738 - DNA, 690 bp, Homo sapiens
  misc_feature: GZ8MTXP01BHB4B.52.23.C01.1.454.CMB.2.raw
  modified_base (197)..(197): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcgagtcaggacattagactaattatttaaatggtatcagcaagaaaccgaggaaacgacccctaaactcctagactctacgatcgactatacctaagtttgggagtacgacggggtacccaagtaccgtaaggtttcaacgtagggaaggtaggtacgtcgtagggtaaacctacttactttttacctttacacctaatcgacgccggtcctcgactacgtaccgttaggtaaattacgttttacgactaaactatttaactttaacgttacgttaaacctaaaactaagttaaataacggtaaacgtaccttaaccccttcccccgttacgtaaccggttttccggggaacggggtaaaccgggtaaacccggaaacggggttacggaacgtaagttacgaaacgggttacggttaaaccggtgggtacgggtcttaccgggaccttaaccgttaacgttcctttccg

SEQ ID NO: 404739 - DNA, 632 bp, Homo sapiens
  misc_feature: GZ8MTXP01AYT11.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatcctcctgtctgcatctgtaggagacagacgtcaccttcacgttgccgggagagtcaggacattagactaactattaaattcggtatacagacaagaaaccgacggaaacgcccctaaactcctgactactacgatagctatacctaagttttcgggaagtaccggacggggtccccatacccgtaaacggttcaacggtggtaaggtaggacgttcgtacgggactaacttacttttactttacaccgtaatcgagccggacctcgacgacgtaccgtagtaacgttattttacgactaaactagttactttaaccgtatacctaaataacttaagtaggaactaccttccctaccccttcgtaacgtttccgggaacgggtaacgggaccgaagggtacggacgacgtacgttacgacgttaacgtggtgcttcggaccttactaacgttcgtttcg

SEQ ID NO: 404740 - DNA, 478 bp, Homo sapiens
  misc_feature: GZ8MTXP01CLTRS.52.23.C01.1.454.CMB.2.raw
  modified_base (267)..(267): a, c, t, g, unknown or other
  modified_base (301)..(301): a, c, t, g, unknown or other
  modified_base (388)..(388): a, c, t, g, unknown or other
  modified_base (390)..(390): a, c, t, g, unknown or other
  modified_base (392)..(392): a, c, t, g, unknown or other
  modified_base (402)..(402): a, c, t, g, unknown or other
  modified_base (405)..(405): a, c, t, g, unknown or other
  modified_base (412)..(412): a, c, t, g, unknown or other
  modified_base (414)..(414): a, c, t, g, unknown or other
  modified_base (431)..(431): a, c, t, g, unknown or other
  modified_base (450)..(450): a, c, t, g, unknown or other
  modified_base (452)..(452): a, c, t, g, unknown or other
  modified_base (466)..(466): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacatagcaactattaaatgatcagcagaaacaggaaanccctaaatctagatctacgatgcatcaattgganacgagggccatccgaagttcacgtggaagtggaatcgtagggaactactattttacttacacatcagcgctgcagctagagatttanananatatatatanaanaatatananactctcctctacgtcgnggaacggacgagtagagananagagactgtgcgcncactcgttcgtg

SEQ ID NO: 404741 - DNA, 577 bp, Homo sapiens
  misc_feature: GZ8MTXP01EC8CY.52.23.C01.1.454.CMB.2.raw
  modified_base (199)..(199): a, c, t, g, unknown or other
  modified_base (295)..(295): a, c, t, g, unknown or other
  modified_base (306)..(306): a, c, t, g, unknown or other
  modified_base (428)..(428): a, c, t, g, unknown or other
  modified_base (446)..(446): a, c, t, g, unknown or other
  modified_base (475)..(475): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatccctccctgtctgcatctgtagganacagacgttctaccttcacgttcggccggggacagtcaaggactattagactaaattatttaaatgatcagacaagaacaggaaccaccctaatcngactctacgangactatacctaagttggacgtacggacgggtaccctagttaccgaacggtttacagtagggtaagtcggtattcggtaggtacctaactttatttttacctcaactatcgacgtccggtccngacagtactagtatatanaactatattactagtactaacaatatatnacttcctaccctccctagtccggttcgggagggaacggtacgagggtacgttagacgtaacgaaggacgttagtggtacgtctcgaccttcttcgttcgtcg

SEQ ID NO: 404742 - DNA, 883 bp, Homo sapiens
  misc_feature: GZ8MTXP01A87SB.52.23.C01.1.454.CMB.2.raw
  modified_base (199)..(199): a, c, t, g, unknown or other
  modified_base (228)..(228): a, c, t, g, unknown or other
  modified_base (262)..(262): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatcgtgtagganacagacgtcaccttcacgttcggccgggngagtcaggactatagactaacttattaattgatnagacaagaaaccgaggaaaccgtacccctaactcctagactactacgatacgacacttaccgtaagtttaggaacggtaccgtaccgggggtaccctaagttaccccggtaaacggtttaccgtaaacggttaagggtaacgggttaacgggtaacgttaaccgggttaacgggggtaaaccctttaaacccgttttaacgttttttttaaccctttaaccccgtaaacccgtaactttaccccgggttaaaccggggcccggtaaccccggttcggaccggtaaccggtaaccccggttaaggttaaacggtttaacgtttttaaccggaaaccgtttaaaaccgttaaacgtttaaaccgttttaaaccggtttaccgttaaaaccgttaaaaccgttaaaacttaaaccgtttaaacggggtaaaccttaacccgtttaaccccctttaccccccccgtttacgttaaccccgggttttaaccgggggaacccgggggtaaacccgggggtaaacggttaaccgggggttaaaggacggtaacgttacggaaacgttaccgggttaaccgttaaggtcggtaaccgttacggacccttacgtaacgttcgtttaaccg

SEQ ID NO: 404743 - DNA, 715 bp, Homo sapiens
  misc_feature: GZ8MTXP01EBD4E.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgaccctagtcctccactccctccctgtctgctatcgtgtaggagacagactcctaccttcacgttcggccgggacgagtcgaacggtactaagttagactaaactttaagtttaaagtggtatacgaagacaaaacggaaaccggaacgggaaaccctacccctaactacctagactactacgatacgactattaccgtaaagtttacgggaacgtaaccggtacggggtaccccaagttacccgtaacggttacgtaaggtaggtaaggtacgggtacgtcggtagggtaaccttaacgtttaacttttaccttaccactagtccgacgccggtctagacctacgtacgtaaggtaacttagttacactaacgttaattactttacgtaattaacaaacttaattaagtacgtaaccgttaccttaccccgttccccttaaggtcccggtttaccggggaacgggtaaccggtaaccggaaggggttcggaaacgtgtaaccgaaggttacgttaacggttgacggtctaccggtacacgtaacttcgttaacc

SEQ ID NO: 404744 - DNA, 615 bp, Homo sapiens
  misc_feature: GZ8MTXP01BP5VA.52.23.C01.1.454.CMB.2.raw
  modified_base (277)..(277): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggactattagactaactattaaattggatcagcaagaaaccagggaaacncccctaaactcctgactctacgatgctatccaagtttcggacgacgacggggtacccagtaccgaaggttcagtgggaaggtacgatcgtagggtacctacgttactttttaccttcaacctatcgagtccggactgacacgtacctagattatttacgactaactatactttactacgttaacaaactaattagtacgaactaccttaccctcccccgttagtaccggtttccgggacgggtaacgggtaaccgttaaggggtggaaacgtaacgtacgaacggttacggaaacgttgggtacggtcgttcggaccttaaccgtaacttcggtttcc

SEQ ID NO: 404745 - DNA, 674 bp, Homo sapiens
  misc_feature: GZ8MTXP01CNBD6.52.23.C01.1.454.CMB.2.raw
tcagcgcagtacgacacgaccggtgctcgatttagtacacgtgattagggattgggggagtcagtcccaatcaggacacagcatggacatgagggtccctgctcagctcctggggctcctgctgctctggctctcaggtgccagatgtgacatccagatcgacccagtcctccactccctccctgtctgctatctaggtaggagacagtacgtcctaccttcacgttcgggcccgggcgagtcgaaggtactattagactaacttatttaagtgtatcagacaaggaaaccgaagggaaacctacccctaaactccgtagtactactaacgtatcgactacttaccgtaaggttcggaacggtaacggtacggggtacctacgttaccgtaacggttcaacggtagggaaacgttggaacgttcgtaacgggtacttacgtttactttaccttacacctatcgacggtccgtctacgacgtacgtccgtaagagtttacttacgaactaaagttattacggtactacgtaactaaatatacacgacttaccctcccgttcccctagttaccggttccgggaacggtaaaccgggacgtaaagggttcgtaaactacggttacccgaggaaccggtaacgttgggtcccgaggtaccaccgtaacttcgtttccg

SEQ ID NO: 404746 - DNA, 635 bp, Homo sapiens
  misc_feature: GZ8MTXP01BAFVZ.52.23.C01.1.454.CMB.2.raw
  modified_base (407)..(407): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctcctgtctgcatctggtaggagacagacgtccaccttcacgttcggccgggcgagtcaggactattagactaaacttatttaaattggatcagacaaaggaaccgaagggaaacctacccctaaactcctagactctacgatcgacataccaagtttcggacgtacgacgggtccatacgacggttcagtggagtgatcgaggtactacgttactttactcacgtatacgngcgtcgcgacgtacgtacgtagtaatacgttttacactaaacttattaacttacgggtactaaactaaactaacgtaagtacggaaactccttaacccctccccgtacgttaccggttccgggaacgggtaacggtaaccgggttagggaccgttaagtacgtaacgttacggttacgacggttgggttccgggcttaccggaccttaaccgtcgttccttttcccgg

SEQ ID NO: 404747 - DNA, 648 bp, Homo sapiens
  misc_feature: GZ8MTXP01BKCQF.52.23.C01.1.454.CMB.2.raw
  modified_base (201)..(201): a, c, t, g, unknown or other
  modified_base (228)..(228): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatccctccctgtcctgctatctgtagganacagactcaccttcacgttggccgggnagtcaggactattagactaattattaaatgatcagacaagaaaccgaggaaacctaccctaaactccgtagaactctaacgtatacgactattacccgtaagtttggacgtacgtacggggtaccctagtacccgtaaaggttccagtagggtaagtcgtatcggtagggtacctacttaactttttacctacactaatcgagccggctgccgtagtaccgtagtaattcgttacactaactattacgttactagtaacaataattacgataaactccttaccccttcccgtacgtaccgttcggggaaccgggtaacggtaaccgttaaaggggtcgttaaacgaccgttagaaacgggttaccgttaaggttccggttagggtaacctacggaccttaacgtcgtttccgtttaaccg

SEQ ID NO: 404748 - DNA, 797 bp, Homo sapiens
  misc_feature: GZ8MTXP01CPYDD.52.23.C01.1.454.CMB.2.raw
  modified_base (227)..(227): a, c, t, g, unknown or other
tcagcgcagtacgacacgaccggtgctcgatttagtacacgtgattagggattggggggagtcagtcccaaccaggacacagcatggacatgagggtccctgctcagctcctggggctcctgctgctctggctctcaggtgccagatgtgacatccagatcgacccagtctccatccctccctgtctgcatctgtagagacagagtcaccttcacgttcggccgggnagtcaaggactatagctaatatttaatgtatcagacgaagaaaccgaggaaacgacccctaactcctagactctacgatgacataccgtaatttgggacgtacggtacggggtccctagtacccggtaaggtctaaggtcggtaagtggaacgttcgtagggtaaacctacgttacttttttaaccctactaccctaagttccgaacgggtcccggtacccgttaggacccgtacggtacccgttaagggttaaacgtttacgttttacggaccctaaaatttacgtttaaactttaaccggtttacggtaaaccttaaaaccgtaaattaacgttaaaccgggtaaacgttaccccgtttaccccccttacccccgttaaccggttaaacccccgggttttgggggaaaccccgggggtaaacccgggggtttaaacccggaaaggggggtttaacggaaaccggggtaaacgttaccgggaaacccggttaacgggttaaccggttaacggggtaccggttaaccgttaccggaccttaaccccgtaaccggtttaacttttcccggg

SEQ ID NO: 404749 - DNA, 730 bp, Homo sapiens
  misc_feature: GZ8MTXP01B47PW.52.23.C01.1.454.CMB.2.raw
  modified_base (233)..(233): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtcctccactccctcctgtctgcatctagtaggagacagacgtcctaccttcgacgttcggccgggngacgtacaaggactaattagacctaattaatttaaagtggatcgagtacaaagaaaccggaagggaaacctaccccgttaaactccgtagaactccgtacgatacgtacgaacttacccgtaaagtttacgggaacgtaaccggtaaccggggttccccctaaaggttaccccgtaaaacgggtttccaaggttagggaacggttaaggtaacgtccggttacgggtaacttaaacctttctttttaaccgtacccaccgtactacccgtagtcccggtacctcggtaccgtacgtaccgttaagtaagttacgttttacgactaaaccttaattaacctttacgtaacgtaacctaaactaaagttagtaacgtaaccgttaccttcccctaccccgttacgtacccggtttacgggcgggtaaacgggacgttaaagggtcgacgtaactacgagttacgacggttgcgtaagctacgacgtaattcgttaaccg

SEQ ID NO: 404750 - DNA, 493 bp, Homo sapiens
  misc_feature: GZ8MTXP02HULHX.52.23.C01.1.454.CMB.2.raw
  modified_base (222)..(222): a, c, t, g, unknown or other
  modified_base (427)..(427): a, c, t, g, unknown or other
  modified_base (437)..(437): a, c, t, g, unknown or other
tcagcgcagtacgacacgaccggtgctcgatttagtacacgtgattagggattggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcacctttcacttgccgggnagtcaggacattagcaactattaaatggtatcagcagaaaccagggaaagcccctaaaatcctgatctacgatgcatccaatttggagacaggggtcccatccaaaggttcactggaagtggatctgggacacattttacttcaccatcagcggcctgcagcctgaagattttgcaacatatttactgttacaaacaatatgaanatctcccctnactttcggcgtagggaccaaggtcgagatcgagacgaactgtggctgcaccatctc

SEQ ID NO: 404751 - DNA, 517 bp, Homo sapiens
  misc_feature: GZ8MTXP02JNB62.52.23.C01.1.454.CMB.2.raw
tcagcgcagtacgacacgaccggtgctcgatttagtacacgtgattagggattgggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacattagcaactattaaatggtatcagcagaaaccaggaagcccctaaatcctgatctacgatgcatccaatttggagacaggggtcccatccaaggttcactggaagtggatcgtgggacactatttactttcacctatcagtcggcctgcagcctgaagtattttgacaactatatttactagttacaactaatatagaaagtaactctcccccttacaccgtttcggccggtagggacccaagggtcggagactacgagacgaacgtgtggctcggacaccatctcg

SEQ ID NO: 404752 - DNA, 498 bp, Homo sapiens
  misc_feature: GZ8MTXP02IK30W.52.23.C01.1.454.CMB.2.raw
  modified_base (211)..(211): a, c, t, g, unknown or other
  modified_base (432)..(432): a, c, t, g, unknown or other
tcagcgcagtacgacacgaccggtgctcgatttagtacacgtgattagggattggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtcaccttnacttgccgggcgagtcaggacattagcaactattaaattggtatcagcagaaaccaggaagcccctaaatcctgatctacgatgcatccaatttgagacaggggtccatccaaggttcactggaagtggatcgtgggacactattttacttcaccatcagcggcctgcagcctgaagtatttgcaacatattactgtcaacataatgaagatctacccctnactttcggcgtacgggaccaagggtgagatcaagacgaaactgtcggcttcgacacccaatccttg

SEQ ID NO: 404753 - DNA, 509 bp, Homo sapiens
  misc_feature: GZ8MTXP02JN80K.52.23.C01.1.454.CMB.2.raw
  modified_base (224)..(224): a, c, t, g, unknown or other
  modified_base (277)..(277): a, c, t, g, unknown or other
  modified_base (289)..(289): a, c, t, g, unknown or other
  modified_base (315)..(315): a, c, t, g, unknown or other
  modified_base (399)..(399): a, c, t, g, unknown or other
  modified_base (404)..(404): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacgttggccgggnagtcaggactattagcaactattaaatggtatcagcaagaaaccagggaaacncccctaaatccngatctacgatgcatccaaatttgganacgaggggtcccatcctaaggttcactgggaatggatcgtgggactactatttacttcacctatcagcgcctgcagctgaagtntttanacatatatactatacatatatagatactcctcctactacgtacgacggacggacgagtacgagacgacgacgacgacgtaagtcgtacgtcgacactactactcg

SEQ ID NO: 404754 - DNA, 485 bp, Homo sapiens
  misc_feature: GZ8MTXP02JYHUJ.52.23.C01.1.454.CMB.2.raw
  modified_base (307)..(307): a, c, t, g, unknown or other
  modified_base (401)..(401): a, c, t, g, unknown or other
  modified_base (403)..(403): a, c, t, g, unknown or other
  modified_base (415)..(415): a, c, t, g, unknown or other
  modified_base (454)..(454): a, c, t, g, unknown or other
  modified_base (473)..(473): a, c, t, g, unknown or other
  modified_base (485)..(485): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttgccgggcagtcaggacattagcaactattaaatggtatcagcagaaaccaggaaagcccctaaatcctgatctacgatgcatccaatttgganacaggggtcccatccaaggttcactggaagtggatcgtgggacactatttacttcacatcagcggctgcagctgagtatttgcaacatatactntnaacatatagaanatctcccctgtactttcggccggaggaccaaggtggagntacgagacgaatgcggtcncgacactatctn

SEQ ID NO: 404755 - DNA, 545 bp, Homo sapiens
  misc_feature: GZ8MTXP02IAZUQ.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactattaaatggtatcagcaagaaaccgagggaaacgaccccctaaatccctagatctacgaatgcatccaatttggagacgaggggtccatccaaggttcacgtaggaagtggatcgtgggactacgtattttacttcactatcagcgcctgcagcctagaagtatttgactaactattatttactagttaccaaataatatagaagtactcctcccccttataccgtttcggacggaggaccgaagggtcgaagtactacgacgacgtaacgtggttacgcgttacgacctactacttcgttcg

SEQ ID NO: 404756 - DNA, 525 bp, Homo sapiens
  misc_feature: GZ8MTXP02JY1FN.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacattagcaactatttaaattggtatcagcagaaaccagggaaagcccctaaactcctgatctacgatgcatccaaatttggagacgaggggtcccatccaaggttcactggaagtggatctgggacactatttacttcaccatcagcgctgcagcctgaagtatttgactaactattattactgtactaaacaataatagaagtactcctaccccctctaccgtttcgggacggtacgggaccaagggtacggagtacaccgagaaccgagtaagcggctcgacactactcttcg

SEQ ID NO: 404757 - DNA, 533 bp, Homo sapiens
  misc_feature: GZ8MTXP02JDHY4.52.23.C01.1.454.CMB.2.raw
  modified_base (211)..(211): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttnacttgccgggcagtcaggacattagcaactattaaatggtatcagcagaaaccagggaaacgaccccctaaatcctgactctacgatgcatccaatttggagacgaggggtcccatccaaggttcactggaagtgatcgtgggacacgtatttacttcacctatcagtcggctgcagcctgaagtatttgacaactatattactagtacaactaatatagaatactcctcccctctacgttcggacggtacgggaccaggtacggagagtaccgaaggaacgaacgtggtacggtacgtacggacctacccgtatacgttcg

SEQ ID NO: 404758 - DNA, 515 bp, Homo sapiens
  misc_feature: GZ8MTXP02JX3A9.52.23.C01.1.454.CMB.2.raw
  modified_base (422)..(422): a, c, t, g, unknown or other
  modified_base (429)..(429): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttgccgggcagtcaggacattagcaactatttaaatggtatcagcagaaaccagggaaacgacccctaaactcctgactctacgatgcatccaatttggagacgaggggtcccatccaaggttcactggaagtggatcgtgggactactatttacttcaccatcagcggcctgcagcctagaagtatttgcaactatattactgtacaanaattaanagaatactacctccctacgtaccgttcggacggacggacgaggtacgagacacgacgacgacgtgtcgactcgaccactactctcg

SEQ ID NO: 404759 - DNA, 565 bp, Homo sapiens
  misc_feature: GZ8MTXP02HKERY.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactattaaatggtatcagcagaaaccagggaaacgcccctaaactcctgatctacgatgcatccaatttggagacgaggggtcccatccaagttcacgtggaagtgatcgtgggactactatttacttcacatcagcgctgcagctgaagtatttgactaactatattactagttacaaactaaatatagaagtactaccttccccctactaaccgtttcgggaccggtaacgggaacccgaaggggttacgggaacggtaacgtaccgaacgtaaccggaaaccgttcggtaggtcgtacggaccgaccgtacttaccgtttccg

SEQ ID NO: 404760 - DNA, 567 bp, Homo sapiens
  misc_feature: GZ8MTXP02GHWB3.52.23.C01.1.454.CMB.2.raw
  modified_base (286)..(286): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtccaccttcacgttggccgggcgagtcgaggactattagactaacttatttaaattggtatcagcaagaaaccgagggaaacncccctaaatcctagactctacgatgcatccaatttggagacgacggggtcccatcctaaggttcacgtaggaagtggatcgtagggactacgtattttacttcactatacagccgctgcagcctagaagtatttgactaactattattactagttacaaactaaatataagaactacttacctaccccctacgtaccgtttacgggacggtaacgggaaccgtaagggtcggaagtactacgaacgacgtaacgtggtacggactgaccacgactcttacg

SEQ ID NO: 404761 - DNA, 558 bp, Homo sapiens
  misc_feature: GZ8MTXP02GFK52.52.23.C01.1.454.CMB.2.raw
  modified_base (197)..(197): a, c, t, g, unknown or other
  modified_base (445)..(445): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgcagganacagagtcaccttcacttgccgggcagtcaggacattagcaactatttaaatggtatcagcaagaaaccagggaaacgcccctaaactcctagatctacgatgcatccaatttggagacgaggggtccatcgaagttcacgtggaacgttggatcgtaggggacacttattttactttcacctatcagcgctgcagcctagaacgtatttgactaaactatattactagtacaaactaatataggaanacttcctacccctataccgtttcggacgggacgggaaccgtaagggtcggaagtacgtacgaaggtaaccggaaacgttggttacgggcttacggacctaacccgtatttccg

SEQ ID NO: 404762 - DNA, 639 bp, Homo sapiens
  misc_feature: GZ8MTXP02IDHCE.52.23.C01.1.454.CMB.2.raw
  modified_base (210)..(210): a, c, t, g, unknown or other
  modified_base (238)..(238): a, c, t, g, unknown or other
  modified_base (259)..(259): a, c, t, g, unknown or other
  modified_base (302)..(303): a, c, t, g, unknown or other
tcagcgcagtacgacacgaccggtgctcgatttagtacacgtgattagggattgggggagtcagtccaaccaggacacagcatggacatgagggtccctgctcagctcctggggctcctgctgctctggctctcaggtgccagatgtgacatccagatgacccagtctccatccctccctgtctgcatctgtaggagacagatcaccttnacttgccggcagtcaggactatttaganaactattaaattggtatcagnagaaaccaggaaggacccctaaacctaccctgatcttaccaannacactactagttagagacgacggtacactaccgtagtactacgtaggtaggtaggtagtcgtacggtactacttactttactttactactactacgtacgccgccgtcgcacgtacgtacgtaacgttactttacgtactaactaattaacttaacttacgttactaaactaacgtaacgtaacgtaacgtaccttacccttaccccgttaccgttaccggttaccgggtaccgggtaaccgggtaaccgggtaacgggtacggtaacggtacgtacgtaacgtaacgtaacgtaacggtacggtacgtaccgtaccgtacctacgttacgttacg

SEQ ID NO: 404763 - DNA, 541 bp, Homo sapiens
  misc_feature: GZ8MTXP02H0NYS.52.23.C01.1.454.CMB.2.raw
  modified_base (312)..(312): a, c, t, g, unknown or other
  modified_base (379)..(379): a, c, t, g, unknown or other
tcagcgcagtacgacacgaccggtgctcgatttagtacacgtgattagggattggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactattaaattggtatcagcagaaaccagggaaagcccctaaatcctgatctacgaatgcatccaaatttgganacaggggtccatccaaggttcactggaatggatctgggacacattttactttcaccatcagcggccngcagctagaagtatttgacaactaattattactatacaaactaatagtagaagtactacctaccctacctaccgttacggtacgggaacgggaacggaagggtacggaggacgtacgaacgtaacgaacgtaaggtacggtacgtcgacgacctactactcg

SEQ ID NO: 404764 - DNA, 526 bp, Homo sapiens
  misc_feature: GZ8MTXP02JV19U.52.23.C01.1.454.CMB.2.raw
  modified_base (401)..(401): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacattagcaactatttaaatggtatcagcagaaaccagggaagcccctaaatcctgatctacgatgcatccaatttggagacaggggtcccatccaaggttcactggaagtggaatcgtagggacactatttacttcaccatcagcggctgcagcctgaagtatttgctaanatattactgtacaactaatatagaaatactacctcccctctacgtttacggacggtacgggaccgaaagggttcggaagtataccgaggaacgaaacgtgtggactaggacctaccacttcttcg

SEQ ID NO: 404765 - DNA, 535 bp, Homo sapiens
  misc_feature: GZ8MTXP02HZMR3.52.23.C01.1.454.CMB.2.raw
  modified_base (219)..(219): a, c, t, g, unknown or other
  modified_base (394)..(394): a, c, t, g, unknown or other
tcagcgcagtacgacacgaccggtgctcgatttagtacacgtgattagggattggggagtcagtcccaaccaggacacagcatggacatgagggtccctgctcagctcctggggctcctgctgctctggctctcaggtgccagatgtgacatccagatgacccagtctcatcctcctgtctgcatctgtaggagacagagtcaccttcacttgccgggnagtcaggacattagcaactattaaatggtatcagcagaaacaggaaagcccctaaatcctgatctacgatgcatcaatttgagaacgaggggtccatccaaggttcactggaatggatctgggacactatttacttcaacctatcagcggcctgcagcctgaagtatttgcaacntattactgttacaaactaatatgaaacatcctacccctactacgtttcggacggtagggaccctaaaggggtacgaaggtactacgaacggaaccgaaagtggttaacgggcttacggaccaaccctaagttccctttcgg

SEQ ID NO: 404766 - DNA, 532 bp, Homo sapiens
  misc_feature: GZ8MTXP02H8WNN.52.23.C01.1.454.CMB.2.raw
  modified_base (274)..(274): a, c, t, g, unknown or other
  modified_base (457)..(457): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacattagcaactattaaattggtatcagcaagaaaccaggaaacncccctaaatcctgatctacgatgcatactaagtttggagacgacggggtcccatacccgaagttcacgtaggaagtggatcgtagggactacgtattttacttcacatcagcggctgcagtcctagaagtactttgactaactatattactgtacaaactaatatagaatactccctcccctntacgtttcgggacggtaacgggacctaagggtgaagactacgaacgacgaactgtacgctacgcaccgattctcg

SEQ ID NO: 404767 - DNA, 506 bp, Homo sapiens
  misc_feature: GZ8MTXP02GJZLR.52.23.C01.1.454.CMB.2.raw
  modified_base (222)..(222): a, c, t, g, unknown or other
  modified_base (416)..(416): a, c, t, g, unknown or other
  modified_base (426)..(426): a, c, t, g, unknown or other
  modified_base (437)..(437): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggngagtcaggacattagcaactatttaaatggtatcagcagaaaccaggaaagacccctaaactcctgatctacgatgcatccaatttggagacaggggtcccatccaaggttcactggaagtggatctgggacactatttacttcacatcagtcggctgcagcctgaagtatttgacaacatattactgtacaanaatatagaanatcctcccctnaccgtttcggacggtagggaccaaaggtcgagatcgaagacaaagtgtggactgacacgtactctttcg

SEQ ID NO: 404768 - DNA, 503 bp, Homo sapiens
  misc_feature: GZ8MTXP02HJ9WI.52.23.C01.1.454.CMB.2.raw
  modified_base (211)..(211): a, c, t, g, unknown or other
  modified_base (272)..(272): a, c, t, g, unknown or other
  modified_base (385)..(385): a, c, t, g, unknown or other
  modified_base (390)..(390): a, c, t, g, unknown or other
  modified_base (398)..(398): a, c, t, g, unknown or other
  modified_base (407)..(407): a, c, t, g, unknown or other
  modified_base (424)..(424): a, c, t, g, unknown or other
  modified_base (436)..(436): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttnacttgccgggcagtcaggacattagcaactattaaatggtatcagcagaaaccagggaacncccctaaatcctgatctacgatgcatccaaatttggagacaggggtcccatccaaggttcacgtggaagtggatcgtgggacactatttacttcacatcagcgcctgcagctnaagtnttgctaanatattacgntacaactaatatagaanatcctccccgtntacgtttcggacggacggaccgaaggtcgaagactcgagaccaagtggtgctcgacaacctctctcg

SEQ ID NO: 404769 - DNA, 515 bp, Homo sapiens
  misc_feature: GZ8MTXP02GDSAP.52.23.C01.1.454.CMB.2.raw
  modified_base (273)..(273): a, c, t, g, unknown or other
  modified_base (309)..(309): a, c, t, g, unknown or other
  modified_base (412)..(412): a, c, t, g, unknown or other
  modified_base (424)..(424): a, c, t, g, unknown or other
  modified_base (430)..(430): a, c, t, g, unknown or other
  modified_base (443)..(443): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactattaaattggtatcagcagaaaccaggaaancccctaaatcctgatctacgatgcatccaattgganacgaggggtccatccaagttcactggaagtgatcgtgggactacgtattttacttcaaccatcagcggctgcagcctgaagtatttgacaactattattactntacaactaatanacgaanactcctacccctntacgtttcggacggtacgggaccaagggtcgagactacgaagacgaaactggtgactcgactacactctacg

SEQ ID NO: 404770 - DNA, 553 bp, Homo sapiens
  misc_feature: GZ8MTXP02I28WP.52.23.C01.1.454.CMB.2.raw
  modified_base (437)..(437): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcacctttcacttgccgggcagtcaggacattagcaactatttaaattggtatcagcagaaacccagggaaacgcccctaaaactccctagactctacgatgcatcctaatttggagacaggggtcccatccaaggttcacgtggagtggatcgtgggactacgtattttacttcactatcagtcgctgacagcctagaagtattttacgactaactataatttactacgttanaactaatatagaagtactcctacccccttctaacgtttcgggacggtaacgggaccgaaaggtcggaagataccgaagacggaactggtaggctacggacacccaattcgtttccg

SEQ ID NO: 404771 - DNA, 488 bp, Homo sapiens
  misc_feature: GZ8MTXP02FN9H6.52.23.C01.1.454.CMB.2.raw
  modified_base (273)..(273): a, c, t, g, unknown or other
  modified_base (388)..(388): a, c, t, g, unknown or other
  modified_base (397)..(397): a, c, t, g, unknown or other
  modified_base (411)..(411): a, c, t, g, unknown or other
  modified_base (424)..(424): a, c, t, g, unknown or other
  modified_base (434)..(434): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttgccgggcgagtcaggacattagcaactattaaattggtatcagcagaaaccagggaaancccctaaactcctgatctacgatgcatccaatttggagacaggggtcccatccaaggttcactggaagtggatcgtgggacactattttacttcacctatcagcggctgcagctnagatttganaacatatactgtanaacaatatagaanatctcccctnacgtttcgcgacggacaggtgagactcgagagactgtacgctcgcacactctag

SEQ ID NO: 404772 - DNA, 602 bp, Homo sapiens
  misc_feature: GZ8MTXP02GKKAV.52.23.C01.1.454.CMB.2.raw
  modified_base (197)..(197): a, c, t, g, unknown or other
  modified_base (223)..(223): a, c, t, g, unknown or other
  modified_base (461)..(461): a, c, t, g, unknown or other
tcagcgcagtacgacacgaccggtgctcgatttagtacacgtgattagggattgggggagtcagtcccaaccaggacacagcatggatatgagggtccctgctcagctcctggggctcctgctgctctggctctcgggtgccagatgtgacatccagatgacccagtctccatcctccctgtctgcatctgtagganacagagtcaccttcacttggccgggnagtcaggacattagcaacttatttaaatggtatcagacaagaaaccaagggaaacgacccctaaaactcctagactctacgatcgacataccaagtttgggaagacgaggggtcccatacgaacggttcacgtggaaagtggactcgtggggactacgtattttacttcacatcagcggtcctgcagccctagaacgttattttacgactaaactattaattacctagtacctaaaanaattaatagaaagtctacccttcccctacttacggtttaccgggacggggaacgggtaaccgaaggggttagaacgaacgtacgaacgaacgtaacgtaggtcggacttacggacctaccgtactaccgtttacgtttccc

SEQ ID NO: 404773 - DNA, 555 bp, Homo sapiens
  misc_feature: GZ8MTXP02GCRJN.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacatagcaactattaaattggtatcagcagaaaccagggaaacgacccctaaactcctgatctacgatgcatccaatttggagacgacggggtccataccgaggttcacgtaggaagtggatcgtgggactactatttacttcacatcagcgctgcagcctgaatatttagactaactattattactgtacaaactaatatagaagtactccctacccccttctaccgtttcgggaccgggtaacggggaaccgtaagggtaggaacgacgtacgaacggaacgtaacgtaacggtcggacgttacggaccaccgtatcgtttacg

SEQ ID NO: 404774 - DNA, 553 bp, Homo sapiens
  misc_feature: GZ8MTXP02FY33D.52.23.C01.1.454.CMB.2.raw
  modified_base (276)..(276): a, c, t, g, unknown or other
  modified_base (415)..(415): a, c, t, g, unknown or other
  modified_base (441)..(441): a, c, t, g, unknown or other
  modified_base (515)..(515): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactattaaattggtatcagcagaaaaccagggaaacncccctaaactcctagatctaacgatgactataccaatttggagacgaggggtcccatccaaggttcaactggaagtggatcgtgggactacgtatttacttcacctatcagcgctgcagcctagaagtatttgactaanatattatagtacaactaatatagaanactccttcccctataaccgtttcggacgggaacggaccgaaagggtcggaaagacgtacgaacgacgtaaccgnggttacggcttacggacctaaccgtacgttcgtttccg

SEQ ID NO: 404775 - DNA, 589 bp, Homo sapiens
  misc_feature: GZ8MTXP02IWAJR.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacattagcaactattaaatggtatcagcaagaaaccagggaaacgacccctaaatcctagactctaacgatgcatcctaatttggagacgaggggtcccatccaagttcacgtaggaatggatcgtggacactatttcttcactatcagtcgctgcagctagaagtatttacactaatataattactagttaaccaaataattaatagtaactacttacccttaccccctctaaaccgtttcgggaccgggtaaacgggacccgtaaaggggttacggtaaacgtaagtaccgaaaaggaaccgtaaaaggtttccggtaacgggcttacggaccgtaaccgtaacgttcgtttaacccg

SEQ ID NO: 404776 - DNA, 491 bp, Homo sapiens
  misc_feature: GZ8MTXP02HRWDS.52.23.C01.1.454.CMB.2.raw
  modified_base (308)..(308): a, c, t, g, unknown or other
  modified_base (398)..(398): a, c, t, g, unknown or other
  modified_base (403)..(403): a, c, t, g, unknown or other
  modified_base (412)..(412): a, c, t, g, unknown or other
  modified_base (418)..(418): a, c, t, g, unknown or other
  modified_base (427)..(427): a, c, t, g, unknown or other
  modified_base (466)..(466): a, c, t, g, unknown or other
  modified_base (482)..(482): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactattaaatggtatcagcagaaacaggaaagcccctaaatcctgatctacgatgcatccaatttgganacgaggggtcccatacccaaggttcactggaagtggatctgggactacattttacttcaccatcagcggcctgcagcctgaagtatttancaaanatacttatntacaanaatataganatctccctacctacttcgacgacggaccgagagagacanacgagacaagtgcgcncacactctc

SEQ ID NO: 404777 - DNA, 586 bp, Homo sapiens
  misc_feature: GZ8MTXP02IH6D0.52.23.C01.1.454.CMB.2.raw
  modified_base (211)..(211): a, c, t, g, unknown or other
  modified_base (280)..(280): a, c, t, g, unknown or other
  modified_base (438)..(438): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtctaccttnacttggccgggcgagtcaggacattagacaacttaattaaatggtatcagacaagaaaccagggaaacncccctaaatccctagtactactacgatgacatacctaatttggaagacgacggggtcccataccgtaaacggttcacgtaggaagtggatcgtagggactacttacttttacctttcaactactctacgacgctacgctacgcctagtaatagtttanactaactattaacttatacttacaaactaataatagaactactcctacccttctacgttcggtacggacgggacctaaagggacggtagaatacgaaacggtacgtaaacgtcggtacggtactacggacctaccgtactcgtttacg

SEQ ID NO: 404778 - DNA, 610 bp, Homo sapiens
  misc_feature: GZ8MTXP02GYABB.52.23.C01.1.454.CMB.2.raw
  modified_base (270)..(270): a, c, t, g, unknown or other
  modified_base (272)..(273): a, c, t, g, unknown or other
  modified_base (277)..(277): a, c, t, g, unknown or other
  modified_base (306)..(306): a, c, t, g, unknown or other
tcagcgcagtacgacacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaatgtatcagcagaacgagaccactacncnntcantcatctactagtgacgacggtccgactanacgtacgtaccctaggtaggtaggtagtactcgggtacgtactacttttactttacctacctaacttacgacgtccgggccgtcacggacacgtacggtaagtaattttccgtaaacaacttaattattaacgttataactaaactaagttaatacgtaacgtacctccccttaccccttaccgttacgttacggggtaccgggaacgggtaaacggtaaggtacgggagtaactacgtaacggaaacggtacgtacggttcggacgtaaccgtacgaacctacgttctacgtttacctactac

SEQ ID NO: 404779 - DNA, 564 bp, Homo sapiens
  misc_feature: GZ8MTXP02JAJ7T.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacattagcaactatttaaatggtatcagcagaaaccagggaaacgcccctaaactcctgatctacgatgcatcctaatttggagacaggggtcccatccaaggtcacgtaggagtggatcgtgggactactatttacttcacatcagcggctgcagctgaagtatttgacaactattattactgttacaaactaataatagaaagtactcccttaccccctctacgtttccggggacgggtaacggggaacccgtaaagggtacgggaagtaacgttccgaaaggaccgtaaacgttggtacgggcttacggacctaccctagttaccctttcgg

SEQ ID NO: 404780 - DNA, 558 bp, Homo sapiens
  misc_feature: GZ8MTXP02G064U.52.23.C01.1.454.CMB.2.raw
  modified_base (442)..(442): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagagacagagtcaccttcacttgccgggcagtcaggacattagcaacttatttaaattggtatcagcaagaaaccagggaaacgacccctaaaactcctagactactacgatgacatccaatttggagacgaggggtccccagtccgtaaggttcaacgtggaagtggatcgtagggactactattttacttcacatcagcgctgcagcctgaagtatttgactaactatattactagtacaactaatanagaagtactcctccccctactaccgtttcgggacggtaacgggaccgtaagggtacggagtacgtacgaacggtaacgtaaacgtggtcggtcgtacgactacccagttacgttcg

SEQ ID NO: 404781 - DNA, 580 bp, Homo sapiens
  misc_feature: GZ8MTXP02IF09G.52.23.C01.1.454.CMB.2.raw
  modified_base (197)..(197): a, c, t, g, unknown or other
  modified_base (532)..(532): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctcctgtctgcatctgtagganacagagtcaccttcacttggccgggcagtcaggactatagacaacttattaaattggatacagacaagaaaccgagggaaacgacccctaaactcctagactctacgatgacatacctaagtttaggacgacgtacggggtccagtaccgtaacgttccaagtaggaaggtagtgtcgtagggactacttatttacttacactactacacggtccggcctgactacgacgtagtaatagtttcataactaattacgttactctaacaaactactaatagaaactactccctcccgtactacggttcgacggtaacgggaccgaaaggtcggaaanacgtacgacgacgtacgtcggtacgtctacgaccactacgtcgttacg

SEQ ID NO: 404782 - DNA, 554 bp, Homo sapiens
  misc_feature: GZ8MTXP02F3IRP.52.23.C01.1.454.CMB.2.raw
  modified_base (197)..(197): a, c, t, g, unknown or other
  modified_base (277)..(277): a, c, t, g, unknown or other
  modified_base (317)..(317): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcagtcaggacattagacaactatttaaattggtatcagcaagaaaccagggaaacncccctaaactcctagactctacgatgacataccattgganacgagggtccatccaaggttcacgtggaagtggatcgtagggacattactttactcacatcgagcgactgcagtcctagaagtatttcgactaactattacttactacgttacaataaatataagaactactaccttacccctacgtaccgtttccgggacggtacgggaaccgtaagggtaggacgactacgacgaacgtaacgtggtacggacacggacctacgactccgtttcg

SEQ ID NO: 404783 - DNA, 706 bp, Homo sapiens
  misc_feature: GZ8MTXP02FE36W.52.23.C01.1.454.CMB.2.raw
  modified_base (196)..(196): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagganacaggatcaccttcacgttgccgggcagtcaggactatagcaatattaaattgatcagcagaaacaggaacaccctaaactcctgatctacgatgcactaccaatttaggacggacaggggtaccccagtacccgtaaaggtttcgaacgttgggaaaggttgggatttccgtacgggggaaactaaccttaactttttaaccttttaccgtaacccaacttacccgaaacggtcccgggacccttacgggtctaacgacccgtacgggtaaacgttaacgtttttaacgtaacgtaaacgttaaacttaacttaacttaacgtaactaaactaaacgtaacgtaacgtaacgtaaccttacccgttaccccgttaccgttaccggtttaccgggtaaccggggtaaaccgggtaaaccggtaacgggtaacgggtaacgtaacgtacgtaacggtaaccgtaacgtaacggtacggtaccgtacgtaccgtaccgtacgttacgttacg

SEQ ID NO: 404784 - DNA, 527 bp, Homo sapiens
  misc_feature: GZ8MTXP02H18BE.52.23.C01.1.454.CMB.2.raw
  modified_base (197)..(197): a, c, t, g, unknown or other
  modified_base (440)..(440): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcgagtcaggacattagcaacttatttaaattggtatcagacagaaaccagggaaacgcccctaaaactcctagactctacgatgcatccaattttggagacaggggtcccatccgaagttcacgtaggaagtggatcgtggactactatttacttcacatcagcggctgcagtcctagaacgtatttagactaactattattactgttacaactaatanagaagacttcctccccttacacgtttcgggacggacggaaccgtaagggtagacgatacacgagaactgtaggctgcacctatctcg

SEQ ID NO: 404785 - DNA, 586 bp, Homo sapiens
  misc_feature: GZ8MTXP02IIJFB.52.23.C01.1.454.CMB.2.raw
  modified_base (197)..(197): a, c, t, g, unknown or other
  modified_base (433)..(433): a, c, t, g, unknown or other
  modified_base (522)..(522): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttggccgggtcgagtcaggacattagcaactatttaaatggtatcagcaagaaaccaggaacgacccctaaactcctagatctaacgatgacataccaatttggacgacgaggggtacccataccgtaaacggttccacgtaggaacgtggatccgtagggaactacttacttttacttacaacctatacgagcggcctacggcagtcctaggtaaattntttacgactaatattaattactatacaaataatatagaatactaccttacccctctaacggttcggacgggtacgggaaccgtaagggngtaacggaatccgaaaggtaccgtaaacgtggtacggtctacggacctaacctactactttccg

SEQ ID NO: 404786 - DNA, 541 bp, Homo sapiens
  misc_feature: GZ8MTXP02F0XPH.52.23.C01.1.454.CMB.2.raw
  modified_base (222)..(222): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtcctccatcctcctgtctgcatctgtaggagacagagtcaccttcacttgccgggngagtcaggacattagctaactatttaaattggtatcagcagaaaccaggaaacgcccctaaatcctgatctacgatgcatccaagtttggagacaggggtccccatcctaaggttcacgtaggaagtggatcgtgggactactattttacttcacctatcagtcgcctgcagcctagaagtatttgactaactataattactgtacaaactaataatagaaatactacctccccctcgaccgtttcggacggaacggaccgaagggtcggagagtacgacgaacgtaactgttcggcttacggcctaacctattcttcg

SEQ ID NO: 404787 - DNA, 530 bp, Homo sapiens
  misc_feature: GZ8MTXP02F2RVS.52.23.C01.1.454.CMB.2.raw
  modified_base (276)..(276): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagactaacttatttaatggtatcagcaagaaaccaggaacncccctaaactctgactctacgatgcataccaatttggagacgagggtacccagtccgaagttcacgtaggagtggatcgtaggactacttatttacttcacatcagcgctgcagctgaagtatttgactaactatattactgtacaactaatatagaagtactcctaccctactacgttcggacggtacggtacgaaggtacggagactacgacgacgaacgtgtacggtctacggacctacgtactcgttacg

SEQ ID NO: 404788 - DNA, 652 bp, Homo sapiens
  misc_feature: GZ8MTXP02HDMZK.52.23.C01.1.454.CMB.2.raw
  modified_base (268)..(268): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagacgtccaccttcacgttggccgggcgagtcgaggactattagactaactaatttaaatggtatcganacaagaaaccgaaggaaacgacccctaaactccctagactcctacgatcgacactacctaagtttaggacgacgacggggtacccagtaccgtaaggttcacgtaggtaaggtaggactcgtacggggtaactacgttattttaccttaccaacctatcgacgtccgtcctcgacagtacctagaagttactttcgacaacttattattactagttaacaaactaaagttactaggaaacttacctaccccttaccccgttacgttaccggtttacgggaccggggttaaacggaacccggtaaggggtaccggaaagtacgtaacgtaacggaaccgtaaggtcgggtacgtccgtacggacctaccgtacttccgtttaccg

SEQ ID NO: 404789 - DNA, 550 bp, Homo sapiens
  misc_feature: GZ8MTXP02JY6JV.52.23.C01.1.454.CMB.2.raw
  modified_base (197)..(197): a, c, t, g, unknown or other
  modified_base (393)..(393): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcagtcaggacattagcaactattaaatggtatcagcagaaaccaggaaagcccctaaatcctgatctacgatgcatccaatttggagacgaggggtcccatccaaggttcactaggaagtggatcgtgggacactatttacttcacctatcagcggcctgcagcctgaagtntttgactaacattattactgtacaacaatatagaagtaactcctaccccctctaaccgtttcgggaccggtaacggggacccgaaaggggttcgggaagacgtacgaacggtaacgaaaccgtggtacggcttacggacctacccattacgtttccg

SEQ ID NO: 404790 - DNA, 543 bp, Homo sapiens
  misc_feature: GZ8MTXP02F9V7B.52.23.C01.1.454.CMB.2.raw
  modified_base (280)..(280): a, c, t, g, unknown or other
  modified_base (318)..(318): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacattagacaacttatttaaattggtaatcagacaagaaaccagggaaacncccctaaatcctagatctacgatgcatccaatttgganacgagggtcccatccaaggttcacgtggagtgatcgtgggactagtatttacttacactatcagacggcctagcagcctagaagtatttgactaactattaacttactagtacaactaaagtataagaactactaccttccccctatacgtttcgggacggacggtaaccgaagggtacgagtacgtacgacgtacgaagtgtcggactcggacacgtactctcg

SEQ ID NO: 404791 - DNA, 509 bp, Homo sapiens
  misc_feature: GZ8MTXP02FNAQH.52.23.C01.1.454.CMB.2.raw
  modified_base (274)..(274): a, c, t, g, unknown or other
  modified_base (312)..(312): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactattaaattggtatcagcagaaaccagggaaancccctaaaatcctgatctacgatgcatccaatttgganacaggggtcccatccaaggttcactggaagtggatcgtgggacagattttacttcaccatcagcggcctgcagcctgaagatttgcaacatattactgtacaacaatatagaagatcctccccctatacctttcggcggaggacccgaaagggtcggaaggactcaaggacaaacgtgtaggctgccaccatcttcg

SEQ ID NO: 404792 - DNA, 581 bp, Homo sapiens
  misc_feature: GZ8MTXP02FQ2Z3.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactattaaattggtatcagcagaaaccagggaaacgcccctaaactcctgatctacgatgcatccaatttggagacaggggtccatcaagttcactggaagtggatcgtgggactactatttacttcacctatcagccggcctgcagcctagaagtattttgactaactattattactagtacaaactaatatagaaagtactccttaccccctactaccgtttcggggacgggtaacggggacccgtaaaggggttacgggaagtaacgttacgaaacggaaccgtaaaaccgtggtacgggtaccgttacggaccgtaacccgtaacgttactttaccgg

SEQ ID NO: 404793 - DNA, 570 bp, Homo sapiens
  misc_feature: GZ8MTXP02I4LLY.52.23.C01.1.454.CMB.2.raw
  modified_base (197)..(197): a, c, t, g, unknown or other
  modified_base (276)..(276): a, c, t, g, unknown or other
  modified_base (313)..(313): a, c, t, g, unknown or other
  modified_base (396)..(396): a, c, t, g, unknown or other
  modified_base (433)..(433): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttggccgggcgagtcaggacattagcaactatttaaatggtatcagcagaaaccagggaaacncccctaaatcctgatctacgatgcatccaatttgganacgaggggtccagtccaaggttcacgtggaagtggatcgtgggactagtatttacttcactatcagccgctgcacgctgaatntttagactaacattattactgtacaacatactagaanacttcctaccccctgtaaccgtttcgggacgggtaaacgggaccgtaaaaggggtcggaaacgtaacgttaccgaaggtaacccggtaaagtcgggttaccgggcttaccggacctaaacccgttacttcgtttacg

SEQ ID NO: 404794 - DNA, 568 bp, Homo sapiens
  misc_feature: GZ8MTXP02HCME4.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaacttattaaatggtatcagacagaaaccagggaaacgacccctaaatcctgatctaacgatgcatccaaatttggagacgaggggtcccataccaaggttcacgtaggaagtggatcgtagggactacgtattttacttcacctatcagcggcctgcagctgaagtatttcgactaactatattacagttacaaataataatagaataactccctacccccttcacctttacgggaccggtaacgggacccgtaaaggggtcgagaaacgtaccgaaggaacgtaaaccgtggtacgtacgttacgaccttaaccgactttacgttccg

SEQ ID NO: 404795 - DNA, 830 bp, Homo sapiens
  misc_feature: GZ8MTXP02I714L.52.23.C01.1.454.CMB.2.raw
  modified_base (223)..(223): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttggccgggngagtcaaggactattagactaactatttaaatggtatcagacaagaaaccagggaaacacccctaaaactcctagactactaacgatcgctaataccctaaagtttgggaacgtaaccgtacgggggtaccccaagttacccgtaaaacgggtttccaaccgttaggggtaaacggttagggtaacgttaccgggttacgggggtaaaccctaaaccgttttaaaccgtttttttaacccgtttttaccgaaaacccccgttatttacccgaaacgggtacccggggttcccgttacggggaccctaaacgggtcccctttaaacgggtaaacggtttaaattttttacgggaaacccttaaaacgttaaatttaaaccgttttaaaccgtttaacgttaaacctaaaaccttaaaactttaaaggtaaagtaaaacgtaacctttacccccgttaaccccccttaccgtttaaaacccggttttcccgggggaaccggggtaaaaccggggttaacccggaaaggggttaccgggaaagtacgtacgaaaacggtaccgtaaacgtggtacggacttaccggacaacccgtagttacgtttacccg

SEQ ID NO: 404796 - DNA, 613 bp, Homo sapiens
  misc_feature: GZ8MTXP02FLD77.52.23.C01.1.454.CMB.2.raw
  modified_base (196)..(196): a, c, t, g, unknown or other
  modified_base (223)..(223): a, c, t, g, unknown or other
  modified_base (564)..(564): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagganacagagtccaccttcacttggccgggngagtcaggactattagactaactaatttaaattggtatcagcaagaaaccagggaaacacccctaaactcctagactctacgatgcactacctaaagtttgggacgacgacggggtacccctaagtacccgtaaaggtttccgaacgtaggggtaaaggtggacttccggtaggggaacctacttaactttttacctttacaacctaatccgtaacggccggtccctagccagtcctagtaacgtattttcgaactaactaattacttactgttacaaactaatatagaaatctcccttacccctcgtaaccgtttcggggacggacggtaccgaaagggngtaacgactacgaaacgacgtaactggaggtcacgccacgactcgttcg

SEQ ID NO: 404797 - DNA, 614 bp, Homo sapiens
  misc_feature: GZ8MTXP02JH0W5.52.23.C01.1.454.CMB.2.raw
  modified_base (293)..(293): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagagacagagtcaccttcacttcggccgggcagtcaggactattagactaacttatttaaatggtatcagcaagaaaccgaggaaactacccctaaatccngactctacgatgctatacctaagtttggacgtacgacggggtaccctataccgtaaggttcacgtaggaagtggactcgtagggactacgttactttttacttactaacctactacgacgtccggtcctcgacacgtaccgtagtaagttagttttcgactaactactttacttacgtacgttaaccaaataaattatagaaactctacccttcccctacgtacgtttacgggaccgggtaacgggaccggtaagggtagtaacggaacttacgaaacgtaccgaagtggtacggtcgtacgaccaacctacgtcgtttcg

SEQ ID NO: 404798 - DNA, 534 bp, Homo sapiens
  misc_feature: GZ8MTXP02G5S24.52.23.C01.1.454.CMB.2.raw
  modified_base (401)..(401): a, c, t, g, unknown or other
  modified_base (410)..(410): a, c, t, g, unknown or other
  modified_base (419)..(419): a, c, t, g, unknown or other
  modified_base (432)..(432): a, c, t, g, unknown or other
  modified_base (490)..(490): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtccaccttcacttggccgggcgagtcaggactattagcaactatttaaatggtatcagcaagaaaccaggaaacgacccctaaactcctagatactacgatgacatacctaatttggagacgacggggtaccatccaaggttcacgtaggagtagatcgtgggactactatttacttacactactcagcgcctgacngctgtaatntttcgacanattattactgtanaactatatagatactcctcccctacgtacgttcggacggtacggaccgagggtcgganacgtacacggaccgtaatggtgcgtacgactacctagtctttcg

SEQ ID NO: 404799 - DNA, 576 bp, Homo sapiens
  misc_feature: GZ8MTXP02I07CK.52.23.C01.1.454.CMB.2.raw
  modified_base (197)..(197): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcagtcaggacattagctaactattaaattggtatcagacaagaaaccgagggaaacacccctaaactcctagaactctaacgatgacatacctaagtttggacgacgtacggggtacccatacccgaaaggttcacgtagggaagtggatcgtgggaactacttacttttacttcactatacacgtcggacctgacacgtactagaaattatttgactaactaattacttactagttacaaactaataatagaactacttacctccctactacgttcgggacgggtacggaccgaagggtagacgtaataccgaagtacggaactggacggactacgacctacctatcgtttacg

SEQ ID NO: 404800 - DNA, 574 bp, Homo sapiens
  misc_feature: GZ8MTXP02FM98J.52.23.C01.1.454.CMB.2.raw
  modified_base (198)..(198): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtagganacagagtccaccttcacttggccgggcgagtcaggactattagcaactatttaaattggtatcagcaagaaaccgagggaaacacccctaaactctagatctacgatgcatccaattggagacgaggggtcccatccaaggttcacgtagggaagtggtatcgtggggactattactttttaccttacaccaatcgagccgcctgcagctgaagtatttgactatatattacgtctactaaactaatatagaactactcccttacccctcgtacgtttcggggacggtaacggggaacccgtaaggggtaggaacgtactacggaacggaaccgtaacgtggtacggacgtacggtaccacgtactcgtttaccgg

SEQ ID NO: 404801 - DNA, 570 bp, Homo sapiens
  misc_feature: GZ8MTXP02IX24R.52.23.C01.1.454.CMB.2.raw
  modified_base (197)..(197): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcagtcaggacattagcaactattaaattggtatcagcaagaaaccagggaaacaccccctaaatcctgatctacgatgcatcccaagtttggagtacacggggtccatcccaaggttcataggagtggactgtgggactactattttacctttacactatcgtagccggtacctgctaacgcctagaacgttatttacgactaaatattatttaacctgtactaaaactaagttataacggaatacttcccttaccccccttagttaccgtttcgggacgggaacgggaccgtaaagggttcggaagtataccgacgtacgaacgtgacggctacgcactgtactttcg

SEQ ID NO: 404802 - DNA, 570 bp, Homo sapiens
  misc_feature: GZ8MTXP02JQY8Q.52.23.C01.1.454.CMB.2.raw
  modified_base (421)..(421): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaacgacccctaaactcctgactctacgatgcatccaatttggagacgaggggtccccataccgaaggttcactggaagtggatcgtgggacactatttacttcaccatcagcgctgcagcctgaacgtatttgacaacattattaactnttacaaacaattaatagaaacgtacttccctacccccttactaaccgttttccgggacgggtaaccgggacccgtaaaggggttacggagtaactacgaacggaaccgtaaacgtggtacggacttcggaccaaacctacgtcctttcg

SEQ ID NO: 404803 - DNA, 564 bp, Homo sapiens
  misc_feature: GZ8MTXP02JLMOS.52.23.C01.1.454.CMB.2.raw
  modified_base (224)..(224): a, c, t, g, unknown or other
  modified_base (276)..(276): a, c, t, g, unknown or other
  modified_base (409)..(409): a, c, t, g, unknown or other
  modified_base (414)..(414): a, c, t, g, unknown or other
  modified_base (416)..(416): a, c, t, g, unknown or other
  modified_base (432)..(432): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtccacctttcacttggccgggnagtcaaggactattagcaactatttaaatgtatcagcagaaaccagggaaancccctaaactcctagatctacgaatgcatcccaatttggaagtaccgacggggtccccagtaccccgtaagggttaccatagggaaggttggaatcgttcgggactacttactttactttcaacctataccgngcgcncncagctagtagttattnactaactatattatacgtacaaactataatagaactacttacctccctaccgtacgtacggtacggtacggacggaggtacggacgacgtacgacgtacgtacgtcggtcgtacgtcgactactactactcg

SEQ ID NO: 404804 - DNA, 660 bp, Homo sapiens
  misc_feature: GZ8MTXP02FUC4L.52.23.C01.1.454.CMB.2.raw
  modified_base (197)..(197): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggcgagtcaggactattagctaactattaaattggtatcagcagaaacaggaaacgacccctaaatcctgactctagatgacatccaagtttggagtacgacggggtacccagtccgtaaaggttccacgtagggaagtaggaacttcgtaggggaactacttaactttttacctttaccacctactaccgtacgtccggtccgtagccgacgtacccgtagtaaacgttaagtttttcgaactaaactaaacttactttaaactacgttaacctaaaactaaaattaagtaaagtaaacgtaactttccccttacccccctcgttaacccgtttccgggggaaccgggtaacggggtaaccgtaaaggggtacggaaaggacgtacgaaacgaacgtaaacgtaaggtcggacgtacgacctaacctacgtcgtttaccg

SEQ ID NO: 404805 - DNA, 498 bp, Homo sapiens
  misc_feature: GZ8MTXP02FFWRE.52.23.C01.1.454.CMB.2.raw
  modified_base (346)..(346): a, c, t, g, unknown or other
  modified_base (407)..(407): a, c, t, g, unknown or other
  modified_base (425)..(425): a, c, t, g, unknown or other
  modified_base (437)..(437): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacattagcaactattaaattggtatcagcagaaaccagggaaagcccctaaactcctgatctacgatgcatccaattggagacaggggtcccatccaaggttcactggaagtgatcngggacatatttacttcaccatcagcggctgcagcctgaagtatttgactaacatattactntacaaacaatatacgaanatcctcccctanactttcggacggacggaccgaaggtcgagatacaacgacgaactgtggctgcacactctcg

SEQ ID NO: 404806 - DNA, 602 bp, Homo sapiens
  misc_feature: GZ8MTXP02FNEEE.52.23.C01.1.454.CMB.2.raw
  modified_base (223)..(223): a, c, t, g, unknown or other
tcagcgcagtacgacacgaccggtgctcgatttagtacacgtgattagggattgggggagtcagtcccaaccaggacacagcatggacatgggggtccctgctcagctcctggggctcctgctgctctggctctcaggtgccagatgtgacatccagatgacccagtctccatcctccctgtctgcatctgtaggagacagagtcaccttcacttgcccgggngagtcgaggactattagactaacttaatttaaagttgtatacagacaacgaaaccgaaggaaacgacccctaaactcctagactactacgatcgactactactaagttggacgacgacgggtacctagtacgtaacgttactacgtaggagtggattcgtggactacttatttaccttacactatacacgtcgtcctgctacgctagtagtatttacgactaactattattacgtagtaacaaactaatagtaagtaacgtacttacccctccccttacgtaccgtttacgggacgggtaacgggaccgtaagggtagacgtacgtacgaacgaacgtaacgtggtaacgtacgtacgactaccgtactccgttcgtcc

SEQ ID NO: 404807 - DNA, 575 bp, Homo sapiens
  misc_feature: GZ8MTXP02GL7AP.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagactaatattaaatgtatcagcagaaacaggaaacgacccctaaactcctagtatcctagactgactataccctaatttggaagtacgaggggtcccaagtaccgtaacggttacacgtagggaaggtaggacttcggtcgggactaacgttacttttacttacaccctatacgacgcggtcctgcacgtaccaggtaatactttagacaactattactactactactaactaatatagaactacttcctacccctcgtaacgtttcggacggtaacgggaccgaagggtcggaagtacacgaacgaccgtaagtgtgacgtcgactacgactcttacg

SEQ ID NO: 404808 - DNA, 585 bp, Homo sapiens
  misc_feature: GZ8MTXP02G9G14.52.23.C01.1.454.CMB.2.raw
  modified_base (222)..(222): a, c, t, g, unknown or other
  modified_base (403)..(403): a, c, t, g, unknown or other
  modified_base (447)..(447): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggnagtcaggacattagacaacttattaaattggtatcagacaagaaaccaggaaacacccctaaatcctagactcgtacgatgactatacctaatttggagtaacgacggggtaccagtccgaagttcacgtaggaagtggatcgtggactactagttttactacactatcgagccgtctgcngtctagaattatttagacaaactatattactagtaccaaataanattaagaactacttcccctaccctacgtaccgtttcggggaccgtaacgggaccgtaaagggtacggaataaccgtagaaacgaacggtaaacgtaacggtcggtacggacgtaaccgaccgttaactactttcccgg

SEQ ID NO: 404809 - DNA, 554 bp, Homo sapiens
  misc_feature: GZ8MTXP02FV6SY.52.23.C01.1.454.CMB.2.raw
  modified_base (252)..(252): a, c, t, g, unknown or other
  modified_base (268)..(268): a, c, t, g, unknown or other
  modified_base (401)..(401): a, c, t, g, unknown or other
  modified_base (460)..(460): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttgccgggcagtcaggacattagcaactattaaatgtatnagcagaacagggaacncccctaaatcctgatctagatgcatccaatttggagacgacggggtcccatccaaggttcacgtggaagtggatcgtagggactactattttacttacacctatacgagcggacctgacagcctagtaaagtnttttacgactaactattacttactagtacaaactaatatagaatactccctaccccctntaaccgtttcgggacggaacgggaccgtaagggtcggaagtactaccgaagacgtaaacgtggtcggactacggacctaaccgtattcgtttcg

SEQ ID NO: 404810 - DNA, 588 bp, Homo sapiens
  misc_feature: GZ8MTXP02HC0B4.52.23.C01.1.454.CMB.2.raw
  modified_base (196)..(196): a, c, t, g, unknown or other
  modified_base (443)..(443): a, c, t, g, unknown or other
  modified_base (462)..(462): a, c, t, g, unknown or other
  modified_base (468)..(468): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagganacagacgtcaccttcacttggccgggcgagtcaggacattagcaactattaaatggtatcagcaagaaaccgaggaaacgacccctaaactcctagactctacgatcgacatacctaagtttggaacgacgtacggggtaccccagtaccgtaaacggttcaacgtaggggtaagttcgggaactcggtacgggactaacttatttttaccttacacctatcagtccggctgcagcctagaacgttntttgacctaatatattacncgttanaactaatactaagaactactacctcccctatacgttcgggaccgggtaacggaccgaagggtcgaagtacgtacgaacgaccgaacgttggacgcgtacgacctaccctagttacttccg

SEQ ID NO: 404811 - DNA, 552 bp, Homo sapiens
  misc_feature: GZ8MTXP02GKWJV.52.23.C01.1.454.CMB.2.raw
  modified_base (197)..(197): a, c, t, g, unknown or other
  modified_base (222)..(222): a, c, t, g, unknown or other
  modified_base (458)..(458): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttcacttgccgggnagtcaggacattagcaactattaaattggtatcagcaagaaaccagggaaacgcccctaaactcctgatctacgatgcatcctaatttggagacgaggggtccatcctaagttcacgtggaagtgatcgtgggactactatttacttacacctatcagcggctgcagtcctagaactagtttagactaaactattaattactagtactaaactaatatagaactactcctcccctntacgtttcgggacggtacggaaccgagggtacggaagactacgaacggtaacgtaaccgtgtacggactacggacctaccgtacgtactttccg

SEQ ID NO: 404812 - DNA, 508 bp, Homo sapiens
  misc_feature: GZ8MTXP02GTTMH.52.23.C01.1.454.CMB.2.raw
  modified_base (222)..(222): a, c, t, g, unknown or other
  modified_base (275)..(275): a, c, t, g, unknown or other
  modified_base (423)..(423): a, c, t, g, unknown or other
  modified_base (434)..(434): a, c, t, g, unknown or other
  modified_base (439)..(439): a, c, t, g, unknown or other
  modified_base (444)..(444): a, c, t, g, unknown or other
  modified_base (449)..(449): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctcctgtctgcatctgtaggagacagagtcaccttcacttgccgggnagtcaggacattagcaactattaaattggtatcagcaagaaaccagggaaacncccctaaatcctgatctacgatgcataccaatttggagacgaggggtcccatccgaaaggttcacgtggtaagtggaatcgtgggaactacttattttacttcacctatcagcggcctgcagctgaagtatttgacaacattatactntacaataatanagaanatccnccctnacgttcgacgacggacaggtgagatacacgacgtaagtgtacggctcgacaccatcttg

SEQ ID NO: 404813 - DNA, 617 bp, Homo sapiens
  misc_feature: GZ8MTXP02GWF3R.52.23.C01.1.454.CMB.2.raw
  modified_base (198)..(198): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtagganacagagtccaccttcacgttggccgggcgagtcaggacattagacaacttatttaaattggtatcagacaagaaaccgaagggaaacgacccctaaaactccctagtactacctaacgatcgactataccgtaagtttggacgtacgacggggtcccagtacccgaaggttcacgtggaagtggatcgtagggactacgttattttacttacactatcagcgactgacacgactagagttatttagactaactaattagttaactagtaactaaactaagttaatacggtaaactaccttacccctcccttacgttaccggtttacgggacgggtaaacgggtaaccggaaggttacggagtaacgttacgaacgaaccggtaagtggtacgtcgtacgaccacgtacgttctttaccg

SEQ ID NO: 404814 - DNA, 554 bp, Homo sapiens
  misc_feature: GZ8MTXP02GFD0L.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttgccgggcagtcaggacattagcaactattaaattggtatcagcagaaaccaggaaacgcccctaaatcctgactactacgatgcatccaatttggagacgaggggtcccagtccaaggttcacgtggaagtggatcgtagggactacgtattttacttcaccgtatcgacgtcggcctagctaacgctagtaagtactttgactaacattattactgttacaaactatatacgaatactcctacccctatacgtttcggacggtacggaccgaaggtcggagtactacgaacgtaacgtaacgtggtacggacgttacggaccaacctacgttactttcg

SEQ ID NO: 404815 - DNA, 608 bp, Homo sapiens
  misc_feature: GZ8MTXP02GDTYQ.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtccaccttcacttggccgggcgagtcaggactatagactaacttatttaaatggtatcagacaagaaaccgagggaaacgacccctaaactcctagactctacgatgacatacctaagtttggagacgaggggtacccagtaccgaagtcaacgtggaagtcggatcgtaggactacttattttaccttacacctatcgacgccggtcctgacacgtacctagtaagttacgtttcgacctaaactattaacttactagttaaccaactaaatactagtaactactaccctacccctacgtaccgttacgggacgggaacgggtaccgtaagggtacggaaacgtacgtaccgaacgtaacggtaacgtcggtacgaccgtacgacccaacgtacgtactttccg

SEQ ID NO: 404816 - DNA, 621 bp, Homo sapiens
  misc_feature: GZ8MTXP02GQ1JS.52.23.C01.1.454.CMB.2.raw
  modified_base (197)..(197): a, c, t, g, unknown or other
  modified_base (211)..(211): a, c, t, g, unknown or other
  modified_base (223)..(223): a, c, t, g, unknown or other
  modified_base (278)..(278): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtcaccttnacttggccgggnagtcaggactattagcaacttattaaattggtatcagcaagaaaccagggaaacncccctaaactccagtatctacgatgctatacctaaagtttggagacgtaggggtaccctagtaccgaaggtcacgtagggtaagtggaatccggtagggactaacgttactttttacttcaaaccgtatacaggtccggctggactacgacctacgtaaggttatttacgactaaacctattaactttaactacttaccaaactaaattagtaaggtaaagttaccttaccctacccccttataccgtttacgggacgggttaacgggacgtaaagggtcgggaaacgtagtacggaacgtaacgtaaacgtggtcggtactacgacctactacgttacgtac

SEQ ID NO: 404817 - DNA, 546 bp, Homo sapiens
  misc_feature: GZ8MTXP02IZRP2.52.23.C01.1.454.CMB.2.raw
  modified_base (295)..(295): a, c, t, g, unknown or other
  modified_base (459)..(459): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtccacctttcacttggccgggcagtcaggacattagcaactatttaaattggtatcagcaagaaaaccagggaaacgccccctaaactccngactctaacgatgcatccctaaatttggagacgaggggtacccatcccaaggttcacgtggaagtggatcgtgggacactattttactcacatcagcggctgcagctagatatttagactaatattattactgtacaactaatatagaatactcctaccccctntacgtttccgggacggtaacgggactaaaggggtcggtagactcgaaacgtacgaaactggtcgacgtacgacacctacttcgttcg

SEQ ID NO: 404818 - DNA, 548 bp, Homo sapiens
  misc_feature: GZ8MTXP02JTLDP.52.23.C01.1.454.CMB.2.raw
  modified_base (281)..(281): a, c, t, g, unknown or other
  modified_base (459)..(459): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagacgtcacctttcacttggccgggcagtcaggacattagactaacttatttaaatggtatcagcaagaaacagggaaacncccctaaactcctagatctacgatgcatcctaatttggagacgaggggtcccatcccaaggttcacgtaggagtggatcgtgggactacttatttacttcactatcagtcgactgcagcctagaagtatttagactaatatattactgtacaaactatatagaactactcctcccctntaccgttcggacggtaacggaccgaaggtcggagtactacgaacggtaaccgaacgtggtacggactcggacctaccgtataccgttcg

SEQ ID NO: 404819 - DNA, 670 bp, Homo sapiens
  misc_feature: GZ8MTXP02JVKSL.52.23.C01.1.454.CMB.2.raw
  modified_base (235)..(235): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagtatgtgacatccagatcgacccagtcctccactccctccctgtctgcatcgtggtaggagacagtcgtcctaccttcacgttcggccgggngagtcgaggactattagactaacttatttaaagttggtatcagacaaacgaaaccaacgggaaactaccccctaaactcctagactccagatgactatcctaagttggacgacgtacggggtacccataccgaggtacacgtaggacgtgtatcgtaggactacgttactttacttacgactctacacgcgctgcacgctagtaagttactttagactaactattacttacgtaactactaaaactaattaaagtacgtaaacgtacccttacccgttacccccgttagttacccggtttaccggggaacggggtaaccggggtaaaacccgtaaagggggttacggaaacgtaacgttaccgaaaacggtaacccggtaaagtcggggttacggacgttacggaaccctaccggttacttaccgggtttacccg

SEQ ID NO: 404820 - DNA, 707 bp, Homo sapiens
  misc_feature: GZ8MTXP02HRLU6.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtccaccttcacgttcggccgggcgagtccgaaggactattagactaaacttattaaatggtatcgagacaagaaaccgagggaactacccctaaatctagactacacgatgctataccgtaagtttgggaacgtaaccggtacggggtacccctaggttaccgtaaacggggtttccaacggttaggggtaaagttacgggtattccgggtaggggtaaccttacgtttttaacctttttaacctttaccgaaacccttagtcccgaacgggtcccggtaccttcgaccgtaacgtacccgttaaggtaacgttacgttttacgaactaaactagtttaacttaacgttacgttaaaccaaacttaagtattaacgaaaactcctttaccccttcccctacgttacggttaccgggacgggttaacggaacggtagggtacgaagtacgtaaccgaagtacggtaacgtggtcgacggttcgacctacttcgttacgtttccg

SEQ ID NO: 404821 - DNA, 606 bp, Homo sapiens
  misc_feature: GZ8MTXP02FYUYW.52.23.C01.1.454.CMB.2.raw
  modified_base (452)..(452): a, c, t, g, unknown or other
  modified_base (603)..(603): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtcctccatcctccctgtctgcatctgtagagacagagtccaccttcacttggccgggcgagtcaggactattagactaacttattaaattggtatcagcaagaaaccgagggaaacgcccctaaactcctagactctaacgattagctaatacctaaagtttggaacgtaccgacggggtaccccaatacccgtaaacggttccaacgtagggtaaggtacggaattcgggtagggactacttattttacctttcaaccctatcacgtccgcgtacgacgcgtacngtaagtaacttttaggaacctataaacttatttacgtacgttacaaactaaatatacgaactactaccttacccgtctaacgtttcggacggacggtacgtagggtacgagtactaccgagaacgtacgaagttgacgtgacctatacgtntcg

SEQ ID NO: 404822 - DNA, 567 bp, Homo sapiens
  misc_feature: GZ8MTXP02FRYLZ.52.23.C01.1.454.CMB.2.raw
  modified_base (526)..(526): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagatccaccttcacgttggccgggcagtcaggactattagactaacttatttaaattggtatcagacaagaaaccgagggaaacacccctaactcagatctagatgctatactagtttggacgacgtaggggtacccagtaccgaacggttcacgtaggtaagtggatcggtagggaactacttacgttttaccttacaccgtatcgagccggtctgcacgtcagtaacttatttgacctaatatttactacttcgaactaaacgtaattatagaacgtactcccttaccccctgtaccggttacggacggtaggacgaggtagganataccgaagacgtagtgtacgctacgaccactactgttacg

SEQ ID NO: 404823 - DNA, 587 bp, Homo sapiens
  misc_feature: GZ8MTXP02JRZGV.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactattaaatggtatcagcagaaaccagggaaacgacccctaaactcctagatctacgatgcatacctaatttggagacgtacggggtaccagtaccaacggttcactaggaagtgatcgtgggacagtatttacttcacctatcgagcggacctgcagtcctagaagtatttagacctaatagtattactgtacaaactattaagtagaacgtacttaccctacccccttacttaccgtttacgggaccgggtacgggtaaccgtaagggtacggaatacgttacgaacggtacgtaaacgttcgggtacggtaccgttacggaccgtacctaacgttcgtttaccg

SEQ ID NO: 404824 - DNA, 543 bp, Homo sapiens
  misc_feature: GZ8MTXP02HNNMT.52.23.C01.1.454.CMB.2.raw
  modified_base (441)..(441): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcagtcaggacattagcaactattaaatggtatcagcagaaaccagggaaacgcccctaaactcctagatctacgatgctatccaaatttggagacgaggggtcccagtcccaaggtcacgtaggaagtggatcgtgggactactattttacttcactatcagcggtcctgcagcctgaagtatttgactaacattattactagtacaactaatatagaanactcctccccctagtacctttcgggcggtaacgggaccaaggggtcggaagacgtacgacgtaaccgaaagtggtacggcttacggaccaccagttctttcg

SEQ ID NO: 404825 - DNA, 578 bp, Homo sapiens
  misc_feature: GZ8MTXP02JV13B.52.23.C01.1.454.CMB.2.raw
  modified_base (197)..(197): a, c, t, g, unknown or other
  modified_base (224)..(224): a, c, t, g, unknown or other
  modified_base (456)..(456): a, c, t, g, unknown or other
  modified_base (557)..(557): a, c, t, g, unknown or other
  modified_base (565)..(565): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatcctccctgtctgcatctgtaganacaggatcaccttcacgttggccgggnagtcaggactattagactaaacttatttaaattggtatcagacaaggaaaccaaggggaaaactccccctaaaactcctagtaactactacgatgactaactccgtaaagtttcggaacggtaacgacggggtaccccaataccccgaaaggttcacgtggaagtggatcgtagggactacttatttaccttcacctattacgacgtcggccctaggctaagctagaagttntttacactaagtatactatactacaaactatagagaatactccgtaccctgttaccgttcggacggtacgacggaggtacgaggactacgacgacgtaagngtacggcncaccacactcgtc

SEQ ID NO: 404826 - DNA, 609 bp, Homo sapiens
  misc_feature: GZ8MTXP02HTMF7.52.23.C01.1.454.CMB.2.raw
  modified_base (211)..(211): a, c, t, g, unknown or other
  modified_base (222)..(222): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctcctgtctgcatctgtaggagacagagtcaccttnacttgccgggnagtcaggactattagctaacttattaaattggtatcagacaagaaaccgagggaaacgacccctaaactcctgatctacgatgcatactaatttggagacgacggggtccatcgaagttcacgtaggtaagtggatcgtagggactacgttacttttacttcacatcgacgcggctgacagtacctagtaagtatttcgactaaactattattacgtacttaacaaaactataaagtacgtaaataaccttccctacccccttacgtaccggtttccgggaacgggtaacggggtaaacccgtaaaggggttacggaacgttaacgtacgaaacgtaacccgtaagtaacgggtcgccgttagaccctaacgtactttcgtttaccg

SEQ ID NO: 404827 - DNA, 546 bp, Homo sapiens
  misc_feature: GZ8MTXP02H0YI1.52.23.C01.1.454.CMB.2.raw
  modified_base (413)..(413): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttcggccggcgagtcaggacattagctaaacttattaaatgtatcagcagaaacaggaaacacccctaaatcctagactacacgatgactatacctaatttggagacgagggtcccaatccgaagttcacgtggaagtggatcgtagggactacttgtttaccttcactatacagcgctgcacgctagagtattgactaanttaacttatagtactaaagtataactagaaactactaccctccctacgtaccgtttcgggacggacggtaaccggtaggtacgaagtactacgacgtaacgtaatcggaaggctacgacaccgtatttcgtcg

SEQ ID NO: 404828 - DNA, 551 bp, Homo sapiens
  misc_feature: GZ8MTXP02JPN54.52.23.C01.1.454.CMB.2.raw
  modified_base (415)..(415): a, c, t, g, unknown or other
  modified_base (420)..(420): a, c, t, g, unknown or other
  modified_base (424)..(424): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttggccgggcgagtcaggacattagcaactattaaatggtatcagcagaaaccagggaaagcccctaaatcctgatctaacgatgacatcccaatttggagacgaggggtcccagtccgagttcactggaagtggatcgtagggactacgtattttacttcactatcagccggactgcagcctgaagtatttgacaactatnttacngtanaaactaatatagaagactcctacccctacgtacgtttcgggaccggtaacgggtaccctaaggggtacgaaggtactacgaacggtaccgaaagtggtacggtactggaccaccgtacttctttacg

SEQ ID NO: 404829 - DNA, 674 bp, Homo sapiens
  misc_feature: GZ8MTXP02IDXJM.52.23.C01.1.454.CMB.2.raw
  modified_base (196)..(196): a, c, t, g, unknown or other
  modified_base (223)..(223): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagganacagagtcaccttcacttggccggganagtcaggactattagcaacttattaatggtatcagcaagaaacgagggaaacacccctaaatcctagactcacgatgacatacctaagttggagacgaggggtcccatccgaagttcacgtaggaagtggtaactcgtaggggaactacgttatttttaacctttcaacctatccgaagccggtccctggaccacgtaccgtagtaaacgttattttaggaccctaaaataagtttaactttaaacccggtagtttaaccaaaacgttaaaatattaaacggaaacgtaacttacccttacccccttacccttaaccgtttaccgggttaaccggggtaaccggggaaaccggtaaaccggggttaacgggtaaacggaagttacgtaacggtaaccgaaaccggtaacggttaggtcgtacggaccgaaccgtacgttaacgtttacccg

SEQ ID NO: 404830 - DNA, 624 bp, Homo sapiens
  misc_feature: GZ8MTXP02HPAPZ.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttggccgggcgagtcaggacattagcaacttatttaaatggtatcagacaagaaaccagggaaacacccctaaatcctagactctaacgatcgacactccgtaaatttgggaacgtaccgtaagggggtaccccaagttcccgaaagggtttccaacgttgggaagttgggaatcggtagggactacttatttttaccttacaccttatcagtcgacctgctagcccttagaagttacttttagacctaaactatttaaacttacttgtaactaaataactaatacggaactactccttacccccttagttaccgtttaccggggacgggaacgggtaccggttaaaggcggtaagacttccgaaaggtacgtaacgtggtcggtactacgaccgtaacctagtttactcg

SEQ ID NO: 404831 - DNA, 570 bp, Homo sapiens
  misc_feature: GZ8MTXP02GSLJL.52.23.C01.1.454.CMB.2.raw
  modified_base (281)..(281): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttcacttggccgggcgagtcagggactattagactaactatttaaattggtatcagcaagaaaccagggaaacncccctaaactcctgatctacgatgacataccaatttggagacgacggggtcccatcccgaaggttcacgtggaagtggatcgtgggaacctagttattttacttcacctatcacgcgcctcgcagctagaagtactttgactaactatattactgtacaaactaatatagaactactacccgttcccctactacgtttacgggacgggtaacgggaaccgaaagggtagggaaacgtacgtacgaacgaaccgtaagtcggtacggcgtacgctaacctactcgttacg

SEQ ID NO: 404832 - DNA, 543 bp, Homo sapiens
  misc_feature: GZ8MTXP02JE6XB.52.23.C01.1.454.CMB.2.raw
  modified_base (210)..(210): a, c, t, g, unknown or other
  modified_base (221)..(221): a, c, t, g, unknown or other
  modified_base (389)..(389): a, c, t, g, unknown or other
  modified_base (429)..(429): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtaggagacagagtcaccttnacttgccgggngagtcaggacattagcaactattaaatggtatcagcagaaaccagggaaagacccctaaatcctgatctagatgcatccaatttggagacaggggtcccatccaaggttcactggagtggatcgtgggacacgtatttcttacaccatcagcgctgcagcctgaagtntttagactaactatattactagtacaataatataggaaanactacctaccccctactaccgtttacggacggtaacgggtaaccgaagggtacggagacgtacgaacggtaacgaacgttggtacgggctacggaccaacctacgtacgtttcg

SEQ ID NO: 404833 - DNA, 549 bp, Homo sapiens
  misc_feature: GZ8MTXP02I0B9Q.52.23.C01.1.454.CMB.2.raw
  modified_base (276)..(276): a, c, t, g, unknown or other
  modified_base (312)..(312): a, c, t, g, unknown or other
  modified_base (424)..(424): a, c, t, g, unknown or other
  modified_base (434)..(434): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttggccgggcagtcaggacattagcaacttattaaatggtatcagacagaaaccagggaaacncccctaaatcctgatctacgatgcatccaattgganacgaggggtacccatccaagttcacgtaggaagtgatcgtggaactactattttacttcaccatcagcgctgcagctgaagtatttagacaactattattactagtaccaanaatatagaanacttcctaccctactacgtttccggacggtacggactaagggtacggagtaacgtcgaacgaaccggtaacgtggtacggtacgttacggacctaacccgtacgttaccgttacg

SEQ ID NO: 404834 - DNA, 608 bp, Homo sapiens
  misc_feature: GZ8MTXP02I6BRU.52.23.C01.1.454.CMB.2.raw
  modified_base (401)..(401): a, c, t, g, unknown or other
  modified_base (502)..(502): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtaggagacagagtccaccttcacgttcggccgggcagtcaggacattagactaacttaatttaaattagtatacagacaagaaaccgaagggaaaccacccctaactctagactctacgatgacatacctaagttggaagacgacgggtaccatacccgtaagtcacgtaggaagtgactcgacggactacgtttatttaccttcactntacgcggtaccgctcgacgtacgtcgtagtaagttatttacgacaacttaatacttactacgtataaactataagtagtaactacttccctaaccccgttntacccgtacgggtacgggtaacggtaaccgtaggtacgggtaagaacgttacgaacggtacaaccggttggtacgtacgttacgacctaccgttaactcgtttacg

SEQ ID NO: 404835 - DNA, 689 bp, Homo sapiens
  misc_feature: GZ8MTXP02H0OVS.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctcatcctcctgtctgcatctgtaggagacagagtcaccttcacttggccggcgagtcgaggactattagactaacttattaaatggtatcagacaagaaacgagggaaacaccccgtaaactcctagtactacctaacgatcgacctaactaccgtaaagtttaggacgaaaccggtacggggtacccctaagttacccgtaaagggtttaccaacggttaggggtaaacgtgggtaacttcgtacgggggtaacctaaacgtttactttttaacctttccaaacctacttacgaacgtccggacccttcgaccgtacgtacccgtaagtaacgttaacttttacgactaaaacgtacttaactttactacgttaacaaactaataactagaaactacttccctacccttacgtaccgtttcggaacgggtacggtaacgtacgggtaagacgtaacgtacgaacggtaacgtaacgtcggtacggtaccgtacggacctaccctaacgtttaccggttcc

SEQ ID NO: 404836 - DNA, 653 bp, Homo sapiens
  misc_feature: GZ8MTXP02G71GE.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacgttggccgggcgagtcaggacattagacaactatttaaatggtatcagcaagaaaccagggaaacaccccgtaaactcctagatactacgatcgctatacctaagtttggacgacgtacggggtaccctatcccgtaaggttcacgtagggaagtcgagtcgtagggactacttactttttacttacacctataccgagtcccggctcggacacgtacctagaagttactttacactaactagttactttaacgtataacctaataataagtacggtaaatacttacccctacccccgttacttaccggtttacggggacccggggtaaaacggggtacccgtaaagggggttccggaaaggtaacgtacggtaaacgaaccggttaaaaccggtggttcgggacttacgggaccctacccgttaagtccttttaaccgg

SEQ ID NO: 404837 - DNA, 754 bp, Homo sapiens
  misc_feature: GZ8MTXP02ITKNP.52.23.C01.1.454.CMB.2.raw
  modified_base (195)..(195): a, c, t, g, unknown or other
  modified_base (221)..(221): a, c, t, g, unknown or other
  modified_base (296)..(296): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgaccagtctccatcctcctgtctgcatctgtagganacagctcaccttcacgttcggccggngagtcaggactattagacaactttattaaatggtatcagacaagaaaccgaagggaaccaacccctaatccgtanactctaacgatacgactactacctaagtttggaacgtaacgtacggggtaccctaagtaccgtaacggttaccaggtaggtaaggtacgaagttccgggtagggaaaccttaacgtttactttttaaccttacaaacctacgttaccgacgccggtaccgtgacctaaacgggtccttaaaggtaagtttacttttaacgaacctaaaacttactttaacgtttaaacgttaacgttaaacctaaaaccgttaaatttaacccgtaaggttaaaaccgtcccgttttaacccccttccccccggtttaaaggtttaaccccgggtttacccgggggaaaaccggggttaacgggtaaacccgggtaaagggttaaccgggaaagtaaccgttaaccgaacggaaaccgttaagtcccgggaggttaccctaggaccctacctaggtttaccgtttccg

SEQ ID NO: 404838 - DNA, 616 bp, Homo sapiens
  misc_feature: GZ8MTXP02GSWC2.52.23.C01.1.454.CMB.2.raw
  modified_base (198)..(198): a, c, t, g, unknown or other
  modified_base (286)..(286): a, c, t, g, unknown or other
  modified_base (307)..(307): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtagganacagatcaccttcacgttggccgggcgagtcgaggacattagactaaacttaatttaatggtatcgagacaagaaaccgagggaaacncccctaaactcagtactctantgcatacctagtttaggacgacgtacggggtaccataccgtaaggtcaacgtagggaagtgatcgtaggactacgttatttacctacactactcagccggtctcgcgtacgtactaggtaagttagtttacgaactaactattaactttactacgttaaacaaacgtaattacgtaacgtaactacccttcccgttaacccccttcgtaaccggtttaccggggaacgggttaacggggaaccgaaggggtacggtagacttacgaacggtacccgaagtcgtgactacggaccaactcgttcttaccg

SEQ ID NO: 404839 - DNA, 733 bp, Homo sapiens
  misc_feature: GZ8MTXP02F61WT.52.23.C01.1.454.CMB.2.raw
  modified_base (199)..(199): a, c, t, g, unknown or other
  modified_base (213)..(213): a, c, t, g, unknown or other
  modified_base (224)..(224): a, c, t, g, unknown or other
  modified_base (281)..(281): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtcctgcatctgtagganacagagtcaccttnacttgccgggngagtcaggacattagactaacttatttaaatgtatcagacaagaaaccgaggaaacncccctaaactccagtactctacgatcgactaacttacccgtaaagtttcgggaacgtaaccggtacggggtacccctaagttacccgtaaaacggtttccaacgttaggggtaacgtacggtaacgttccggtagggggtaaaccttaaacgtttacgttttttaacccttacgtaaaccctactttaccgaaggtaccccggtcccgttaggacccgtaacgtacccgtaggtaaaggtttacttttacgaaacttaaactaaatttaactttaccgttaacgtaaccaaattaaacgttaataacgtaaactacttccccttacccccgttacgtaccgtttaccggggacggtaacgggtacccggaaagggttaccggaaagtaacgtacgtaacggaacgttaaccgtgggtacgtaccgtacggacctacgtacttacgtttaccg

SEQ ID NO: 404840 - DNA, 637 bp, Homo sapiens
  misc_feature: GZ8MTXP02IDOQA.52.23.C01.1.454.CMB.2.raw
  modified_base (198)..(198): a, c, t, g, unknown or other
  modified_base (226)..(226): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtctgcatctgtagganacagagtctaccttcacgttggccgggngagtcaggactattagctaacttattaaatggtatcagcaagaaccagggaaacacccctaaatcctagactactaaccgatcgacacttaccgtaagttttaggaagaaccgtacggggtcccagtaccgaaacggtttcgacgtagggaagtcgggtatcgtacgggtaactacttaacgtttttaccttaccacctaagtcgtaacgccggtcctgcctagtcccgtagtagttaactttcgactaactaatttattacctagttaaccaaatatatagaactactcccgtccccttagtaccgtttccgggacggtaacgggtacccgtaggggtagaacggtacgtacgaacggttaaccaaaccggttggtacgacgttacggacctaccctagtttaccttccg

SEQ ID NO: 404841 - DNA, 582 bp, Homo sapiens
  misc_feature: GZ8MTXP02FKWVA.52.23.C01.1.454.CMB.2.raw
  modified_base (197)..(197): a, c, t, g, unknown or other
  modified_base (464)..(464): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtagganacagagtccaccttcacttggccgggcgagtcaggacattagactaactatttaaatgtatcagacagaaaccagggaaacacccctaaatcctagatctacgatgactatcctaaatttgggacgacgacggggtcccagtaccgaaaggttccactagggtaagtggtaatcgtagggactactatttttacttacacctatcgagccgtacctgcagtcctagaagtagtttgactaactattattactagtactaaactatanacgactactccctaccccctatacgttcggacggtacggggaccgaagggtcggaactacgtaccgaagtacccggtaaatcggtacggcttacggactaaaccgtacgttccgttcg

SEQ ID NO: 404842 - DNA, 647 bp, Homo sapiens
  misc_feature: GZ8MTXP02J21O5.52.23.C01.1.454.CMB.2.raw
  modified_base (197)..(197): a, c, t, g, unknown or other
  modified_base (225)..(225): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtcctccatccctcctgctgcatctgagganacagagtccacttcacgttcggccgggnagtcaggtacattagctaacttattaatggtatcagcaagaaccgaggaaacctcccctaaagtcctagtactccgtacgatcgacttacttacgtaacgtttaacggaaacgtacggggtacccctaagtaccgtaaggttccgaaggtcggggagttcggccgttcgttggggaactacggtttacttttaccttacaaccctataccgacgtaccaacggtcccttaggacccgtacgcccggttaagaaggtatttaacgttgaaccctaaataatttacgtaatctaacgaaaccgtagtaacctaactaactccctaccggtccttacgtaccggggttacgggacggggacgtaaggacggactacgacgaaaacgttgtcggtaacgcgtacgaccgtactcgtacgttctacc

SEQ ID NO: 404843 - DNA, 692 bp, Homo sapiens
  misc_feature: GZ8MTXP02GMXNS.52.23.C01.1.454.CMB.2.raw
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctccctgtcctgcatctgtaggagacagagtcaccttcacgttggccgggcgagtcaggactattagactaaacttatttaaattggtatcagacaagaaaccaggggaaacacccctaaactcctagactacgtaacgatgactaataccctaaagtttcgggaacgtaccggacggggtacccctaagttacccgtaaggttacaacgtaggggaagttcggattcggtagggaacctaacttacttttacttcaacctatcgagtccgtctgacagtaccgtagtaacgttagtttacgactaaactaattattaaccgttagtaacctaaacgtaaattacgtaagtaaacgtaccttcccttacccccgttacgtaaccgggtttaccggggaaccggggtaaaccggggtaaccggtaaagggggttacggaaacggtacgtaacggaaacggtaaccggtaacggtcggtacggtaccgttacggaccctacctacgtttccgtttaccg

SEQ ID NO: 404844 - DNA, 790 bp, Homo sapiens
  misc_feature: GZ8MTXP02H16E3.52.23.C01.1.454.CMB.2.raw
  modified_base (201)..(201): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtcctcactcctccctgtctgcatctaggtagganacagagtctaccttcacgttcggccgggacgagtcgaggactattacgactaaacttattaatgtatcgagacaagaaacgaggaacacccctaaatcctagtactacacgatcgactactaccgtaaagttcggagtaaccggtacggggtacccaagtacccgtaaacggttaccaacggtagggtaacggttacgggtaacgtccggtaaggggtaaaccttaacgttttaaacctttttaaccttaccgaaaccttaactacccgttacggcccggtacccgttaggtacccgaacggttacccgttaaaggtaaacgtttaactttaccggaaccttaaaaccgttagtttaaactttaaccgttaacgttaaaacccgtaaaacttaagttaaacgttaacggtaaaaccgtaccctttacccccgtacccccttaaccggttaccgggtttacccggggaaccggggtaacgggtaaaacccggtaaggggtacggaaacggtacgtaacccggtaaaggtacccgtaaaggttcggtaccggttacgaccggtaccgtaaacctacggtttccttaaccgg

SEQ ID NO: 404845 - DNA, 638 bp, Homo sapiens
  misc_feature: GZ8MTXP02GFKUY.52.23.C01.1.454.CMB.2.raw
  modified_base (225)..(225): a, c, t, g, unknown or other
  modified_base (417)..(417): a, c, t, g, unknown or other
  modified_base (471)..(471): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctcctgtctgcatctgtagagacagactcctaccttcacgttggccgggngagtcaggactattagactaacttatttaaagtggtatcagacaagaaaccgagggaaacctacccctaaactcgtagactacgtaacgatcgactataccgtaagtttggacgacgtacgggtcccagtaccgagttcacgtaggagtggatcgacggactacgttatttactacactagtcgagccgtcncgtacgacgtctagaagttatttacgactaaactactttattacgtacgtaaanaaactaatagtaacgaacttaaccttccccgttaaccccttcgttaaccgggtttacgggaacccgggttaaacgggaccggaaaggggttaccgaaagttaccgaacgtaacgtaacgtaccgtaaggtccggtacttaacggaccaacgtacgttcgtttaaccg

SEQ ID NO: 404846 - DNA, 641 bp, Homo sapiens
  misc_feature: GZ8MTXP02H7A52.52.23.C01.1.454.CMB.2.raw
  modified_base (408)..(408): a, c, t, g, unknown or other
  modified_base (447)..(447): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtctaccttcacgttggccgggcgagtcaggacattagctaacttatttaaatggtatcagacaagaaaccgagggaaacaccccctaaatcctagatctacgatcgactactactaagtttggaacgacgtacggggtcccagtaccgaagttcacgtaggtaagtggatcggtagggtaactacgttacttttaccttcaactntccgaggcccggtacctgacgacgtccgttagaacgttntttacgactaaactattactttactacgtaactaaataatagtagaaactcttcccctaccccttacgtaccgtttaccggggaccggggtaaacggtaaccggtaaagggtcgggtaaagaacgttaccggaaagggtacccgtaacgttgggccggtccttaccggacctaaccgtacgttaccgtttaccg

SEQ ID NO: 404847 - DNA, 708 bp, Homo sapiens
  misc_feature: GZ8MTXP02GVYYX.52.23.C01.1.454.CMB.2.raw
  modified_base (198)..(198): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctcctgtctgcatctggtagganacagacgtccaccttcacgttcggccgggcgagtcaggactattagactaacttaattaaattggtatcgagacaacgaaaccgaagggaaaccacccctaaactcctagtactactagactcgactactaccgtaagtttggaacgtaacggtaccggggtaccctagtacccgtaaggttccaaggtacggaaggttacggacttcgggtacgggtaactaacgtttacttttaccttacaacctacgttcgacggtacccggtccgtacgacgtacgtaccgttaggtaaagttacgtttacgactaaacttacttaacttaaccgtactaaacctaaagtaaagtaacgtaagtaaacttaccttacccttaccccctagttaacccggttcggggaaacgggtaaccgggtaaaccgttaaggggacgtaaacgtacgtaacggaaccggtaaccgtaaaggtcggtacgtaccgtcggaaccctacgtacgtttcctttaaccg

SEQ ID NO: 404848 - DNA, 742 bp, Homo sapiens
  misc_feature: GZ8MTXP02IKIBV.52.23.C01.1.454.CMB.2.raw
  modified_base (318)..(318): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtcctccattccctccctgtctgcatctagtaggagacagacgtccaccttcacgttcggccgggcagtcacggactatagactaacttaatttaaatagtatcagacaagaaaccgaaggaaaccaccccgtaaactcctgactctacgancgactactactaagttacggaacgaccgtaccggggtacctagtaccccgtaaggttacccgagttacggggtaagtacgggtacgttacgggtacggtaaacttaactttaacttttttacctttaaccaaacccgttacttaccgacggtcccggtacgttacgaccgacgtacccgtaggtaaaccgttttagtttaacgactaaacttaacgtttaaccttaggttaacaactaaaacgttaataaaggttaacaaacgttaccccttaaccccttacccccgtttaccggttaacgtttacccgggggaccggggtaaaacggggtaacccgttaagggggtaaaccggtagaaacggtaacgtaacggtaaacgttaggcggtacggttcctacggaccaactttccgtagtttcccg

SEQ ID NO: 404849 - DNA, 671 bp, Homo sapiens
  misc_feature: GZ8MTXP02IOJQ4.52.23.C01.1.454.CMB.2.raw
  modified_base (458)..(458): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagacgtccaccttcacgttcggccgggcgagtcaggacattagactaacttaattaaatgtatcagacaagaaaaccgaggaaacaccccctaaatcctagaactacgtacgatgacctactacctaagtttacggacgtaacgtacggggtaccccataccgtaaggttccaacgttaggaagttcgatcggtacggactaacttattttactcaaaccgtatacacgccggcctgcgtacgtccgtagtaacgtttntttagacctaaagtacttagttaacgttaccggtaactaaacttaaagttaaacgtgtaaaacgtacccttccccgttacccccttacgttaccgtttaccggggacgggtaaaacgggtaacccggttaaggggacggtaaacgaacgttacgaaacggtaacccgggtaaagttggtacggtaacttcggacctaacctgttccgtttacg

SEQ ID NO: 404850 - DNA, 526 bp, Homo sapiens
  misc_feature: GZ8MTXP02GAEPT.52.23.C01.1.454.CMB.2.raw
  modified_base (211)..(211): a, c, t, g, unknown or other
  modified_base (271)..(271): a, c, t, g, unknown or other
  modified_base (374)..(374): a, c, t, g, unknown or other
  modified_base (384)..(384): a, c, t, g, unknown or other
  modified_base (407)..(407): a, c, t, g, unknown or other
  modified_base (424)..(424): a, c, t, g, unknown or other
  modified_base (443)..(443): a, c, t, g, unknown or other
  modified_base (490)..(490): a, c, t, g, unknown or other
  modified_base (492)..(492): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttnacttgccgggcagtcaggacattagcaactattaaatggtatcagcagaaacagggaaancccctaaactcctgatctagatgcatccaatttaggagacgaggggtccccatccaaacggttcactaggagtgatcgtgggacactatttactttcacatcngacggctagnaacgcctagaagtattttacganaaactattaattacctnttacaaacaatatagaaanatcctacccctctacgtttcggacggtacgggaccagggtacggaananacgagacgagtgtcgactcgacacctacgtctcg

SEQ ID NO: 404851 - DNA, 551 bp, Homo sapiens
  misc_feature: GZ8MTXP02GRSHU.52.23.C01.1.454.CMB.2.raw
  modified_base (200)..(200): a, c, t, g, unknown or other
  modified_base (282)..(282): a, c, t, g, unknown or other
  modified_base (294)..(294): a, c, t, g, unknown or other
  modified_base (419)..(419): a, c, t, g, unknown or other
  modified_base (423)..(423): a, c, t, g, unknown or other
  modified_base (449)..(449): a, c, t, g, unknown or other
  modified_base (455)..(455): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtcctccatccctccctgtctgcatctgtagganacagatccaccttcacgttggccgggcgagtcaggactattagactaattaattaaatgtatcagacaagaaccagggaacncccctaaatcanatctagatgcactcctaagttaggacgtacgacgggtccctagtaccgtaagtcagtaggagtcggatcggagactacgttacttttactacactacacgtacgcgctggcagtacgtatagttnttanactaactattagttctagtacaatanagtaanactacctcctaccgtacgtacgtacggacgtacggacgtaggtacgagtaacgacgaacgtacgtacgtcgtagctacgacctactcgttacgtcg

SEQ ID NO: 404852 - DNA, 644 bp, Homo sapiens
  misc_feature: GZ8MTXP02INR3X.52.23.C01.1.454.CMB.2.raw
  modified_base (200)..(200): a, c, t, g, unknown or other
  modified_base (582)..(582): a, c, t, g, unknown or other
tcagcgcagtacgacacgaccggtgctcgatttagtacacgtgattagggattggggggagtcagtcccaaccaggacacagcatggacatgagggtccctgctcagctcctggggctcctgctgctctggctctcaggtgccagatgtgacatccagatgacccagtcctccatccctcctgtcctgcatctgtagganacagctccaccttcacttggccgggcgagtcgaggactattagactaaacttattaatggtatcagacaagaaaccaagggaaccacccctaaactcctagactctaacgatcgacactaccgtaagtttaggaacgtaccggtacggggtaccccaagttaccgaacggtttacacggttacggtaaggtacggtactcggttagggtacctacgttaacctttttaccttaccaactactacgtacgcgtctcgacacgtacgtagtaacgtagtttacactaactattaaactttactacttaacaaactaataagtagaactaaccttccctaccccttagttacccggtcggaacggtacgggtaaccgtaaggggngaaacgtacgtaacgaacgtaacgacgtaaggtccgacgtacgacctacctagtaccgttcg

SEQ ID NO: 404853 - DNA, 647 bp, Homo sapiens
  misc_feature: GZ8MTXP02JB6SZ.52.23.C01.1.454.CMB.2.raw
  modified_base (198)..(198): a, c, t, g, unknown or other
  modified_base (454)..(454): a, c, t, g, unknown or other
  modified_base (530)..(530): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatccctcctgtctgcatctggtagganacagagtcctaccttcaccgttgggcccggggacgtaggtcgaacggtactaagttacgactaaacttaatttaaagtgtaatcagacaacgaaacgaggaaacacccctaaatcctagtactcacgtatgacacttacgtaagtttcggggaacgtacgggtaccgggtacccctagtaccggttaacggttccaagttacgggtaggtggtacttcgggtacgggaacttaactttatttaccttacaaccgtntacgacggccgtcgcgactacggtctaggtaagttatttacgactaactacttacgttactagtacaaataagtanaaacgtactacctaccttcccgtacttacgtacgggaccggtacggaccggtaggtcggtaaagacggtaccaaaggtacgtaacgtggtccgtactcgactaccgtactacggttc

SEQ ID NO: 404854 - DNA, 692 bp, Homo sapiens
  misc_feature: GZ8MTXP02I4ASO.52.23.C01.1.454.CMB.2.raw
  modified_base (200)..(200): a, c, t, g, unknown or other
  modified_base (325)..(325): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatccctccctgtctgctatctgtagganacgagacgtccaccttcacgttggccgggacagtcaggactagttagacaacgttaatttaagtggtatacgagacgaacgaaaccgaacggaaaccgtacccctaaactccagtactacactangactactacgtagttaggacgacgtccgggtaccacgtccgtaacgttacctaggtaaggtacgtagtacgtcgtagggaaccttaacgtttactttttaaccttacccgtaaacacttacgtacccggtccggtacctacgactacggtaccgtagtaagttcttaaacgactaaactacttaacttaaccttacgtaaactaaactaacttaagtaaccgtaatacccttccctaaccccgtcggtttaccgttacccggggaccggttaaacgggaacccgtaaaggggtacgaaacgggtacttaacggaacgtaccggtataaccgggtggtaccctaggaccgtactccgttacgttcccg

SEQ ID NO: 404855 - DNA, 652 bp, Homo sapiens
  misc_feature: GZ8MTXP02F66XP.52.23.C01.1.454.CMB.2.raw
  modified_base (231)..(231): a, c, t, g, unknown or other
  modified_base (544)..(544): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatcgacccagtctccatccctcctgtcctgctatctggtacggagacagagtccaccttcacgttcggccgggngagtcaggactattaacgactaattaattaagtgtatcagacaaacgaaacgacggaaacctaccctaatctagactactacgatccgactacttaacgtaagtttacgggaacgaaccggtacgggtaccctaattaacccggtaaacggttaccgaaggttaggggtaacgtacgggttactccggggtaacggtaacctttaacgtttaaacctttttacctactaaccgtatccggaacgtccgtacgcgactacgtactaggtaattacgttacaactaattatattactacctaaatactaaagtanaacgtacctcttcccgtacctaggttacggtccggacggtaacggaacgaggttacgacgttaacgacgtaacgacgtagtcggcggtactacgcaacctgtcctacg

SEQ ID NO: 404856 - DNA, 666 bp, Homo sapiens
  misc_feature: GZ8MTXP02GG0KL.52.23.C01.1.454.CMB.2.raw
  modified_base (196)..(196): a, c, t, g, unknown or other
  modified_base (218)..(218): a, c, t, g, unknown or other
  modified_base (550)..(550): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagganacagatcacttcacttgccggnagtcaggactatacgactaacttaattaaattggatcagacaacgaaaaccgaagggaaaacgacccctaaaacgtccctagtaactactaacgatcgactaacttaccaatttacgggaagtaccgacggggtaccctaagttaccgtaaacgggttccaacgtagggtaaacggttaggaacgttcggtacgggaaacttaaacgttaactttttacctttaccgaaacctaattccaacggtcccggtaccttacggcacggtaccctaggtaaagttacttttacgaactaaactaacttattaaacgtacttacaaataatacgtanaacgtactccctacccctacgtaacgttcgggaacggtacgggtaccaaagggtgacgtaactcgaacgtaacgaacgttggaacggtctacggacctaaccgtactccgtttacg

SEQ ID NO: 404857 - DNA, 586 bp, Homo sapiens
  misc_feature: GZ8MTXP02HO1G6.52.23.C01.1.454.CMB.2.raw
  modified_base (140)..(140): a, c, t, g, unknown or other
  modified_base (389)..(389): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtnccagatgtgacatccagatcgacccagtctccatccctccctgtctgcatctggtaggagacagcgtaccaccttcacgttggcccgggcgagtcaggactagttagactaaactatttaagtggtatacagacaaacgaaacgaaggaacacccctaaactccagataccagatcgacattactaagttgacggacgtacggggtcctagtaccgtacgtacagtaggagtcgatgtagactaacttntttacctacacctagtccgaggcggtctagactagccttaagacttagttcgactaatagttaactttcgaactacaaagtaatagaatacgtctaccccgtcacgttaccgtcgggacgggtacgacgggtaagtcggaaactcgtaacgacggtaaccgaggtgttaccgactacgctaccggttcttccttacg

SEQ ID NO: 404858 - DNA, 594 bp, Homo sapiens
  misc_feature: GZ8MTXP02G7UWO.52.23.C01.1.454.CMB.2.raw
  modified_base (208)..(208): a, c, t, g, unknown or other
  modified_base (220)..(220): a, c, t, g, unknown or other
  modified_base (251)..(251): a, c, t, g, unknown or other
  modified_base (280)..(280): a, c, t, g, unknown or other
  modified_base (465)..(465): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagagacagatcaccttnacgttggccggnagtcaaggcattagactaattattaatgtancagacaagaaacaggaaacacccctaaancctagactctacgatcgactagtacctaagttaggacgtacgtacggggaccctataccccgtaagttcacgtagggaagtggatcggacggactacgttatttccttacaccgtattacgcggtaccgtcgtgacctagtacctaggaagtttaccttgaacttaacgtaaattacgtttaacncgttaaaccaaatattaataggaaactcgtccctacccccgtataccggttacggcggaaccggacgaggtcgaagtactacgaaggaccgttaagtgtacgtcgactaccgtactaacgtcgttaccg

SEQ ID NO: 404859 - DNA, 636 bp, Homo sapiens
  misc_feature: GZ8MTXP02I7BCI.52.23.C01.1.454.CMB.2.raw
  modified_base (469)..(469): a, c, t, g, unknown or other
tcagcgcagtacgacacgaccggtgctcgatttagtacacgtgattagggattggggggagtcagtcccaaccaggacacagcatggacatgagggtccctgctcagctcctggggctcctgctgctctggctctcaggtgccagatgtgacatccagatcgacccagtctccactccctccctgtctgctatcgtgtaggagaacagacgtcctaccttcacgttggccgggtcgagtcgaaggtactattagactaaacttatttaatgtatcagacaaagaaccgaacggaaccacccctaaatcctagactacgtacgatacgactactacctagtttcggacgacggtaccggacctagtaccgtagttcgaacgttaggggaagtgtactcgggtcgaaccttagttacttttacctacaactacgtacgacgccggtctagacgcgtacgtaggtaactttnttacgataaccgtattacgttactagtaaccaaataattaacgacgtaaactcttcccttccccgttagttacccgttacggacggaaccggtacggaaagggtcgaggtaacgtacaacggacgtaacgtcggtcgtaccgtcgaccctacgttactcgtttaccg

SEQ ID NO: 404860 - DNA, 726 bp, Homo sapiens
  misc_feature: GZ8MTXP02FF269.52.23.C01.1.454.CMB.2.raw
  modified_base (196)..(196): a, c, t, g, unknown or other
  modified_base (221)..(221): a, c, t, g, unknown or other
tcagcgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctcctgtctgcatctgtagganacagagtcaccttcacttgccgggngagtcaggacattagctaactattaaattgatcagcagaaacagggaaagacccctaaacgtcctagatactacgaatcgcatacccaatttgggaacgtacgagggggtaccccaagtccccgtaaaggtttccacgtaggtaaggtaggacgttcgtagggggactaacgttagttttaaccttttacgaaccctattaccgaggtacccggggtaccctcggaccgtacgtacccgtaggttaaaacgtaagtttttacggaccttaaaaccgtaatttaaacttaaaccgttacggttaactaaaaccgtaaacttaagtaacgttaaaacggacctttaccccgttacccccctaccttaaccggttttacccgggaaccgggaacgggggtaaccccgtaaaggggttcgggaaacggtacgttaaccggaacgtaaccggaaaccgtttgggaacggtaccctcgggtacccgtaaccctaacgtttaccgtttccgg

SEQ ID NO: 404861 - DNA, 755 bp, Homo sapiens
  misc_feature: GZ8MTXP02HS9V1.52.23.C01.1.454.CMB.2.raw
  modified_base (203)..(203): a, c, t, g, unknown or other
  modified_base (288)..(288): a, c, t, g, unknown or other
tcagcgcagtacgacacgaccggtgctcgatttagtacacgtgattagggattggggggagtcagtcccaaccaggacacagcatggacatgagggtccctgctcagctcctggggctcctgctgctctggctctcaggtgccagatgtgacatccagatgacccagtctccatccctcctgtctgactatcgtggtaagganacgagacgttcctacctttcgacgttcgggccgggagtacgtcgaaggactaatacgactaacttaatttaaagtggtaatcganacaacggaaaccgaaggaaaccacccctaaactcctagtactactagatcactacttacgttaaagttacggaacgtaacggtaccgggtactaacgttacccgtaaacggttctacggtaagggtacggtacggtagttccggtagggttaaccttaaacgtttacctttttaacttaacccgtacctaaccgtaccgtaacggtcccggtaccgtacgtacgtacgtaaccgtagttaaacgttagtttaaacactaaaacttacgtttaaaacgtttcgttaaacttaaactaaaacttaaagtttacggaaacttaaacccgtaccctttcccctacccccgtttaacggtaccggtttaccggggaacggggtaaaccggtaccgggtaaaggtacggaacgttaccgaacgacggtaacggacgttcggacgtcgtacgtaccgacctacggtttccttcg

SEQ ID NO: 404862 - DNA, 508 bp, Homo sapiens
  misc_feature: GZ8MTXP01DSB8S.52.19.B08.1.454.CMB.2.raw
  modified_base (211)..(211): a, c, t, g, unknown or other
  modified_base (400)..(400): a, c, t, g, unknown or other
  modified_base (422)..(422): a, c, t, g, unknown or other
  modified_base (441)..(441): a, c, t, g, unknown or other
  modified_base (479)..(479): a, c, t, g, unknown or other
  modified_base (495)..(495): a, c, t, g, unknown or other
  modified_base (501)..(501): a, c, t, g, unknown or other
  modified_base (506)..(506): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggngagtcgagacattagcatgtatctgaaattggtatcagacaaaaaagtagggacacgacccctaaactcctgatcctcgaatgctatcccactttggagacgagggggtcccatccaaggtttcaggtggaagtggctcgtgggactagtattttacttcactatcagcaggctgcagctagagatgtnacaactattattactgtacaanagtataatcctctccccgntcgtaacgtttcggggacgggggaccaagggttgaggnttacgagttcgaatgnggtccngctcntc

SEQ ID NO: 404863 - DNA, 500 bp, Homo sapiens
  misc_feature: GZ8MTXP01DZI8C.52.19.B08.1.454.CMB.2.raw
  modified_base (185)..(185): a, c, t, g, unknown or other
  modified_base (209)..(209): a, c, t, g, unknown or other
  modified_base (389)..(389): a, c, t, g, unknown or other
  modified_base (429)..(429): a, c, t, g, unknown or other
  modified_base (468)..(468): a, c, t, g, unknown or other
  modified_base (489)..(489): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagaatcaccatcacttgccggnagtcgagacattagcatgtatctgaattggatcagacaaaaaagtagggacacgacccctaaactcctgatcctcgatgcatcccactttggagacgaggggtcccatccaaggttcagtggaagtggctcgtgggactagtattttacttcacatcagcaggctgcagctagagatgtnacaacatattactagttacaatatataactcgtctcccgntctcgtttcgggcgggggttaccaaagggttggaagtanacgaagccgtaatggtggccngctaacttgtc

SEQ ID NO: 404864 - DNA, 475 bp, Homo sapiens
  misc_feature: GZ8MTXP01CLT1S.52.19.B08.1.454.CMB.2.raw
  modified_base (186)..(186): a, c, t, g, unknown or other
  modified_base (343)..(343): a, c, t, g, unknown or other
  modified_base (362)..(362): a, c, t, g, unknown or other
  modified_base (365)..(365): a, c, t, g, unknown or other
  modified_base (371)..(371): a, c, t, g, unknown or other
  modified_base (381)..(381): a, c, t, g, unknown or other
  modified_base (385)..(385): a, c, t, g, unknown or other
  modified_base (397)..(397): a, c, t, g, unknown or other
  modified_base (399)..(399): a, c, t, g, unknown or other
  modified_base (402)..(402): a, c, t, g, unknown or other
  modified_base (441)..(441): a, c, t, g, unknown or other
  modified_base (446)..(446): a, c, t, g, unknown or other
  modified_base (459)..(459): a, c, t, g, unknown or other
  modified_base (472)..(472): a, c, t, g, unknown or other
  modified_base (475)..(475): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcagtcgagacattagcatgtatctgaattggatcagacaaaaagtgggaacacgacccctaaactcctgatcctcgaatgcatcctactttggagacgagggtcccatccgaaggttcaggtgaagtgctcgngggactagtatttctcacntcngcagcngcagcagagntgtnacaatatatatnanaanatactatctctccgtctcgtcggtcgggcgggactaggngaganacgagacgtaagngtgcgtcgactcnctn

SEQ ID NO: 404865 - DNA, 491 bp, Homo sapiens
  misc_feature: GZ8MTXP01EFPT8.52.19.B08.1.454.CMB.2.raw
  modified_base (186)..(186): a, c, t, g, unknown or other
  modified_base (213)..(213): a, c, t, g, unknown or other
  modified_base (391)..(392): a, c, t, g, unknown or other
  modified_base (394)..(394): a, c, t, g, unknown or other
  modified_base (397)..(397): a, c, t, g, unknown or other
  modified_base (399)..(399): a, c, t, g, unknown or other
  modified_base (403)..(403): a, c, t, g, unknown or other
  modified_base (405)..(405): a, c, t, g, unknown or other
  modified_base (487)..(487): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctcctgtctgcatctatagganacagaatcaccatcacgttggccgggnagtcgaagactattagctatgtatctgaattggatcagacaaaaaagtagggacacgacccctaaactcctagactcctcgatgcatccctactttggagacgcggggtacccatacccgaaggttcaggtggaagtggctcgtgggactaggtaattttacttcacatcagcaggcnnancanantgtnanatatatatatacatatatatctctcctctcgtcgtcgggtcgggacggaggaggagagacgacgacgaagtgtgcgcgctcncgtc

SEQ ID NO: 404866 - DNA, 586 bp, Homo sapiens
  misc_feature: GZ8MTXP01BFEAF.52.19.B08.1.454.CMB.2.raw
  modified_base (187)..(187): a, c, t, g, unknown or other
  modified_base (209)..(209): a, c, t, g, unknown or other
  modified_base (421)..(421): a, c, t, g, unknown or other
tcagcgcagtacgacacgaccggtgctcgatttagtgagtcagtaaggggcagtcccaaccaggacacagcatggacatgagggtccctgctcagctccgtggggctcctgctgctctggctctcaggtgtcagatgtgtcatccagatgacccagtcctccttcctcctgtctgcatctatagganacagaatcacatcactgccggnagtcgagactattagctatgtatctgaattggatcagacaaaagtaggacacgacccctaatcctagactcctcgatcgctactccctacgtttggacgtacgacggggtacccagtaccgtaaggttcgaggtaggtaaggtcgggtctcggtaggggtaactaggttacttttacttcactatcagcgaggctcgcacgccgtagaagtnttagttagactaaactagttaactttacgtagtaactaacgtaagttaataacgttccgtacctcccgtactccgtcgggttccggggacgggggttaccgtaagggttcggaagtacgttacgaaggcgtaacgtggtcggactcggacctaacgttgtttccg

SEQ ID NO: 404867 - DNA, 496 bp, Homo sapiens
  misc_feature: GZ8MTXP01BZYSM.52.19.B08.1.454.CMB.2.raw
  modified_base (400)..(400): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcagtcgagacattagcatgtatctgaattggatcagacaaaaagtagggacacgacccctaaactcctgactcctcgatgcatccactttggagacgaggggtcccagtccaaggttcagtggaagtggactcgtgggactagtacttttacttcaccatcagcaggctgcagctagagatgtgacaacnttaattactgtacaaatagtataatcgtctcccgtctctacgttcggggcggggactagggttgagattacgagcgaatgcgctgctaaccttgtc

SEQ ID NO: 404868 - DNA, 577 bp, Homo sapiens
  misc_feature: GZ8MTXP01BW7F6.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggcagtcgagactattagctatgtatctagtaattggatcagaacaaaagtaggacacgacccctaatcctgactcctgatgcatcctagtttggagacgacgggtcccataccgaggttcgaggtaggaagtcggctcgtagggactagttactttacttcacctatcagacacggctcggcacgccttagaagtagtagttaacaactaactagttacttacgtacgtaactaagtagtaactacgtccgtccgtccgtacgtaccgtacgggttaacggggaacggggttaacgtaagggttacgtaacgtacgttaacggacgttacgtaacgtcggtaacgtcgtacgttacctaacgttcgtcg

SEQ ID NO: 404869 - DNA, 578 bp, Homo sapiens
  misc_feature: GZ8MTXP01DVJ6D.52.19.B08.1.454.CMB.2.raw
  modified_base (256)..(256): a, c, t, g, unknown or other
  modified_base (296)..(296): a, c, t, g, unknown or other
  modified_base (483)..(483): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggagcgtggtccagcctgggaggtccctgagactctcttgtgctgcctntggattcacttcagggtctatgacatgcactggggtcccncagctcgaggcgaaggggctgggagtgggtgctattatatacatatgagtaggaaagacaagaataataactatagtagacgtacgtaggaagggacgtatactatactactctacacgaagaacaaactaccgaacgaaacgaacgtacgtagtactactagacaaagtaagactacgacggacgngaagaagacgtacgaaacgaacgtaacggttacgtttattaactttaacttagtaacgtaacgtaaacgttaaacgtaacgttaacggtaacggg

SEQ ID NO: 404870 - DNA, 512 bp, Homo sapiens
  misc_feature: GZ8MTXP01CFOWN.52.19.B08.1.454.CMB.2.raw
  modified_base (399)..(399): a, c, t, g, unknown or other
  modified_base (415)..(415): a, c, t, g, unknown or other
  modified_base (507)..(507): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcacatcacttggccgggcagtcgagacattagcatgtatctagaattggatcagacaaaaaggtaggacacgacccctaaactcctgactcctcgatgcatccgtatttggagacgacggggtccagtaccgaggttcgagtggaagtggctgtgggactagttatttacttcactatcagctaggctgcagcctagagtatgttnactaactatagttacngtacaactagtatatccgtcctccgtctcgtacggttccgggcggggttacaggttggacgtgacgagcgtaactggtcgcgtcgactccgnttccg

SEQ ID NO: 404871 - DNA, 499 bp, Homo sapiens
  misc_feature: GZ8MTXP01BTQT8.52.19.B08.1.454.CMB.2.raw
  modified_base (186)..(186): a, c, t, g, unknown or other
  modified_base (382)..(382): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcagtcgagacattagcatgtatctgaattggatcagacaaaaagtagggacagacccctaaactccttatcctcgatgcatccactttggagacgagggtccatcaaggttcagtggaagtggctctgggacagtattttactttcactatcagcaggctgcagcctgaagntgttgacaacatattactgttacaaactagtataatcgtactcccgtctctacgtttcgggaacgggggtaccaagggtcggagatcgaagcgaacgtgtggctgcacaattcgttc

SEQ ID NO: 404872 - DNA, 533 bp, Homo sapiens
  misc_feature: GZ8MTXP01AZOBM.52.19.B08.1.454.CMB.2.raw
  modified_base (296)..(296): a, c, t, g, unknown or other
  modified_base (338)..(338): a, c, t, g, unknown or other
  modified_base (354)..(354): a, c, t, g, unknown or other
  modified_base (366)..(366): a, c, t, g, unknown or other
  modified_base (428)..(428): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagcctgggagtccctgagactctcttgtgctgcctctggattcaccttcagggtctatgacatgcacgtgggtccnccaggctccgaggcaagggggctgggagtgggtgctatttanatcatatgatggaaancaagatatactntgtagactcgtgaggcatcatcatctcagacgacaactcgagaacgacgtctgtatccgtanactaatgactcgaggcgtaggaagacgacgtagaaacgtacgtacggttacttattacttaacgtgtaacgtacgtaaacgttacgtaaccggaacgggtaacgg

SEQ ID NO: 404873 - DNA, 526 bp, Homo sapiens
  misc_feature: GZ8MTXP01AS9FW.52.19.B08.1.454.CMB.2.raw
  modified_base (298)..(298): a, c, t, g, unknown or other
  modified_base (341)..(341): a, c, t, g, unknown or other
  modified_base (357)..(358): a, c, t, g, unknown or other
  modified_base (459)..(459): a, c, t, g, unknown or other
  modified_base (461)..(461): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggaggcgtggtccagcctgggaggtccctgagactctcttgtgctgcctctggattcaccttcagggtctatgacatgcactgggtcccnccaggctccgaggcaagggggctgggagtggggtgctatttanatcatatgatggaaannaagatatactatgtagactcgtagacgggccgattcatcatctaccagagacaactcgaacgaacacgctagtatctgacaaatgaatcgaggctggaagngntaggaagtacgacggttctttattatttaacgtgtcgtacgtaacttaatccgttaaccggaagg

SEQ ID NO: 404874 - DNA, 502 bp, Homo sapiens
  misc_feature: GZ8MTXP01EF0SW.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggcagtcgagacattagcatgtatctgaattggatcagacaaaaagtgggacagcccctaaatcctgatcctcgatgcatccactttggagacgaggggtcccatccaaggttcagtggaagtggctcgtgggactagtattttacttcacatcagcaggctgcagctagaagatgttgactaacagttattactgtacaaactagtataactcgtctccgctctacgtttcgggcgggggaccaagggttggagtacttacgagcgaactggtggctggctaaccgttgttccg

SEQ ID NO: 404875 - DNA, 581 bp, Homo sapiens
  misc_feature: GZ8MTXP01DXYC5.52.19.B08.1.454.CMB.2.raw
  modified_base (211)..(211): a, c, t, g, unknown or other
  modified_base (390)..(390): a, c, t, g, unknown or other
  modified_base (395)..(395): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggngagtcgagacattagcatgtatctgaattggtatcagacaaaaaagtagggacaacgcccctaaatcctgatcctcgatgcatccatttggagacgaggggccatccaaggttcagtggaagtggctcgtgggactagtacttttacttcacatcagcaggctgctaacgcttagaagnttgtnacaaactagttaatttactgtaacaaactaagtacttaaacgtccgtcctaccccgtctaccgttacggtttaaccggggcggggggttaacccgtaaagggggttcggaaagacggtttaacgaaacgggaccggtaaaccggttggtcggggttacccgtacgacccgtaaccgttcgtttccg

SEQ ID NO: 404876 - DNA, 543 bp, Homo sapiens
  misc_feature: GZ8MTXP01B2NSB.52.19.B08.1.454.CMB.2.raw
  modified_base (186)..(186): a, c, t, g, unknown or other
  modified_base (211)..(211): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggnagtcgagacattagcaatgtatctagaattggatacagacaaaaagtagggacacgacccctaaactcctgactcctcgatgctatcctacgtttggagtacgaggggtcccagtaccgaaggttcagtgaagtgctgtgggactagtactttactcacatcagtcaggctagcagctagaagtatgttacgactaaactagttaacttacgtagtaccaaagtagtaactaaatccgtctcccgactcgtacgttccggggacggggttacagggttggaaagtcttacgagaccggtaagtgtgggtacctcgttacctaacgttcgtcg

SEQ ID NO: 404877 - DNA, 498 bp, Homo sapiens
  misc_feature: GZ8MTXP01DE2RF.52.19.B08.1.454.CMB.2.raw
  modified_base (391)..(391): a, c, t, g, unknown or other
  modified_base (462)..(462): a, c, t, g, unknown or other
  modified_base (467)..(467): a, c, t, g, unknown or other
  modified_base (495)..(495): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggcagtcgagacattagcatgtatctgaattggatcagacaaaaagtagggacacgacccctaaatcctgactcctcgatgcatcctacttggagacaggggtcccatccaaggttcagtaggagtggctcgtgggacagtatttacttcacatcagctaggctgcagcctagaagtatgttanactaatagttacttactagtacaatataactacgtctcctccgtctcgtcggttcggggcgggacgtaggngaganacgagacgtaagtggcgctgactaacgngtc

SEQ ID NO: 404878 - DNA, 584 bp, Homo sapiens
  misc_feature: GZ8MTXP01CA8CW.52.19.B08.1.454.CMB.2.raw
  modified_base (155)..(155): a, c, t, g, unknown or other
  modified_base (171)..(171): a, c, t, g, unknown or other
  modified_base (257)..(257): a, c, t, g, unknown or other
  modified_base (298)..(298): a, c, t, g, unknown or other
  modified_base (341)..(341): a, c, t, g, unknown or other
  modified_base (360)..(361): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttccncgttgctcttttaagnggtgtccagtgtcaggtgcaactggtggagtcgtggggggagcgtggtccagcctggggagtccctgagctctctgtgctgccctntggattcaccttcagggtctatgacatgcacgtgggtcccncaggctccgaggcaagggggctggggagtggggtgctatttanatcatatgatcgggaaaannaagtatatactatgtacgacgtcgagaacggctatacatctactcctacaacgaacaccaaccgtaccgaacgaaccgacgtcttagtactcgtacgactaaagtcgagtcgaggcgtaggaacggtacgttacgtaacggaaacgtaaccgtacgtttatttaattacgttaacgtgtaacgtaaccgttaaacgttaacgtaaccgggaacgggtaaccgg

SEQ ID NO: 404879 - DNA, 578 bp, Homo sapiens
  misc_feature: GZ8MTXP01CMZOP.52.19.B08.1.454.CMB.2.raw
  modified_base (186)..(186): a, c, t, g, unknown or other
  modified_base (211)..(211): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggngagtcgagacattagcatgtatctgaattggatcagacaaaagtagggacacgacccctaaactcctagactccgtacgatgacatccctacgtttggacgacgacggggtcccagtacccgtaaggttcgaggtaggaacggtgggtcctcgtagggtaacctaggttacttttactttacacctatcagcagggctagcagtccgtagaagtattgttacactaactagttacttactagtacaaactagtaataacgtccgtcctacccgtcttcgtacggtttcgggacgggggaacccgtagggttacggaagcgttacgaggacgtaaccgtgtcggtactcggacctaaccgttcttccg

SEQ ID NO: 404880 - DNA, 503 bp, Homo sapiens
  misc_feature: GZ8MTXP01DWGIL.52.19.B08.1.454.CMB.2.raw
  modified_base (186)..(186): a, c, t, g, unknown or other
  modified_base (435)..(435): a, c, t, g, unknown or other
  modified_base (486)..(486): a, c, t, g, unknown or other
  modified_base (491)..(491): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcagtcgagacattagcatgtatctgaattggatcagacaaaaaagtgggacacgacccctaaatcctgactcctcgatgcatccctactttggagacaggggtcccatccaaggttcagtggaagtgggctcgtgggactagtatttacttcacatcagcaggctgcaggctgaagatgtagactaacagttaattactgttacaatagtataatcgtctcccgntcgacgtttcgggcgggggacaagggttgaagtcttacgagcgtaacgtgnggtcngactaacttgtc

SEQ ID NO: 404881 - DNA, 549 bp, Homo sapiens
  misc_feature: GZ8MTXP01DW4UN.52.19.B08.1.454.CMB.2.raw
  modified_base (299)..(299): a, c, t, g, unknown or other
  modified_base (340)..(340): a, c, t, g, unknown or other
  modified_base (347)..(347): a, c, t, g, unknown or other
  modified_base (357)..(357): a, c, t, g, unknown or other
  modified_base (428)..(428): a, c, t, g, unknown or other
tcagcgcagtacgacacgaccggtgctcgatttagtgagtcagtaaggggtctgggagaggaacccagcactagaagtcggcggtgcttccattcggtgatcagcactgaacacagaggactcaccatggagtttgggctgaactgggttttcctcgttgctcttttaagaggtgtccagtgtcaggtgcaactggtggagtcgtggggggaggcgtggtccagcctggggaggtccctgagactctcttgtgctgcctctggattcaccttcagggtctatgacatgcactgggtccncaggctccaggcaagggggctgggagtgggtggctatttanatcatanggatgggaancaaaagataatactatgtaacgacctccggtaggaacgggccgtattcatcaatctaccagacgaacaacnccgaagaacacgctgtaactctagacaatagatacagcgtagagagctagaagacgacggtactttattattacttagtgtacgtaacttaactacgttacggaacggaacgtaacccggg

SEQ ID NO: 404882 - DNA, 512 bp, Homo sapiens
  misc_feature: GZ8MTXP01DG99N.52.19.B08.1.454.CMB.2.raw
  modified_base (185)..(185): a, c, t, g, unknown or other
  modified_base (209)..(209): a, c, t, g, unknown or other
  modified_base (398)..(398): a, c, t, g, unknown or other
  modified_base (509)..(509): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagaatcaccatcacttgccggnagtcgagacattagcatgtatctgaattggatcagacaaaaaagtgggaacacgacccctaaatcctgactcctcgatgcatcccattggagacgacggggtcccagtcccaaggttcaggtcgaagtgggctcgtgggacagtatttacttcactatcagtcaggctgacagcgtagaagtatgttanaacaactattacttactatacaactagtatacgtccgtctccgctcgtacggttcgggacggggacgtaggttagagtacgacgacgacgaagtgtcgctgactaacgttntcg

SEQ ID NO: 404883 - DNA, 629 bp, Homo sapiens
  misc_feature: GZ8MTXP01B5HZF.52.19.B08.1.454.CMB.2.raw
  modified_base (189)..(189): a, c, t, g, unknown or other
  modified_base (215)..(215): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgacccagtcctccttcctccctgtctgcatctagtagganacagaatcaccatcacgttgccgggngagtcgagactattagctatgtatctagtaattggtatacgaagaacgaaaaaggtacggacaccgtacccctaaactcctagactcctacgatcgactactacctacgtttggacgacgtacggggtaccagtaccgtaggttgaggtaggtaagtcgggtactcggtagggtactagtttacttttaccgttacaactactcgagcgacggtctacgacgacgtaccgtagaaagtcgttagttacaactaactagttaacttaacgtacgtaaactaacgtaagttaactaacgttcccgttccgtcccgtcgtaccgttacgggttccgggggacggggttaacgtaagggttacggaagtacgttacgttacggacgtaagtggtcgtcgtcgactaaccgttgttccg

SEQ ID NO: 404884 - DNA, 595 bp, Homo sapiens
  misc_feature: GZ8MTXP01C6Q2G.52.19.B08.1.454.CMB.2.raw
  modified_base (211)..(211): a, c, t, g, unknown or other
  modified_base (578)..(578): a, c, t, g, unknown or other
tcagcgcagtacgacacgaccggtgctcgatttagtgagtcagtaaggggcagtcccaaccaggacacagcatgaacatgagggtccctgctcagctcctggggctcctgctgctctggctctcaggtgtcagatgtgtcatccagatgacccagtctccttcctccctgtctgcatctataggagacagaatcaccatcacttgccgggnagtcgagacattagctatgtatctgaattggtatcaagtaacgaaaaaagtagggaaccaacgaccccctaaaactcctagactaccctcgaatgacctactccctaacgtttgggacgtaacgtacgggggtacccagttaccgaaagggttcaggtaggtaaggtcgggccttcggtaggggtaacctaaggtttacttttaccttcacctattccagcagggctgctaacgtctagaaacgtattgtagactaactattattactagtaccaatagtaataagtcccgtctcccgtcttccgcggtttcggggcggggttaacgtaagggttggaacgtattacgagacgtaacgtggcggtcncgactaacttgtttccg

SEQ ID NO: 404885 - DNA, 564 bp, Homo sapiens
  misc_feature: GZ8MTXP01C0W7W.52.19.B08.1.454.CMB.2.raw
  modified_base (186)..(186): a, c, t, g, unknown or other
  modified_base (208)..(208): a, c, t, g, unknown or other
  modified_base (389)..(389): a, c, t, g, unknown or other
  modified_base (413)..(413): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcacatcactgccggnagtcgagacattagcatgtatctgtaattggatcaagacaaaaagtacggacacgccctaaactccttatcctgatcgcatccacgtttggacgtacgacggggtacccataccgtaaggttcaggtggaagtggacttgtggggaactagttacttttacttcacctatcgagcaggtcngacagtacgtagaagtagtgttanactaactattaacgttactagtaacaactagtactactccgtacctccgtctccggtacgggttccggggaacggggtaacgttagggtaggagtacgtaacggaacgttcgttaacgttcggtacgtcgtcgaccttactcgttccgttg

SEQ ID NO: 404886 - DNA, 607 bp, Homo sapiens
  misc_feature: GZ8MTXP01B341M.52.19.B08.1.454.CMB.2.raw
  modified_base (124)..(124): a, c, t, g, unknown or other
  modified_base (209)..(209): a, c, t, g, unknown or other
  modified_base (397)..(397): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctnaggtgtcagatgtgtcatccagatgacccagtctccttcctcctgtctgcatctataggagacagaatcacatcacttgccgggnagtcgagacattagctatgtatctagaattggatcaagaacaaaaagtggaacacgacccctaaatcctgactcctcgatcgctactcctacgtttggaacgaccgacggggtcccaataccgaacggttgaagtggaagtgctcggtagggtactaggtacttttacttcacctatcagacgaggcngcgacgtcgtagaagtagtacgtacactaactaacgttaacttaacgttacgtaacgtaaactaagtaacgttaacgttaccgttccgtccgtaccgtccgtaccggttaacggggtaccggggttaaccgggtaacgggttaggtaacgtaacgttacgaacgttacggtaacgtacggtcggtcgtacgaccgtaaccgttaacgtcg

SEQ ID NO: 404887 - DNA, 587 bp, Homo sapiens
  misc_feature: GZ8MTXP01A3PBI.52.19.B08.1.454.CMB.2.raw
  modified_base (210)..(210): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctcctgtctgcatctataggagacagaatcacatcacttgccgggngagtcgagacattagcatgtatctgaattggatacaagacaaaaaggtacggaacacgacccctaaactcctagactcctcgaattcgctactccctacgtttggaacgacgacggggtcccaagttaccgaaggttcgaggtggtaagtcgggtctcgtagggactagttactttacttcgactatcagcgagtctagcacgctagaagtattgtacgactaacattaagttacctagtaaccaaagtagttaactaacgttccgtaccttccccgtcttacccgtacggttaacgggggacggggacctaaagggttggaacgtaagttacggaacgacgtaacgtggtcggtctacggacctaaccgttgttcg

SEQ ID NO: 404888 - DNA, 728 bp, Homo sapiens
  misc_feature: GZ8MTXP01ENGFF.52.19.B08.1.454.CMB.2.raw
  modified_base (186)..(186): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctcctgtctgcatctatagganacagaatcacatcacttgccggcagtcgagacattagctatgtatctagtaattggtatacgaagaacaaaaaggtagggaccaaccgtacccccttaaaactcctacgtactcctacgtactgacctacttacccgtaacgtttagggacgtaaccggtacggggtacccctaagtacccgtaaggttacgaagggtaggtaacggttcgggacctcgggtacggggtaaacttaacggtttaaccttttttaaccgtttaccaactacgttacgaacggtacctaagggcttacgacgtacgtaccgtagtaagtagttaggttacaactaaacttacgggtttaaattacttaaggtaacccttaaagtaaccgttaaataaccgtttccggtccctaccccgttacgtaccgggttaaccgggtttcggggggaaccgggggttaaccgtaaggggttacggaaagtaacgttacggaaacggttacccggtaaagtcgggtaacgtccgttacggacctaaacccttggttttcccg

SEQ ID NO: 404889 - DNA, 762 bp, Homo sapiens
  misc_feature: GZ8MTXP01AO8VY.52.19.B08.1.454.CMB.2.raw
  modified_base (187)..(187): a, c, t, g, unknown or other
  modified_base (213)..(213): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcaccatcacttggccgggngagtcgaagactattagctatgtatctagtaattggatacaagaacgaaaaaggtaggacacgacccctaaactcctagactcctgaattcgactactaccctaagttttagggacgtaccggtaacggggtccctaagttacccgtaaagggtttcgaagggtagggaaacggtcgggtaccgttcggtacggggtaaacctaagggtttaacttttttaacctttaccaaaccctagttaccgaaagtccgaggtcgtacgacgaaccggtaccgttaaggaaagtacgttaggttaacgaaccgtaaaaccttaagtttaactttaaaccggttacgtttaaacccaaaacggttaagtttaaacgttaaacctttaccccgggttaccccttacccccgggttctttaccccggttaaccgggggttttcccggggggaaccccggggggttaacgaaacgggggttcggaaaggtaacgttaaccggaacggttaccggtaaccgtgggtccggttcgtacggacccgtaaccgttcgtttccg

SEQ ID NO: 404890 - DNA, 621 bp, Homo sapiens
  misc_feature: GZ8MTXP01AL24Y.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcagtcgagacattagcatgtatctgaattggatcagacaaaagtaggacacgcccctaaactcctagactcctcgatcgctatccctactttggagacgtagggggtcccagtacccgaaggtttcaggtggaagtcggtctcgtggggtaacagtttatttacctttacactattccagtcgaggcctagcagcctgaagattgttacgactaaactagttactttaacgtatacctaaactagttaaattaacgtccgttcccctcccggtacttaccggttccggtttaacccgggggccggggggttaacccgtaaaggggttccgggaaagtaacgttacggaaacggttacccggtaaacgttgggtcgggtaaccttcgggaccctaaacccggttttcgtccg

SEQ ID NO: 404891 - DNA, 530 bp, Homo sapiens
  misc_feature: GZ8MTXP01BU8LF.52.19.B08.1.454.CMB.2.raw
  modified_base (185)..(185): a, c, t, g, unknown or other
  modified_base (210)..(210): a, c, t, g, unknown or other
  modified_base (391)..(391): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagaatcaccatcacttgccgggnagtcgagacattagcatgtatctgaattggtatcagacaaaaagtagggacacgacccctaaactcctagactcctcgatgcatccactttggacgacgaggggtcccatccaaggttcagtggaagtggctgtgggactagtattttacgttcacatcagtcaggctgcagcctagaagntgttgacaactattattactagtacaaactagtaattaagtccgtcctcccgtcttccgtaacgtttcggggacgggggttaccaaagggttggaagattacgaaggcgaacgtggtcggctggactaaccgaattccg

SEQ ID NO: 404892 - DNA, 570 bp, Homo sapiens
  misc_feature: GZ8MTXP01BDKSO.52.19.B08.1.454.CMB.2.raw
  modified_base (355)..(355): a, c, t, g, unknown or other
  modified_base (408)..(408): a, c, t, g, unknown or other
  modified_base (562)..(562): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcacatcacttgccgggcagtcgagacattagcatgtatctgaattggatcaagacaaaaagtagggacacgacccctaaactccgtgactcctacgatgctatcccacgttttgggagacgacgggggtacccataccgaaggttcaggtaggagtggctgngggacagtacttttacttacactatcagccaggctgcagcttagagattggtnacaactagtaattactgtacaatagtaataattccgtacctcccgtacttctacccggtttcgggggacgggggaaccgtaaggggttggaaacgtacgttaacgaacgggttcgtaaaccgtgggttcgggaccgtacggacctaaccggttntttcccgg

SEQ ID NO: 404893 - DNA, 803 bp, Homo sapiens
  misc_feature: GZ8MTXP01AW9NJ.52.19.B08.1.454.CMB.2.raw
  modified_base (187)..(187): a, c, t, g, unknown or other
  modified_base (214)..(214): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcaccatcacgttggccgggngagtcgagacattagcatgtatctgaattggatacgaagaacgaaaaaaggtacgggaaccaccggaccccttaaactcctagtaactcccgtacgactcgaccacgtttacccgtacgtttttacggggaacggtaacccggtaacggggggtaccccctaagtttaaccccggtaaacgggtttaccggaacgggttagggggtaaacggttcggggttacccgttaacggttacggggggtaaacctttaaacgggtttaaaccgttttttttaccccgttttaacaaaccccggtaaactttacccgtaacggacccgggtaacggggtccgttacggaccgtaaccggtacccgttaggtaaaggtacgttagttacggaaactaaaccgttaagttaacttttaaccgtagttaacctaaacgttaaaggttaacttaaccgtacccggtttccctaccccggtacctttaccggtcccgggtttaacgggggaacccgggggaccggtaaaggggttcgaaagtacgttaacggacggacggtaacggtggtcggtctcggacctaaccgttaaggtttccg

SEQ ID NO: 404894 - DNA, 580 bp, Homo sapiens
  misc_feature: GZ8MTXP01DNLIA.52.19.B08.1.454.CMB.2.raw
  modified_base (186)..(186): a, c, t, g, unknown or other
  modified_base (212)..(212): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttggccgggngagtcgagacattagcatgtatctgaattggatcaagacaaaaaagtgggaacacgacccctaaactcctgactcctcgatgcatccctatttggagacgacggggtccataccgaaggttcagtggaagtggctcgtgggactagtacttttacttcacctatcagcaggctgcagcctagaagtagtgttacgactaactattaacttacgtagtactaactaagtattaacgtccgttcctcccgtactcgtaaccggttttcggggaccgggggaaccgtaagggttacggtaagtgttaacccgaaggttaccgtaaaccggttggtcggggttctacggaccgtaaccgttaagttttcccg

SEQ ID NO: 404895 - DNA, 546 bp, Homo sapiens
  misc_feature: GZ8MTXP01BU52L.52.19.B08.1.454.CMB.2.raw
  modified_base (256)..(256): a, c, t, g, unknown or other
  modified_base (296)..(296): a, c, t, g, unknown or other
  modified_base (337)..(337): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagcctgggagtccctgagactctcttgtgctgcctntggattcaccttcagggtctatgacatgcacgtgggtccnccaggctccgaggcagggggctgggagtgggtgctatttanatcatatgatcggaaagcaagataatactatgtagactccgtagaacgggcgtatcatcatctaccagacgaaccaacgtacgaacgaacacggtctagtactactcgataagtgatcgaggtctgaacgagacgtaggaaagtaccgtacggttactttacgttagttctaggtcgtacgtaaacgttactaacgaacgggtaaccgg

SEQ ID NO: 404896 - DNA, 604 bp, Homo sapiens
  misc_feature: GZ8MTXP01D7OC8.52.19.B08.1.454.CMB.2.raw
  modified_base (213)..(213): a, c, t, g, unknown or other
tcagcgcagtacgacacgaccggtgctcgatttagtgagtcagtaaggggcagtctcaaccaggacacagcatggacatgagggtccctgctcagctcctggggctcctgctgctctggctctcaggtgtcagatgtgtcatccagatgacccagtcctccttcctccctgtcctgcatctataggagacagaatcacatcacgttgccgggngagtcgagacattagcatgtatctagtaatggtatacaagaacgaaaaaaggtacgggaaccaccgtaccccctaaactcctagaactcctacgatgactactcctacgtttggacgacgacggggtacccagtacgtaaggttcgaggtaggaaagtcgcgtcgtagggaactagttattttacttcacctatcgagcgaggctgacagtctagaagtatgtacgactaatatttaattactagtaacaactagttaactaacttccgtccgtcccgtacttccggtaaccggtttcgggggaccgggggtaaccgttaaggggtacggaagttacggttacgaaacggtccgtaaagttgggtacgcgttacgaacccttaaccgttaa

SEQ ID NO: 404897 - DNA, 543 bp, Homo sapiens
  misc_feature: GZ8MTXP01AFC4B.52.19.B08.1.454.CMB.2.raw
  modified_base (268)..(268): a, c, t, g, unknown or other
  modified_base (296)..(296): a, c, t, g, unknown or other
  modified_base (345)..(345): a, c, t, g, unknown or other
  modified_base (353)..(353): a, c, t, g, unknown or other
  modified_base (363)..(363): a, c, t, g, unknown or other
  modified_base (387)..(387): a, c, t, g, unknown or other
  modified_base (493)..(493): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagcctgggagtccctgagctctcttgtgctgcctctggattcaccttnagggtctatgacatgcacgtgggtcccnccgaggcctccgagggccaagggggctggggaggtggggtgctatttanatccaatntgatggaaancaagatatactatgtagactccgngaagggcctatcatcatctacagacgacaactcgaagaacagctgtactcgtagacaaatgactcgagcgtggaacgagacgtagaaagtaccgacggttactttnttacttaaccgttgtaacgtaacgttaacttagtccgaacggggtaacgg

SEQ ID NO: 404898 - DNA, 786 bp, Homo sapiens
  misc_feature: GZ8MTXP01AHHZJ.52.19.B08.1.454.CMB.2.raw
  modified_base (187)..(187): a, c, t, g, unknown or other
  modified_base (212)..(212): a, c, t, g, unknown or other
  modified_base (247)..(247): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcacatcacttggccgggngagtcgagacattagctatgtatactaaatggtancaagacaaaaggtacggacacgacccctaaactcctagactcctgactgacctacttcccgtaacgttttgggaacgtaccggtacgggggtacccctaagtaccgtaaacgggtttaccgaagggttagggtaaacggtcgggtaaccgttacccgggttaagggggtaaacctttaaacgggtttaaacgtttttttaacccgttttaaccccgaacccgtaacttacccggaaacggttacccgtaaacggggccgttacgggacccgtaaacggtaccccggtttaagggaaacgtttaacgtttggggtttaaccgaaacctaaaaccgtttaagtttaaaccggtttaaacccttagggttaaaccctaaaacccgttaaggttaaacgttaaccttacccggtttcccgtaccccggtacgtttacccggtaaccggggtttccgggggaaccgggggtaaccgttaggggttacgaggtacgtacgaacggttcgaacgtggtacggctacgacttacctaacttcgttcg

SEQ ID NO: 404899 - DNA, 605 bp, Homo sapiens
  misc_feature: GZ8MTXP01DUKHW.52.19.B08.1.454.CMB.2.raw
  modified_base (124)..(124): a, c, t, g, unknown or other
  modified_base (134)..(134): a, c, t, g, unknown or other
  modified_base (188)..(188): a, c, t, g, unknown or other
  modified_base (213)..(213): a, c, t, g, unknown or other
  modified_base (345)..(345): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctnaggtgtcagntgtgtcatccagatcgacccagtctccttcctcctgtctgctatctagtagganacagaatcacatcacgttggccggngagtacgagactattagctatgtatctagtaattggtatacaagaacgaaaaagtaggaccaacgacccctaaactctagctctacgatgctatccgtagttggagacgacgggtacctagtacgtaaggtntaggtaggtaagtcggactggtagggaacttaggtttactttaccttacacgtactacgagtcagggtctagacacgtacgtagtaagtgtagttacaacctaatacgtttaattacgtagtaaacctaaataacgttacttaacgttcgtacctcccgtataccgttaaccgggttcggggaacgggggttaaacctagggttaggaactagttaaccggagaccgtaagtgtaacgctagacctaacgttaacgttcg

SEQ ID NO: 404900 - DNA, 617 bp, Homo sapiens
  misc_feature: GZ8MTXP01BMZRC.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgtaattggtatcagacaaaaagtagggacacgacccctaaactcctagactcctcgatgctatccgtagtttggagacgacggggtccccagtaccgtaagggttcaggtaggaagtggctcgtcggggactagtattttacgttcacctatcagctaggctgacacgtactagtaagtattagttagaacctaaagtaacgttaactttaaacttggtaaaccctaaatacggtaaacttaacgttcccggtcctcccggtacttaccgtacccgggtttccgggggaaccggggggttacctaaggggttcggaacgtacgttacggaacggttacgtaaccgtggttcgggcttacgggcctaaccttcggttttcccg

SEQ ID NO: 404901 - DNA, 545 bp, Homo sapiens
  misc_feature: GZ8MTXP01B9M6V.52.19.B08.1.454.CMB.2.raw
  modified_base (257)..(257): a, c, t, g, unknown or other
  modified_base (296)..(296): a, c, t, g, unknown or other
  modified_base (298)..(298): a, c, t, g, unknown or other
  modified_base (301)..(301): a, c, t, g, unknown or other
  modified_base (313)..(313): a, c, t, g, unknown or other
  modified_base (317)..(317): a, c, t, g, unknown or other
  modified_base (322)..(322): a, c, t, g, unknown or other
  modified_base (324)..(324): a, c, t, g, unknown or other
  modified_base (330)..(330): a, c, t, g, unknown or other
  modified_base (337)..(337): a, c, t, g, unknown or other
  modified_base (347)..(347): a, c, t, g, unknown or other
  modified_base (349)..(349): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagcgtggtttccgcgtagctctttaagaggtgtccagtgtcaggtgcaactggtggagtcgtgggggaggcgtggtccagccgtgggaggtccctgagactctcttgtgctgcctntggattcacttcagggtctatgacatgcactgggccccncngcncgaggcgagggntggngtggngntattanatcatangataggaaananaagataatacgtagtagtacgacgtcggtaggacggtcgtatcatactactcacgagacgaacacgtacgaacgaacgacgtctagtactctagacaagtagtacgtagagacgagaagagacgtagaacgtaacgtacgttacgttattagttaagtagtaacgtacgtaacgttaacgtaacgaacggtaacgg

SEQ ID NO: 404902 - DNA, 599 bp, Homo sapiens
  misc_feature: GZ8MTXP01DGN26.52.19.B08.1.454.CMB.2.raw
  modified_base (212)..(212): a, c, t, g, unknown or other
  modified_base (549)..(549): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttggccgggngagtcgaagacattagctatgtatctgaattggtatacagacaaaaaggtagggaacacgacccctaactcctgactcctcgatgctactcctacgtttggacgtacgacggggtacccactaccgtaaggttacgaggtaggaaggtcgggtcttcggtacggggtaactaaggtttacttttaccttacaacctataccgagactagggtctcgacgtacgtccgtaagtaagtacgtagttacgaactaacctatttaactttaccgtagttaacaaatagtaattacgtcgtacctcccgtctccgtcggttcgggacggggaccgtaagggngagtattacgagaccgtaagtgcggtactggacctaacgttaactttccg

SEQ ID NO: 404903 - DNA, 634 bp, Homo sapiens
  misc_feature: GZ8MTXP01A14WS.52.19.B08.1.454.CMB.2.raw
  modified_base (186)..(186): a, c, t, g, unknown or other
  modified_base (211)..(211): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggnagtcgagacattagcatgtatctgaattggatcagacaaaagtagggacacgacccctaaatcctagactcctacgattcgccacttcccgtaacgttttgggacgtaaccgacgggggtccccaagttacccgaagggttacaggttgggaaacgtgggactcggtaggggtaacctaggttactttttaccttacaactatacagcagggtctgcgtaagcctagaacgtagttgttacactaactattaattacgtagtacaaactagttactaactccggtacctcccgtacttaccgtaccgggtttccgggggaccggggggttaactaaacggggttggtaaacggtaacttacggaaacggccgtaaacggtttcggcgggtaaccgtcggaaccctaacccgttaagtttcccg

SEQ ID NO: 404904 - DNA, 647 bp, Homo sapiens
  misc_feature: GZ8MTXP01EO5HL.52.19.B08.1.454.CMB.2.raw
  modified_base (448)..(448): a, c, t, g, unknown or other
  modified_base (599)..(599): a, c, t, g, unknown or other
  modified_base (607)..(607): a, c, t, g, unknown or other
  modified_base (615)..(615): a, c, t, g, unknown or other
  modified_base (625)..(625): a, c, t, g, unknown or other
  modified_base (643)..(643): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgacccagtcctcccttcctcctgtctgctatctagtaggagacagaatcaccatcacgttcggccgggagagtcgagactattagctatgtatcgtagtaattggtatacgaagtaaacgaaaaaggtacgggaaccaccgtaacccctaaactcctagtactcctacgtatcgactactcccgtaagtttacggacgtaccggtacgggtaccctagtaacccggtaggtagtaggtaggaagtcgggtactcggtagggacttagtttaactttttaccttacactatcgagtacgngggtcctgacgacggtccgttaaggaagttagttcgtaacaactaaactagttaactttacgtaactaactaaacgtaagttaacttaacctccgttcccgtacccgtcgttaccgttccggggttaacgggggacggggacctaaggggngtaaacgnttaaccgngaccgtaagnggtcgctgactaacgttnttcg

SEQ ID NO: 404905 - DNA, 712 bp, Homo sapiens
  misc_feature: GZ8MTXP01DFKIJ.52.19.B08.1.454.CMB.2.raw
  modified_base (186)..(186): a, c, t, g, unknown or other
  modified_base (279)..(279): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccggcgagtcgagacattagcatgtatctgaattggatcagacaaaaaggtagggacacgacccctaaactccngtactcctacgatgactacttcctaacgtttagggaacgtaacgtacgggggtacccctaagtacccgtaaagggttacgaaggttgggaaacggttgggaccttcggtaggggtaacccgttaagggtttaacttttttaacccttaccgtaaccctaacttaccgaagcctaaggggtcccttagggccaaacggtcccgttaggaaaacgtagttagttacgaacgtaaaaccttatttaacgtttaacggttagtaacctaaacgtaagttaacgttaaacttccggttcctaccccgtaccgttaccgttaaccggttaaccgggggtaccgggggaacccgttaaagggttacggtaaagtacttacggaaacgttccggtaaaccgttgggtcgggtactcggttacctaaccgttaagtttcccg

SEQ ID NO: 404906 - DNA, 703 bp, Homo sapiens
  misc_feature: GZ8MTXP01CQMR2.52.19.B08.1.454.CMB.2.raw
  modified_base (210)..(210): a, c, t, g, unknown or other
  modified_base (293)..(293): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcacatcacttggccggngagtcgagacattagctatgtatctagtaattggatcgaagtacaaaaaggtagggacaacgacccctaaactcctgactccncgatcgactactacctacgttgggacgtacggtacggggtacccagtaccgtaaacggttcgagggtacggtaaggtcgggccttcggtaggggtaaccttaaggttaactttttaccttacctacctatacaacgacgaacgggtctacgacgacgtaccgtaggaaacgtacgttagttacggaaacctaaaccgttaagtttaaacgtttaacccgttagtaaaccgtaaaccgttaagtttaaaacttaccgttacccgttacccgttccccgtaccgttaccggttaccggggtttaaccgggggaaccgggggttaaaccgtaaggggttggtaaacggtacgttacgaaacggacccggtaaagtggtaacggtccgttacaccgtaaccgttaagtttcccg

SEQ ID NO: 404907 - DNA, 559 bp, Homo sapiens
  misc_feature: GZ8MTXP01CFX7N.52.19.B08.1.454.CMB.2.raw
  modified_base (187)..(187): a, c, t, g, unknown or other
  modified_base (447)..(447): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcaccatcacttgccgggcagtcgagacattagcatgtatctagaattggatcagacaaaagtagggacacgcccctaaatcctagactcctacgaattgactatccctaagtttggacgacgacggggtcccaagtccccgaaggttcaggtggaagtgggaccttggtgggacctagttattttaaccttcacctatcaagccgaggctggcaaggcctaagagtatggttaagactaactattattacgtntaactaagtagtaatacgtcgtcctccgtcgtacgtcggtaacggggacggggacgtaaggcggtaagtacgttacgacgacgtaagtggtcgtctcgactaacgttcgtcg

SEQ ID NO: 404908 - DNA, 512 bp, Homo sapiens
  misc_feature: GZ8MTXP01DLD58.52.19.B08.1.454.CMB.2.raw
  modified_base (247)..(247): a, c, t, g, unknown or other
  modified_base (294)..(294): a, c, t, g, unknown or other
  modified_base (337)..(337): a, c, t, g, unknown or other
  modified_base (354)..(354): a, c, t, g, unknown or other
  modified_base (450)..(450): a, c, t, g, unknown or other
  modified_base (456)..(456): a, c, t, g, unknown or other
  modified_base (473)..(473): a, c, t, g, unknown or other
  modified_base (486)..(486): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggagcgtggtccagcctgggagtccctgagactctcttgngctgcctctggattcaccttcagggtctatgacatgcactgggtccnccaggctccgaggcaagggggctgggaggtgggtgctatttanatccatatgatggaaancaagatatactatagtagactccgtagaaggccgattcattcatctaccagagaacaactccgaagaacgacgctgtatctgacaaatgatcaggntgaagngctagaagacacggttntttattattaacngtgacgtaattactcgaacggaacgg

SEQ ID NO: 404909 - DNA, 558 bp, Homo sapiens
  misc_feature: GZ8MTXP01ALOIH.52.19.B08.1.454.CMB.2.raw
  modified_base (275)..(275): a, c, t, g, unknown or other
  modified_base (404)..(404): a, c, t, g, unknown or other
  modified_base (409)..(409): a, c, t, g, unknown or other
  modified_base (426)..(426): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcagtcgagactattagcatgtatctgaattggatcagacaaaagtagggacacgacccctaaacncctgactcctcgattgcatcctagtttggacgtacgaggggtcccagtaccgaaggttcaggtaggaagtcgggtctcgtagggactagttacttttacttcactatcagcgagctgcagctagaacgnttgtnactaacattacttacgntaaccaatgtataagtccgtctcccgtacttcgtaccggtttcgggggccgggggttaacgaagggttcggaacgtcgttacgaaacggcggtaaaccgttgggcgggtctacggacctaaccgttcgttcg

SEQ ID NO: 404910 - DNA, 525 bp, Homo sapiens
  misc_feature: GZ8MTXP01ELB82.52.19.B08.1.454.CMB.2.raw
  modified_base (187)..(187): a, c, t, g, unknown or other
  modified_base (212)..(212): a, c, t, g, unknown or other
  modified_base (402)..(402): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcaccatcacttgccgggnagtcgagacattagctatgtatctgaattggatcagacaaaaagtagggacacgacccctaaactcctagactcctcgatgcatcccacgtttggagacgaggggtcccagtcccaaggttcaggtggaagtggactcgtgggactagtattttacttcactatcagcaggctgcagctagaagatgtanactaatatattactatacaatagtatacgtcctcctccgtctcgtacggttcggggacggggacgtagggttagaagtacgttacgacgacgtaagtggtcgtacgtcgacctaacgttgtcg

SEQ ID NO: 404911 - DNA, 571 bp, Homo sapiens
  misc_feature: GZ8MTXP01A3MJG.52.19.B08.1.454.CMB.2.raw
  modified_base (211)..(211): a, c, t, g, unknown or other
  modified_base (356)..(356): a, c, t, g, unknown or other
  modified_base (412)..(412): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttggccgggnagtcgagacattagcatgtatctgaattggatacgaagacgaaaaagtagggaacacgacccctaaactcctagactcctcgatgctactcctactttggagaccgaggggtccagtccgaaggttcaggtggaagtcggctcgngggactagttacttttacttcactatcagtcaggctgcacgctagaacgtatgttnactaagtagttaattacgtagtacctaaactagtaaacttaacttccggtacctcccggtacttccgtaccgggtttcggggaccgggggacctaaaggggttgaaacgtacttacgaaggacgtaacgtggtcgacttgacctaaccttaagtttccg

SEQ ID NO: 404912 - DNA, 704 bp, Homo sapiens
  misc_feature: GZ8MTXP01BQQCS.52.19.B08.1.454.CMB.2.raw
  modified_base (187)..(187): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcaccatcacgttgccggcagtcgagactattagctatgtatctagtaattggtatcaagtaacgaaaaagtagggacacgacccctaaactcctagactcctacgtatacgtactccgtacgtttggacgtacgacggggtcccaagtaccgtaaaggttcgaggtaggtaagtggtaacttcgtggggactaagttacttttaccttacacctagtccaagtcaagggtctcggcgagtacccgttaggaaagttagtaggttacgaacctaaacttaatttaacggtttaacgttaacgtaacccgtaaaacttaaggttaaacgttaacttacccggtttaccctccccgtacggtttaccccggtaacggggttttcccggggggaaaccggggggtaaacccgttaaacgggggttacgggaaagtaacgttaaccggaaaggttaccggttaaccgtgggtacgggtccttacgggaccttacccgtaatttccggtttaaccg

SEQ ID NO: 404913 - DNA, 711 bp, Homo sapiens
  misc_feature: GZ8MTXP01CEORZ.52.19.B08.1.454.CMB.2.raw
  modified_base (208)..(208): a, c, t, g, unknown or other
  modified_base (270)..(270): a, c, t, g, unknown or other
  modified_base (280)..(280): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttctccctgtctgcatctataggagacagaatcacatcacttgccggnagtcgagacattagcatgtatctagaattggatcaagacaaaaaggtggacagcccctaaancctgactccncgatcgcacctacgttagtagacgacggtaccgactagtaaccggttacgtaggagggtaacggtacggtcgtaccttggggtacgtaaacggttaatttttaacctttaccttaaccactttacgacgtaccgtacgaacggttcgacgtaacggacccgttacggtaaaggtaatggtttacgtaacaaccttaaagtttacgttttaaacctttagggtaaccctaaaacttaacgttaaaagtttaacctaaccggtttccttacccccgtaacggtttcctaaaccggggtttccggggttaaccggggggggtaaacccggaaggggtttaacgggaggtaaacgttacgttaaacgggacggttaaaccccgggttgttaccggggctttacgggacgttaccccgtaacttcgggttttcccg

SEQ ID NO: 404914 - DNA, 516 bp, Homo sapiens
  misc_feature: GZ8MTXP01A13CW.52.19.B08.1.454.CMB.2.raw
  modified_base (211)..(211): a, c, t, g, unknown or other
  modified_base (398)..(398): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggngagtcgagacattagcatgtatctgaattggatacagacaaaaagtagggacacgacccctaaactcctagatcctcgatgcatccacgtttggagacgaggggtcccataccaaggttcagtggaagtggctcgtgggactagtattttacttcacatcagctaggctgcagcctagagatgttanacaactatattactgtacaactagtactaatcgtctcccgtctcgtcgttcggggacgggggacaagggttggaagtgaccgttagacgtaaccgtgtggctcggcctaacgctttcg

SEQ ID NO: 404915 - DNA, 657 bp, Homo sapiens
  misc_feature: GZ8MTXP01C5WPB.52.19.B08.1.454.CMB.2.raw
  modified_base (236)..(236): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccacatgacccagtctcccttcctccctgtctgcatctataggagacagaatcaccatcacttgccgggcgagtcgagacattagcatgtactntagtaattgatacagaacgaaaaggtaggaacaccgaccctaactcctagactcctcgatcgactactccctagttaggacgacgtacggggtcccaagtaccgtaaggtactaggtaggtaaggtcggtcttcggtagggtaactaaggtttaacttttaccttacaacctagtacagcgaggtctagccgacgtaccgtagaagtagttgttaagaacctaaacttaagtttaactttaacgtaacgtaaccctaaaggtaaacgttaaactttaaacgtacccggttccccttacccgggtcctaccgttaccggggtttaaccgggggaacgggggttaaccgtaaaggggcggaaagtaacgttacggaacgttacccggtaagtggtcgggctacggacctaaccgttaattccg

SEQ ID NO: 404916 - DNA, 522 bp, Homo sapiens
  misc_feature: GZ8MTXP01D2FAW.52.19.B08.1.454.CMB.2.raw
  modified_base (404)..(404): a, c, t, g, unknown or other
  modified_base (444)..(444): a, c, t, g, unknown or other
  modified_base (506)..(506): a, c, t, g, unknown or other
  modified_base (519)..(519): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcagtcgagacattagcatgtatctgaattggatcagacaaaaagtagggacacgacccctaaactcctagactcctcgaatgacatccctagtttggagacgtacggggtcccataccgaaggttcaggtggaagtggctcgtagggactagtattttacttcactatcagtcaggctgacagctagagatgtnactaactatattacgtatacaatagtataatcctctccgntcgtcgttcgggacggggttaccagggttgagtacttacgagacgtaacgtggtaacggtcnggctaacccgttntcg

SEQ ID NO: 404917 - DNA, 762 bp, Homo sapiens
  misc_feature: GZ8MTXP01AZRBM.52.19.B08.1.454.CMB.2.raw
  modified_base (185)..(185): a, c, t, g, unknown or other
  modified_base (209)..(209): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagaatcaccatcacttgccggnagtcgagacattagctatgtatctagaattggatcagaacgaaaaagtagggaacacgacccctaaactcctagaactccacgtatcgcatcctaacgtttgggacgtacgagggggtccccaagtaccgtaaacggttacgaggttagggtaaacggtcgggtaccgttcggtaggggtaaaccgtaaggtttaaccttttttaaccgtttaccgaaacctaattacccgaagtaccgtaagggccgttacggaccgtaacggtcccgtttaaggaaacggtagtttaacggttacggaaccttaaaacgttagtttaaacgtttaaaccttacggttaaaccctaaaagtaacggtttaaacttaaacctcccgggttaaccttcccccgtacgttacccggttaaccggggttttaacccgggggaaccggggggttaaaccctaaagggggttaaccggaaaggtaacggtttaaaccgaacgggttacccgggtaaaccggttggttaaccggggtccttacgggaccctaaaccggttcgtttcccg

SEQ ID NO: 404918 - DNA, 569 bp, Homo sapiens
  misc_feature: GZ8MTXP01DGW1K.52.19.B08.1.454.CMB.2.raw
  modified_base (155)..(155): a, c, t, g, unknown or other
  modified_base (247)..(247): a, c, t, g, unknown or other
  modified_base (268)..(268): a, c, t, g, unknown or other
  modified_base (293)..(293): a, c, t, g, unknown or other
  modified_base (328)..(328): a, c, t, g, unknown or other
  modified_base (336)..(336): a, c, t, g, unknown or other
  modified_base (344)..(344): a, c, t, g, unknown or other
  modified_base (347)..(347): a, c, t, g, unknown or other
  modified_base (354)..(354): a, c, t, g, unknown or other
  modified_base (356)..(356): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagcgtggttttccncgttgctctttaagaggtgtccagtgtcaggtgcaactggtggagtcgtgggggagcgtggtccagcctgggagtccctgagactctcttgngctgcctctggattcaccttnaggtctatgacatgcactgggcccncgaggctccgaggcaagggggctgggagtggggtnctatttanatcatagnganaggaaananaagtataactatagtacgtacgtcgtcgagacggctatcatacactcacgagacgaactaacgtacgaacgaacgtacgtcttagtactcgtaacgaacgtaagtaacgtacgtacgacgacgaggaacgacgacgtaacgaacgtaacgtacgttacgtttacttacgttaagtagtaacgtacgtaacgttaacgtaacgaacggtaacgg

SEQ ID NO: 404919 - DNA, 705 bp, Homo sapiens
  misc_feature: GZ8MTXP01ANA7K.52.19.B08.1.454.CMB.2.raw
  modified_base (187)..(187): a, c, t, g, unknown or other
  modified_base (213)..(213): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcaccatcacttggccgggnagtcgagacattagctatgtatctgaattggatcagacaaaagtacgggacacgacccctaaactcctagactcctagatcgactatccctacgtttggacgtaccgacgggggtacccagtaccgtaaggttcgaaggttacgggaagttcgggaccttcggtagggtaacctaaggttactttttaccgtttacacctattcacgtcgaacggtctgacgtaacgccgttaggaacgtagttcggttacgaacgttaaacaagttttaacttaaccttacggtaaacctaaaaccgttaagttaacgttaaacctttcccgtacccgttaccccggttaccttaccgttaccgggttttaacccggggggaaccggggggttaaacccgtaaagggggttacgggtaaacggtaacgttacggaaacgggttaccggtaaaccggttgggtcggggtacctacgggaccctaacccgttaagttttcccg

SEQ ID NO: 404920 - DNA, 523 bp, Homo sapiens
  misc_feature: GZ8MTXP01DI2MH.52.19.B08.1.454.CMB.2.raw
  modified_base (186)..(186): a, c, t, g, unknown or other
  modified_base (211)..(211): a, c, t, g, unknown or other
  modified_base (378)..(378): a, c, t, g, unknown or other
  modified_base (399)..(399): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggnagtcgagacattagcatgtatctgaattggatcagacaaaaagtagggacacgacccctaaactcctagactcctcgatgcatcctactttggagacgacggggtcccatcccaaggttcaggtggaagtgctgtagggactagtatttacttcactatcagcaggntgcagcctagaagtatgttanacaactagttattactgtaccaaatagtaactaagtccgtactcccgtactcgtacggtttcggggacgggggacgtaagggttgagattacgagccgaagtggtggctgacctcgttaatccg

SEQ ID NO: 404921 - DNA, 585 bp, Homo sapiens
  misc_feature: GZ8MTXP01DNT5D.52.19.B08.1.454.CMB.2.raw
  modified_base (185)..(185): a, c, t, g, unknown or other
  modified_base (533)..(533): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagaatcaccatcacttgccgggcgagtcgagactattaagctaatgtatctagaattggtatcaagacaaaaagtagggacacgaccctaaactcctagactcctcgatcgctagtcctagtttggacgtacgaggggtacccatcccgaaggttcaggtggaacgtggctgtagggactagttattttacttcaactatcagctaggctgacagctagagtagttgttacactaaacaagtttacttaacattaaccaaagtaagttaacgttaaactccggttccctcccggtactccgttaacgggtttccgggggacgggggttacgaaggggttgaacgtnaaccgttaggacgtaacgtaggtcggctacggttaccaacttaacgtttccg

SEQ ID NO: 404922 - DNA, 573 bp, Homo sapiens
  misc_feature: GZ8MTXP01EA0XX.52.19.B08.1.454.CMB.2.raw
  modified_base (435)..(435): a, c, t, g, unknown or other
  modified_base (440)..(440): a, c, t, g, unknown or other
  modified_base (558)..(558): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttggccggcgagtcgagacattagctatgtatctagtaattggatacaagaacgaaaaaggtacgggacaaccggaccccctaaactcctagactcctacgatcgactactccctacgtttggacgtacgacggggtcccagtacccgaaggttcgaggtaggaagtcggctcggtagggtactagttacttttaccttacactatcgagtcgaggtctgcaggcctagagtntgtanactaactattaattactagtaacctaatagtaattaacgtccgtcctcccgtctaccgtcggttcggggaccgggggaactagggttgaagtacttacgacgacgtaacgtggtgtcncgctaaccgttgtcg

SEQ ID NO: 404923 - DNA, 589 bp, Homo sapiens
  misc_feature: GZ8MTXP01A6CE3.52.19.B08.1.454.CMB.2.raw
  modified_base (259)..(259): a, c, t, g, unknown or other
  modified_base (272)..(272): a, c, t, g, unknown or other
  modified_base (300)..(300): a, c, t, g, unknown or other
  modified_base (361)..(361): a, c, t, g, unknown or other
  modified_base (484)..(484): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcaactggtggagtcgtgggggagcgtggtccagccgtgggagtccctgagactctcttgtgctgcctntggattcaccttnagggtctatgacatgcacgtgggtcccncaggcctccgaggcaagggggctgggagtggggtgctaatttagatccatatgatggaaancaagatagtactatgtagacgtcgtagaacggccgattcatcaactctaccagacgaacaaacgtaccgaagaaccgacggtccttagtactaccgtgactaaatcgtaatccgagggtaccnggaacgagcgtaaggaaacgtaaccgtaaccgggttacttttattaagtttaacctaggttaacgtaacccgtaaagtttaacgtaacgaacgggtaaaccgggg

SEQ ID NO: 404924 - DNA, 693 bp, Homo sapiens
  misc_feature: GZ8MTXP01BX05C.52.19.B08.1.454.CMB.2.raw
  modified_base (213)..(213): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctcctgtctgcatctagtaggagacagaactcacatcacgttgccgggngagtcgagactattagctatgtatctagtaattggtatacaagaagaaaaaggtcggaaccaccgtacccctaaactcctagtactcctacgactcgacctacgttcccgttaacgtttcgggaacgtaaccggtaccggggtaccctaagttaccccggtaaaggtttcgtaagggtacgggtaaggttcggtcgttccggtaggggtaacttaggtttaactttttaccttacactagtacgagacgacggctcgacgtacggtccgtagaagtgttacgtacgactaaacctagttaactttaccgtagtaaccctaaagtacgttaaacgttaacgttccggtaccctcccggtacttaccgggttaccgggtttaaccgggggaaccgggggttaacgaagggttcggaaacgtacggttacgttacggttaccgtaacggtggtaacggtctacggacctaacgttgtttcccg

SEQ ID NO: 404925 - DNA, 767 bp, Homo sapiens
  misc_feature: GZ8MTXP01BGSSW.52.19.B08.1.454.CMB.2.raw
  modified_base (186)..(186): a, c, t, g, unknown or other
  modified_base (212)..(212): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctcctgtctgcatctatagganacagaatcaccatcacgttggccggngagtcgaagactattagctatgtatctgaattggatacaagacaaaaagtggaacaaccgacccctaaactcctagactcctcgatcgctactcctagtttggacgtacgacggggtacccagtaccgtaaggttacgaggtaggaacggtcgggtaccgtcggtacggggtaactaaggtttaacctttttaccgtttaccaaccgtacttcgaacgtccgtaacgggtccttacggacgtaacggtaccgttagaaacggtagttaggttaacgaacttaaaaccgtagtttaaacgtttacggtaacgttaaaccgtaaacttaaacggtttaaaccttaaaccgtttccggttaaccccgttccccgggttaacgtttaccccgggttaacccgggggtttaacccggggggaacccggggggttaaaccggttaaacggggttagggtaaacggttaacggttaaaccgggttaacggttaccgggtaaaccggtttgggtccgggtttaaccgtaccgggaaccgttaaccgttaacgttttaacccgg

SEQ ID NO: 404926 - DNA, 678 bp, Homo sapiens
  misc_feature: GZ8MTXP01BFNMK.52.19.B08.1.454.CMB.2.raw
tcagcgcagtacgacacgaccggtgctcgatttagtgagtcagtaaggggcagtcccaaccaggacacagcatggacatgagggtccctgctcagctccgtggggctcctgctgctctggctctcaggtgtcagatgtgtcatccagatgacccagtcctccttcctccctgtctgcatctagtaggagacagaactcaccatcacgttggccgggcgagtcgagactattagctatgtatctagtaattggatcaagaacaaaaaggtagggacaacgacccctaaactcctgactcctgatgcatccctagtttggacacgacgggtacccagtacgtaaggttcaggtaggaagtcgggacttcggtaggggtaactaggttactttttaccgtacacgtattccgagtcgaggtctgacacgtccgtaggaaagtacgttagttaggaactaaacgttaagttacttaacgtacgttaacaaacgtacgtttaaataaccgttcccggtacccttaccccggtacgttacccgttaacccgggggtttcggggggaacccggggggaacccgttaaagggggttaccgggtaaacggtagttaacggaacgggttaccgttaaacggttcgggtaacggttcgacccgggttaacctccggtttaacgttcccg

SEQ ID NO: 404927 - DNA, 573 bp, Homo sapiens
  misc_feature: GZ8MTXP01BLYHM.52.19.B08.1.454.CMB.2.raw
  modified_base (293)..(293): a, c, t, g, unknown or other
tcagcgcagtacgacacgaccggtgctcgatttagtgagtcagtaagggcagtcccaaccaggacacagcatggacatgagggtccctgctcagctcctggggctcctgctgctctggctctcaggtgtcagatgtgtcatccagatgaccagtctccttcctcctgtctgcatctataggagacagaatcacatcacttggccgggtgagtcgagtacattagctatgtatcgtagtaattggatacgaagaacgaaaagtacggaacaccgtaccctaaactctagactcncgtatgctactccagttggacgtacgacgggtactagtaccgaaggttcaggtaggagtgggctgagggtaactagttacttttactactacatacgacgtacgaggctgacgtacgtcgtaagtaggtatcggttaaacactaactattactactataactaaatagtactacgttccgtccgtccgtacgtaccggttacgggtaacggggacggggaacgtagggttagtaacgtacgacgttacgacgtaagtggtcgctcgacctaacgttcgtc

SEQ ID NO: 404928 - DNA, 698 bp, Homo sapiens
  misc_feature: GZ8MTXP01EOTSF.52.19.B08.1.454.CMB.2.raw
  modified_base (186)..(186): a, c, t, g, unknown or other
  modified_base (211)..(211): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctcctgtctgcatctatagganacagaatcacatcacgttgccgggnagtcgaagactattagctatgtatctgtaattggtatacaagacaaaaaggtgggaccacgtacccctaaactctagactcctcgatcgactactacccgtacgtttaggacgtaccgtacggggtacccctagtacccgtaaaggttacgaggtaggtaaacggttcgggtacccgttggtacggggttaaactagggtttaactttttaccgttttaaccgaacctacgttaccggagtaaccggtacggccgttacggaccgtacggtacccgtaaggtaacgtacgtttagttacggaactaaaccttaagttaactttaacggttaacgtaactaaaccggtaaattaacttaaaccgtccgttccctacccgtcgtaccggttcgggtaaccgggggtaacgggggttaccctaaagggggttcgtaaacgtacgacgttacggacgtaacggttgtgacgtccgactaaccttgtttccg

SEQ ID NO: 404929 - DNA, 535 bp, Homo sapiens
  misc_feature: GZ8MTXP01E10D8.52.19.B08.1.454.CMB.2.raw
  modified_base (186)..(186): a, c, t, g, unknown or other
  modified_base (210)..(210): a, c, t, g, unknown or other
  modified_base (325)..(325): a, c, t, g, unknown or other
  modified_base (389)..(389): a, c, t, g, unknown or other
  modified_base (509)..(509): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcacatcacttgccgggngagtcgagacattagcatgtatctgaattggatcagacaaaaagtagggacacgacccctaaatcctgactcctcgatgcatccagtttggagacgagggtcccatccaaggttnagtggaagtgctcgtgggactagtatttacttcacatcaagaggctgcagctagaatatgttanacaaactattattacgattaccaaatattaataaacgttccgtacctcccgtctccgtaccggtttcgggggaacgggggtaaccaagggtagggagaagtacgaaggttcgaactgggnggtctacgcaacctaagttcttaacg

SEQ ID NO: 404930 - DNA, 627 bp, Homo sapiens
  misc_feature: GZ8MTXP01DJCS3.52.19.B08.1.454.CMB.2.raw
  modified_base (185)..(185): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagaatcaccatcacttgccgggcgagtcgagacattagcatgtatctgaattggatacagacaaaaagtagggaacacgacccctaaactcctgactcctcgatcgctatccctagtttggagacgtacggggtccagtaccgaaggttcaggtaggaagtcgggacttcgtggggaactaggttactttttacctactaaccatccagcgaggctgcacgtctagaagtatgttagactaaactagttaactttaacgtcgtaaacaaacttaaggtaacttaaacgttcccggttccttccccgtacgtttaccggtaaccgggttttccgggggaaccggggggttaaacccgtaaaggggttacgggaaacgtaacgttacgaaacgggttcggtaaaccgtgggtaacgggtaccgtcgacctaacgttcgttcg

SEQ ID NO: 404931 - DNA, 721 bp, Homo sapiens
  misc_feature: GZ8MTXP01BKPUV.52.19.B08.1.454.CMB.2.raw
  modified_base (211)..(211): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctataggagacagaatcacatcacttgccgggnagtcgagacattagctatgtatctagaattggatcaagacaaaagtggacacgacccctaactcctgactcctacgatcgacctattacccgtagtttacgggacgaccgtacggggtccccagttaccccgaagggtttcgagggttagggtaacggtcgggtccgttcggtacggggtaaaccttaagggtttaaccttttttaccgtttaccaaaccgttacgttaccgtaacggtacccgaaggggtccttacggaccgaacggtcccgtttaaagggaacgttacgtttgggtttaacgaaccttaaaccgttaagtttaacttttaacgtacggttaaacctaaacgtaacggtttaacttaaccgttcccggttacccttccccggttacgttacccggtaaccggggtttcggggggaacccgggggttaacgtaaggggttggaacgtacttaacggacggttcgtaacgtggtaacgctacggacctaacttcgtttccg

SEQ ID NO: 404932 - DNA, 631 bp, Homo sapiens
  misc_feature: GZ8MTXP01A581R.52.19.B08.1.454.CMB.2.raw
  modified_base (187)..(187): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgacccagtcctccttcctcctgtctgcatctatagganacagaatcaccatcacgttggccggcgagtcgagactattagctatgtatcgtagtaattggtatacaagaacgaaaaaggtagggaacctaccgacccctaaactcctagtactcctacgtatcgactacttaccctacggtttcggaagtaccgtacggggtaccctagttaccgtaaggttacgaggtacggtaagtcggtctcgtagggtactagttactttacttacgactagtacacgcgtacgctacggacacgtaccgtaagtaagtacgttagtactaactaaactaggtttaacttacgtcgtaaacaactaacgttacttaacgttaccgttcctacccgtcttccggtaccgggttcggggaccggggaacgtaggttacggagtacgttacgacgacgtaagtggtaacgtctacgactaaccgaattccg

SEQ ID NO: 404933 - DNA, 632 bp, Homo sapiens
  misc_feature: GZ8MTXP01BY2DY.52.19.B08.1.454.CMB.2.raw
  modified_base (255)..(255): a, c, t, g, unknown or other
  modified_base (310)..(310): a, c, t, g, unknown or other
  modified_base (357)..(357): a, c, t, g, unknown or other
  modified_base (376)..(376): a, c, t, g, unknown or other
  modified_base (413)..(413): a, c, t, g, unknown or other
  modified_base (416)..(416): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagcttggggtttttcctcgtttgcttcttttaagaggtgtccagtgtcaggtgcaacgtggtggagtcgtgggggagcgtggtccagccgtgggacgtcctgagactctcttgngctgcctctggacttcaccttgagggtctagtgacagtcgctacgtcgggtcccnccgaggcctccgaggcgaagggggctgggagtggggtgactatttanatccaatatgatggaaaancgaagtatatactagtgtagacgtcgtagacgctatnatntactctaccgagacgaaccaacgtaccgaacgaaacgaccgttacgttacgtacgttaccagtaaaccgtaaagtggtaactacggaacggccgttaaggaagtaacggcgttaaaggaacgtaaaccggtacggttaccttttaagttaagtttaacggtcggtaaccgtaacggttaaaacctttaacggtccggaaaaccggggtaaaccggg

SEQ ID NO: 404934 - DNA, 681 bp, Homo sapiens
  misc_feature: GZ8MTXP01AQSWD.52.19.B08.1.454.CMB.2.raw
  modified_base (218)..(218): a, c, t, g, unknown or other
  modified_base (471)..(471): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgaccctagtcctccttcctcctgtctgcatctagtaggagacagaactcactatcacgttcggccgggngagtcgagactagttagctatgtatcgtagaagttgatacgaagaaacgaaaaggtacggacaaccgtacccctaactcctagactcctacgactcgctactccgtacggtttagggacgaccggtacgggtaccctaacgttaccgtaagggttcaagggttacggagttcgggtactcggtaggtaacttagttacttttacctcaactatacgacgcgtacgcgttacgacgtacggtctaagaacgttntacgttaacactaaaccttaggtttaaacttacccggttaataacgtaaacgttaacgtaacttaaccgttcccggtacccctccggttacctaccgggtacggggttccggggaaccggggttaagacggttgggaaactacggttaacgacgggttacggttaaccgtgggtccggtaccttacggaccctaaccgtttaagttcccg

SEQ ID NO: 404935 - DNA, 529 bp, Homo sapiens
  misc_feature: GZ8MTXP01CGH81.52.19.B08.1.454.CMB.2.raw
  modified_base (186)..(186): a, c, t, g, unknown or other
  modified_base (211)..(211): a, c, t, g, unknown or other
  modified_base (483)..(483): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggnagtcgagacattagcatgtatctgaattggatcagacaaaaagtgggacagcccctaaactcctgactcctcgatgcatcccactttggagacgaggggtcccatccaaggttcaggtggaagtggctcgtgggactagtacttttacttcaccatcagtcaggctgcagcctgaacgatgttagacaactattacttactgtacaaactagttaataactcgtacctcccggctcgtcgtttcggggcgggggttaccaagggttggaagngttacgacggcgtaacgtggtaacgtcgtgacctaacgttcttccg

SEQ ID NO: 404936 - DNA, 623 bp, Homo sapiens
  misc_feature: GZ8MTXP01BBS2U.52.19.B08.1.454.CMB.2.raw
  modified_base (185)..(185): a, c, t, g, unknown or other
  modified_base (208)..(208): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagatcaccatcacttgccggnagtcgagacattagctatgtatcgtagtaattggtatcaagaacgaaaaggtacgggacaccgtacccctaaactcctagactcctacgatgactacgtccctacgtttggacgtacgaggggtacccagtccgaaggttcaggtacggaagtcgggtctcgtacgggtactagttactttaccttacgacctaatccgagccgagctcgacgtacgccgtagagtacgttagttcgactaactattacgttactacgtacaactacgttaactacgtccgtccttcccgacgtccgttacgggttaaccgggggacgggggttaaccctaaggggttcggaaacgtaacgttaccggaaaggttcccggtaaagttcggaacggttccgcgttacccggaaccgttcgttcccg

SEQ ID NO: 404937 - DNA, 562 bp, Homo sapiens
  misc_feature: GZ8MTXP01CWN0K.52.19.B08.1.454.CMB.2.raw
  modified_base (186)..(186): a, c, t, g, unknown or other
  modified_base (210)..(210): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctagtagganacagaatcaccatcacttgccggnagtcgagactattagctatgtatctagtaattggatcgaagaacgaaaaagtagggaacacgacccctaaactcctagactcctacgatcgctactaccgtacgtttaggacgtacgacggggtcccaagtacccgtaagggttcaggttaggaacggtacggtctcgtagggaactaggttacttttaccttacaactatcagcgaggctgcgaacgtccgtagaagtattgttacactaactaagttattactatacaactatatatacgtctccgtctcgtcgtcgggtacggggaccggtaaggaggagagttacgagacgaacgtagtcgcgtcgcaacaacgttcg

SEQ ID NO: 404938 - DNA, 593 bp, Homo sapiens
  misc_feature: GZ8MTXP01EVWRG.52.19.B08.1.454.CMB.2.raw
  modified_base (156)..(156): a, c, t, g, unknown or other
  modified_base (190)..(190): a, c, t, g, unknown or other
  modified_base (372)..(372): a, c, t, g, unknown or other
  modified_base (385)..(385): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagcgtgggttttccncgttgctcttttaagaggtgtccagtgtcaggtncaagtggtggagtcgtgggggagcgtggtccagcccgtgggacggtccctgagtactcttcttgtgctcgcctgtggtattccaccttcgaggtctatgaacatcgctacgtggtcccgcaggcctcgaggccgaagggggtcgtagggagtggggtagtactaatttatataccgattagngagtacggaaaanacgaagtatatacgtagtagtacgacgtcgtaggacggtctatcatctactactacaagaacacaaccgacgaacgaaccggtcgtagtatacgtcgaagtaacaagtagactcgagtcgagaacgagttacggtaagacgtacgtacgttaactttattacttaacgtcgtaacgtaacgtaacttacgtaacggttaacgggaacg

SEQ ID NO: 404939 - DNA, 746 bp, Homo sapiens
  misc_feature: GZ8MTXP01CF4VF.52.19.B08.1.454.CMB.2.raw
  modified_base (189)..(189): a, c, t, g, unknown or other
  modified_base (217)..(217): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgacccagtcctccttccctccctgtctgcatctatagganacagaatcaccatcacgttcggccgggngagtcgaagactattagctatgtatcgtagtaattggtatacgaagaaacgaaaaaggtacgggaaccaaccgtacccccttaaaactccccgtagtaaccttccccgtacggtaatcgtacctaaccgttacccgttaacgtttacggggaaccggtaccggtaccgggggtacccctaagttacccggtaaacgggtttcgaaggggttacggaaggtcgggtaccgttcggtacggggtaaacttaggtttaacttttaccgttaccaactagtaccgagtccgaggccttacggacgtacggtaccgttaggtaagtacggttaggttaacgaactaaaaccgtttagtttaactttaacggtacgtaaaccaaagttaacgttaataaccgtttcccgtacccgtacccgtcgttaccggtacccggggtttccgggggaaccgggggttaaccgtaagggttcggaaacgtcgttaacggacggttacggtaagtcggtaacgcgtcactaaccttctttccg

SEQ ID NO: 404940 - DNA, 696 bp, Homo sapiens
  misc_feature: GZ8MTXP01B97QE.52.19.B08.1.454.CMB.2.raw
  modified_base (210)..(210): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttggccggnagtcgagacattagctatgtatctagaattggtatcaagacgaaaaagtagggacacgacccctaaactcctagactcctcgatgctactcctacgtttggacgtacgacggggtaccctagtaccgtaaagggttcaggtaggtaaagtcggaccttcggtaggggtaaacctaagggtttaactttttaacctttaccaaccctattccgaagtaccgaagggtcctaggacgaacggtccgttaagaaacggttagttacgtacgaacttaaacttaacgtttaacgtttaacgtacgtaacgtaaacgttaacgttaacgttaacgttacccgttacccttacccggtaccgttaccgggttacccggggtttaaccgggggaacgggggttaaacgtaaggggttacggtaaacgtacgttaacggaaacggttaccggtaacgtcgggtcgtacgtacggttacctaaccgttcgttccg

SEQ ID NO: 404941 - DNA, 489 bp, Homo sapiens
  misc_feature: GZ8MTXP01B2KZJ.52.19.B08.1.454.CMB.2.raw
  modified_base (210)..(210): a, c, t, g, unknown or other
  modified_base (275)..(275): a, c, t, g, unknown or other
  modified_base (347)..(347): a, c, t, g, unknown or other
  modified_base (364)..(364): a, c, t, g, unknown or other
  modified_base (372)..(373): a, c, t, g, unknown or other
  modified_base (375)..(377): a, c, t, g, unknown or other
  modified_base (379)..(379): a, c, t, g, unknown or other
  modified_base (384)..(384): a, c, t, g, unknown or other
  modified_base (389)..(389): a, c, t, g, unknown or other
  modified_base (391)..(391): a, c, t, g, unknown or other
  modified_base (393)..(393): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggnagtcgagacattagcaatgtatctgaattggatcagcaaaaaaagtagggacagcccctaaaacncctgatcctgaatgcatcccaacgtttggagacgaggggtcccatacccaagggttcagtggaagtggcttngggacagtatttacttnaccatcanngnnnancaganatgtnananatattatatacaacatataatactctcctctctcgtcggtcggggacgggaacggaggtagagagacgacgaagagtgcgcgcgtaacaacgtaac

SEQ ID NO: 404942 - DNA, 686 bp, Homo sapiens
  misc_feature: GZ8MTXP01ALEEY.52.19.B08.1.454.CMB.2.raw
  modified_base (187)..(187): a, c, t, g, unknown or other
  modified_base (210)..(210): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcacatcactgccgggngagtcgagacattagcatgtatctgaattggatacagacgaaaaagtagggacacgacccctaaactcctagactcctcgatgcatcctacgtttgggacgacgtacggggtacccagtccgaaggttcgaggtaggaaggtcggcgttcgtgggtaactaggtttaacttttaccttacactactcgagcgaacgggtctggctaacggtacctaggaaagtagttcgttacggaacctaaactaagtttaactttaacgtacggttaaaccctaaattaaacggttaacttaaaccgttcccgttcccgttcccccggttaccttaccggttaacccggggtttccggggggaaccggggggttaaacccgtaaacgggggttgggaaacgtacgttaacccggaaaggttacccgggtaaacggtttgggtccggggtttaacccgtaccgttacccgtaaccgttcgttccg

SEQ ID NO: 404943 - DNA, 609 bp, Homo sapiens
  misc_feature: GZ8MTXP01EGI24.52.19.B08.1.454.CMB.2.raw
  modified_base (209)..(209): a, c, t, g, unknown or other
tcagcgcagtacgacacgaccggtgctcgatttagtgagtcagtaagggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggnagtcgagacattagcatgtatctgaaattggatacagacaaaaaagtagggaacacgacccctaaactcctgactcctcgatgctatccctagtttggagacgacggggtcccaataccgaaggttacaggtagggtaagtcggtctccgtagggaactaggtacttttacttcacagttcagtcgaggctggacagtcctaggaatagtgttacactaaactagttaactttaacgtcgttaccaaacgtaagttaacgttaaacttccggtcccttaccccggcttccgtaacccggttttgggggacccggggggttaaaccctaagggttcggggaaataaccgttacgaaaggttccgtaacgtggtcgggcctagggcctaacgttgtttcccg

SEQ ID NO: 404944 - DNA, 670 bp, Homo sapiens
  misc_feature: GZ8MTXP01CYJ6X.52.19.B08.1.454.CMB.2.raw
  modified_base (186)..(186): a, c, t, g, unknown or other
  modified_base (209)..(209): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcacatcacgtgccggnagtcgagacattagctatgtatctagtaattggatacgaagaacgtaaaaaggtacgggacaacgtacccctaaactccgtagtactccgtacgatcggactacgttaccctagtttagggacgtacgacggggtaccagtaccgtaaggttcgagggtacgaaggtcgctcggtaggggtaacctaggtttaaacttttactccaactaatccgtaagcgtagctacggaccagtacccgtagtaaacggttgttagtacgtaactaaacgttagttaacttaacgtacgtaacgtaaacgtaacgttaacttacgttcccgttcccgtacccgtacgttaccgggttacggggttaaccgggggaacgggttaacgtaacgggttacggtaacggtaacgttaacggaagttaccggaacgttcggtaacgtacgtacgttaccgtaaccgttcgttcg

SEQ ID NO: 404945 - DNA, 716 bp, Homo sapiens
  misc_feature: GZ8MTXP01ARMFQ.52.19.B08.1.454.CMB.2.raw
  modified_base (192)..(192): a, c, t, g, unknown or other
  modified_base (352)..(352): a, c, t, g, unknown or other
  modified_base (361)..(361): a, c, t, g, unknown or other
  modified_base (383)..(383): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagtcttgggttttcctcgttgcttcttttaagaggtgtccagtgtcaggtncaacgtggtggagtcgtgggggagcgtggtccagccgtgggagtccctgagctctctgtcgctgcctgtggtacttcaccttgagggtctagtcgactagtgcctacgttcgggcccctccgaggtcctccgaggcgaagggggtctgggaggtggggtnactatttanatccatagtgactaggaaaacnaagtattagtaacttagtacggtaacgaccgttaccgggtaggtaacggggtccctaatttccgaaacttcctaaacgttcctaccgaacgggaactaaacccgaacgttacccggaaacggaaacctacggttaccttagtaaactcggttaacgaaacttaaagcggtaaaccgtccggtaacggtacgtaaggaacgtaaccggttacgtaaacgggttaaaccgttaaccggttaaccggttttacttttaaacgttacggtttaacggtaggttaaccgtaaaccggttaaaacgtttaacgggaaccgggttaaaccggggtaaccg

SEQ ID NO: 404946 - DNA, 668 bp, Homo sapiens
  misc_feature: GZ8MTXP01B80QG.52.19.B08.1.454.CMB.2.raw
  modified_base (187)..(187): a, c, t, g, unknown or other
  modified_base (213)..(213): a, c, t, g, unknown or other
  modified_base (252)..(252): a, c, t, g, unknown or other
  modified_base (290)..(290): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcaccatcacgttgccgggngagtcgagacattagcatgtatctgaattggatcaaganaaaagtagggacacgtacccctaaactcctagactccncgatgactactaccctacgttttagggacgtaccggtacgggggtaccccaagtacccgtaaagggtttcgaggtacggggtaaaggttcgggccttcggtagggggtactaaggtttaactttttacctttccaacctaattccgaaagccgaagggtccgtgaccgtacggaccgttagaacgtagttgttacgactaacctaagttatttaactcgttaacaaaccgtaattaacgttaaacttccgtaccttccccgtcttaccgtccgggttttaaccggggacggggggttaacccgtaagggttgggtaaacgtacggttacggaaacgacgggtaacgtggtcgggtctcggacctaaccttgtttcccg

SEQ ID NO: 404947 - DNA, 680 bp, Homo sapiens
  misc_feature: GZ8MTXP01B5UXA.52.19.B08.1.454.CMB.2.raw
  modified_base (181)..(181): a, c, t, g, unknown or other
  modified_base (186)..(186): a, c, t, g, unknown or other
  modified_base (213)..(213): a, c, t, g, unknown or other
  modified_base (449)..(449): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctcctgtctgcatctanagganacagaatcaccatcacgttcggccggngagtcgagactattaggctatgtatcgtagtaattggatacaagaagaaaaaggtagggacctaaccgacccccttaaaactccgtacgtactcctcgaactcgactactcccgtaagtttggaacgacgtacggggtaccctagttaccgaaaggtttcaggttacggaaggtcggtctcggtagggtaaccttaggtttaacttttacgttacaaccctagtaccagtaccggngtcgtacgaccgtacgtacgtaagtaagtacgtgttaacgtaactaaacgttagtttaacttacgtaacgtaacgtaaacgtagttaacgttaccgtccgttacccgtcccgtacgtttaccggtaaccggggttaacgggggaacggggttaaccgtagggttacgtaacggtaacgttaacggacggttacgtaagtcggttcgcgtacgacccgtaacgttcgttccg

SEQ ID NO: 404948 - DNA, 618 bp, Homo sapiens
  misc_feature: GZ8MTXP01AZL2Y.52.19.B08.1.454.CMB.2.raw
  modified_base (187)..(187): a, c, t, g, unknown or other
  modified_base (212)..(212): a, c, t, g, unknown or other
  modified_base (460)..(460): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaactcacatcacttggccggngagtcgaagactattagctatgtatcgtagaattggatacgaagaacgaaaaaggtacgggacaaccgaccccttaaactcctagactcctcgatcgcctactaccctacgtttgggacgtaccggtacggggtacccaagtacccgtaaggttcgaagggtaggtaacggtcgggcttcggtagggtacttagttacttttaccttacactatacgagcaggctgcgacgcgtagagtagtcgttanactaactagttactacgtagtaacctaagtataacgttaacgtccgtcctaccccgtctaccgtaccgggttaacgggggacggggttaaccgagggttaggacgtacgacgaacggcgtaacgtggtaacgcgtacggacctaacgttaacgttccg

SEQ ID NO: 404949 - DNA, 722 bp, Homo sapiens
  misc_feature: GZ8MTXP01A35U4.52.19.B08.1.454.CMB.2.raw
  modified_base (188)..(188): a, c, t, g, unknown or other
  modified_base (213)..(213): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgacccagtcctccttcctcctgtctgctatctatagganacagaatcacatcacgttggccggnagtcgaagacagttagctatgtatctagtaattggatacaagaacgaaaaaggtacgggaacaccgtaacccctaaactcctagactcccgtgaactcgactactcccgtaacgtttacgggacgaccggtacggggtacctaacgtacgtaacgggttacgaaggtagggtaacggtcgggtaccgtcggtaggggaaaccttaagtttaacgttttaccgttacgaaacctactacgacggtacgacgggtctcggacgtaccgtacgttaaggaagtagttagtacgtaactaaaccttagtttaactaaccgttgtaacctaaaagtacgttaacgttaacgttcccgtaccgtccccgtacgttaccggttccgggttaaccgggggacgggggttaacccgtaggggttaacggaacgtaacggttaaccggttaaacggttaccggtaaacggttcgggtaacgggttccctaaccgggcccttaacgttaaccggtttccg

SEQ ID NO: 404950 - DNA, 689 bp, Homo sapiens
  misc_feature: GZ8MTXP01DN0WB.52.19.B08.1.454.CMB.2.raw
  modified_base (257)..(257): a, c, t, g, unknown or other
  modified_base (310)..(310): a, c, t, g, unknown or other
  modified_base (397)..(397): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcaacgtgggtggagtcgtgggggaggcgtggtccagccgtggggacgtccctgagtactctcttgngctgcctctggacttcaccttcgaggtctatgaacagtcgcacgtgggtcccncgaaggcctcccgaagggccgaagggggtctagggggagtgggggttagctaagtttatatccaatatgaacgttgggaaaaacganaaggtacttaaattaaacttaagtacggtaacggtaccgttaccggtagggaaacggggtccctaagtttacaacttacaaacttcccgtaaccaagggaaacaaaccctaaaccgttaccggaaacgaaacggtacccgtagttacgtaactaccgttaagactaaaagttaggtacttcggaaagggtctaaggaaagtcgacgtaggaaacgtaccaaggtttacctttaattaacgttaacgtagtaacgtaacgtaaacgtttaacgtccggaaacggggtaaccgg

SEQ ID NO: 404951 - DNA, 502 bp, Homo sapiens
  misc_feature: GZ8MTXP01AF94J.52.19.B08.1.454.CMB.2.raw
  modified_base (210)..(210): a, c, t, g, unknown or other
  modified_base (246)..(246): a, c, t, g, unknown or other
  modified_base (388)..(388): a, c, t, g, unknown or other
  modified_base (398)..(398): a, c, t, g, unknown or other
  modified_base (484)..(484): a, c, t, g, unknown or other
  modified_base (499)..(499): a, c, t, g, unknown or other
tcagcgcagtacgacacgaccggtgctcgatttagtgagtcagtaagggcagtcccaaccaggacacagcatgaacatgagggtccctgctcagctcctggggctcctgctgctctggctctcaggtgtcagatgtgtcatccagatgacccagtctccttcctccctgtctgcatctataggagacagaatcaccatcacttgccgggnagtcgagacattagcatgtatctgattggatcaganaaaagtagggacacgacccctaaactcctagactcctcgatgcatcccactttgagtacaggggtcccatccgaaggttcagtggaagtggctcgtggggacagtacttttacttcacctatcagctagctagcagcctganatgttgcaanagttaattactgtaccaaatgtaatactcgtactcccgcttcacgtttcgggcgggggacctagggttcgagattccgagcgaacngtcgagtcgctaacngtc

SEQ ID NO: 404952 - DNA, 519 bp, Homo sapiens
  misc_feature: GZ8MTXP01BU209.52.19.B08.1.454.CMB.2.raw
  modified_base (367)..(367): a, c, t, g, unknown or other
  modified_base (386)..(386): a, c, t, g, unknown or other
  modified_base (483)..(483): a, c, t, g, unknown or other
  modified_base (514)..(514): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcacatcattgccgggcagtcgagacattagcatgtatctgaattggatcagacaaaaagtagggacacgacccctaaactcctgactcctgatgcatcccactttgggagacgaggggtcccatccgaaggttcagttggaagtggctcgtagggactagtattttacttcacntcagcagctgcagctgaantcgtagactaactatattactagtacaatagtaactaacgtccgtcctcccgtcttaccgtcggtttcgggggacgggggttacagggttcggaagngttacgagacgaagtgtcgctcgctaaccgntttcg

SEQ ID NO: 404953 - DNA, 668 bp, Homo sapiens
  misc_feature: GZ8MTXP01BOBL2.52.19.B08.1.454.CMB.2.raw
  modified_base (216)..(216): a, c, t, g, unknown or other
  modified_base (241)..(241): a, c, t, g, unknown or other
  modified_base (298)..(298): a, c, t, g, unknown or other
  modified_base (513)..(513): a, c, t, g, unknown or other
  modified_base (631)..(631): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccacatcgaccctagtcctccttccctccctgtctgcatctataggagacagaatcacatcacgttggccgggngagtcgagactattgctatgtactntagtattgatacgaagaaacgaaaggtcggacaccgtacccctaacgtctagctccngtatcgctactcccgttaggttacggacgtacgggtaccggtacctacgttaccggtaacggttcgagggtacgggtaagtcggtcgtcgggttagggaaccctttaaaggtttacctttttactacccgaacttctaacgcgtacggacggttcgcgacgtacgtacggtaataggggtattgggtacaaacctaacttaagttacttaccgtntaaacgtaactagtaacttaccgttcccgtaccgtcccgttcgttaccggtccgggttaacgggggaccggttaagggtaagggcgtaaacgtcgaaccgggttagttccgggtaacngggttcgacgtacttaccccgtaattcgtttaacccg

SEQ ID NO: 404954 - DNA, 686 bp, Homo sapiens
  misc_feature: GZ8MTXP01BXJRZ.52.19.B08.1.454.CMB.2.raw
  modified_base (208)..(208): a, c, t, g, unknown or other
tcagcgcagtacgacacgaccggtgctcgatttagtgagtcagtaagggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcacatcacttgccggnagtcgagacattagctaatgtatctgaattggatcaagacaaaaagtagggacacgacccctaaatccctagactcctgactgctatccacgtttggacgacgacggggtacccagtacccgaaggttacgagttaggaaaggttgggcttcgtaggggtaaacctaggttaactttttactttaccaacctacgttaccaagcaacgggtctcggtacacggacccgttagaaaggtattacgggttaacgtaaacctaaacgttaacgtttaaacgtttaaccggtaacgttaaaccgtaaaacgttagttaaacttaccgttacccggttcccgtaccccgtaccgtttaccggttacccggggttaaccgggggaaccgggggttaaaccgtaaagggttacgggaacgtaacgttaacggttaacggacggtaacgtggtaaccggtcgtaccgacctaaccgttcgttcccg

SEQ ID NO: 404955 - DNA, 783 bp, Homo sapiens
  misc_feature: GZ8MTXP01A87UI.52.19.B08.1.454.CMB.2.raw
  modified_base (187)..(187): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgacccagtcctccttcctcctgtctgcatctatagganacagatccactatcgacgttcggccgggacgagtcgagtactattagctatgtatcgtagtaagttggactcgaagaacctaaaaagggtacggacctaaccgtaacccccttaaactccgtacgtacctaccgcgtatacgtacctactaccccgttaagtttacgggacgtaccggtacggggtacccctaagttacccggtaaacggttcgaagggttacgggtaagtacgggtccgttcggtagggtaaaccttagtttaacctttttaaccttacgaacctaacgttacgacgtaccgtaagtaccgtcgacgtacgtaccgtagggtaaacttaggtacgttaactaaaccgtaacctttaagttaaccctttaaaggggtaccttaacccgtaaaattaacggttaaccttaaaccgttcccgttacccgtaccccggttacgtttaaccccggggttacgggtttaacccggggggggaaaccgggttaaaccgggttaaagggttaggggtaaaccgaacgtttaaccggaaccggttacggtaaaccgtgggtccggtacgacttaccggtaacctttcttcccgg

SEQ ID NO: 404956 - DNA, 696 bp, Homo sapiens
  misc_feature: GZ8MTXP01AY7LE.52.19.B08.1.454.CMB.2.raw
  modified_base (155)..(155): a, c, t, g, unknown or other
  modified_base (172)..(172): a, c, t, g, unknown or other
  modified_base (259)..(259): a, c, t, g, unknown or other
  modified_base (575)..(575): a, c, t, g, unknown or other
  modified_base (588)..(588): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttccncgttgcttcttttaagnggtgtccagtgtcaggtgcaatggtggagtcgtgggggagcgtggtccagccgtgggacgtccctgagactctcgttgtgctgcctntggtacttcacccttgagggtctagtgacagtcgctacgttcgggccccgccgacgggtcctacccggagggtaccggaaacgggggtcgtagggggtaaggttcggggggtcgtacgttaattttaagtactaccctaaagttagtaggtaagtacggggaaaaaactacgaaagttaacttaaacgttaacctaagtttacggtaacgtacgttaccccgggtaggaaacggggcctaactttacgaacttacaacttccctaccgaagaaccgaactaaaccggtaccgaacgaacctacgtctagtacttanacgaacttaaagntacgtacgacggtcaggaaggtacgacggtaagaaccgtacgttacgttagttaacgttcttaacgagtaacgtaacgtaacgttacggtaaccggaacgggtaaccg

SEQ ID NO: 404957 - DNA, 676 bp, Homo sapiens
  misc_feature: GZ8MTXP01A56VJ.52.19.B08.1.454.CMB.2.raw
  modified_base (256)..(256): a, c, t, g, unknown or other
  modified_base (263)..(263): a, c, t, g, unknown or other
  modified_base (277)..(277): a, c, t, g, unknown or other
  modified_base (304)..(304): a, c, t, g, unknown or other
  modified_base (366)..(366): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcaacgtggtggagtcgtgggggagcgtggtccagccgtgggacgtccctgagtactctcgttgtnctgcctntggattccaccttnaggtctatgacatgcacgtgggtcccnccaggcctccgaggcgaagggggctagggaggtggggtgactagtttaatactctaattagngtaagtaggaaaagaaccgtaagaatactaaactagtacgtaacgtacgttaccggtacggaacggggtacctagttaccaacttacgtaacttccgttacccaagggaaacctaaaccgtaaaccccgttaaccgaaacgaaaccggtacgtaccgtttaggtaacctacgttacgaacctaaagtacgaacttaccgaggtaccgtaggaaacgggagttaccggaaggaaacgtaaccgtacggttacctttattaccgttaagtagtaacgtaacggtaattacgtaaccgaagggtaaacccggg

SEQ ID NO: 404958 - DNA, 796 bp, Homo sapiens
  misc_feature: GZ8MTXP01ESGXM.52.19.B08.1.454.CMB.2.raw
  modified_base (187)..(187): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctcctgtctgcatctagtagganacagaactcacatcagttcggccgggcgagtcgagactattagctatcgtatctagtaagttggatacgaaggaacgtaaaaaggtacggggaacctaaccggtaacccccttaaaacgttcccgtacggtaaccttcccgtacgtatacggtaccttaccgttacccgttaacggttttacggggaaacgtaccgggtaacgggggtacccctaagttaaccggttaacggggttacgtaaggggttacgggtaaacggttcgggtaccgttaacgggtacggggtaaactttaaggttttaaccttttttaaccgttaccgtaacctaagtaccgagtacgacggtctacgacgtacgtaccgtaagacggtatacggtacaactaacgttagttaactttaacggtactaaccgtaaagtacgttaacttaaccggttccttacccgtcccgttaccggtttaaccggttcccggggggttaaccggggggaacccggggggttaaacggtacggggttaaagacgggtaacgttaacgggaccgggttacccgtaagggtttcggttccggaccggtacggaccctaaccgtttcggtttccccg

SEQ ID NO: 404959 - DNA, 792 bp, Homo sapiens
  misc_feature: GZ8MTXP01BHACW.52.19.B08.1.454.CMB.2.raw
  modified_base (187)..(187): a, c, t, g, unknown or other
  modified_base (213)..(213): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcaccatcacttggccgggngagtcgagacattagcatgtatctgtaattggatcaagacaaaaaggtagggaacacggtaccccctaaactcctagactccgtcgtatcgacctacttccctacggttttacgggaacggtaaccgacgggggttccccaagttaaccccgtaacgggtttacgaagggttacgggaaacgggttcgggtaccgttcggtaacgggggtaaaccttaaagggtttaacgtttttttaacccgtttaccaacccgttaactaccgttaggaccgtaaggggtcctcggtacgtaaaccgtcccgttaagggtaaacggtagtttacggttaaggtaaccccttaaaaggttacgttttaaaactttaaccgttacggttaaaacccgtaaacttaaaggttaaactttaaaccgttcccgtttaaccccgttcccccggttacgtttaccccgggttaaccggggttttaacccgggggaaccggggggttaacccgtaaagggggttacggtaaacgtacgttaacgacggttaccggtaacgtgggtcgtcgtacggacctaaccttcggtttcccg

SEQ ID NO: 404960 - DNA, 735 bp, Homo sapiens
  misc_feature: GZ8MTXP01EU8XG.52.19.B08.1.454.CMB.2.raw
  modified_base (260)..(260): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcaacgtggtggagtcgtgggggaggcgtggtccagccgtgggacgtcctgagactctcttgtcgtccgntgcgtctcggacttcacgtctaggtcgtactgtaccgtaccgtaccggttaccggtacccggtaccggtaccggtaaccggaccggtaccgggaacgggtacgggtacgggtacgggtagggttacgggtacggttacgttaacgttaacgttacgtaagtacgtaagtaagtaaggtaaacgtaaacgtaaacgtaacgtaaacgtaacgtaacgtacgtaacgtacgtacggtaacgtaccgtacgtaacggtacgtactactaacgtactactacgtaccgaacgaacgaacgaacgtaaccgacggtaacgtaacgtacgtacgtacgtaacgtaacgtacgaacgtacgtaagtacgtacggacgtaacgtaacgttaacggtaacgttaacgtaaacgtaacgttaacgttacgttacgttaacgtacgtaacgtaacgtacgttaacgtaacggttaacggtaaccgg

SEQ ID NO: 404961 - DNA, 693 bp, Homo sapiens
  misc_feature: GZ8MTXP01A2JKM.52.19.B08.1.454.CMB.2.raw
  modified_base (192)..(192): a, c, t, g, unknown or other
  modified_base (218)..(218): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgaccctagtcctccttcctccctgtcctgctatctagtagganacagaatcaccatcacttggccgggngagtcgagactattagctatgtatcgtgtaattggatacgaagacgaaaaaggtacggacaaccgtaccctaaactcctgaactccgtagatcgactactacctacgtttacgggaacgtaccgtacgggggtcccctaagttacccccgtaagggttaccgaagggtgggtaaacgttcgggcgttcggtacggggaacttaaaggtttacctttttacgtacaaccgtagtacccgaagtcccggtaaggccgttgcgtaaacggtccgtaagtaacggttgttacgtactaactaacttagttaactttacgtacgtaactaactaacgttactaccgttacccgtcctacccgtacgtaccgggttcgggttaacccgggggaacggggttacgtagggttacggaaagtaccggttaacgacggttaccgttaacggtcgtaacggtacctacggaccctcgttcgttcg

SEQ ID NO: 404962 - DNA, 773 bp, Homo sapiens
  misc_feature: GZ8MTXP01BGZD9.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagatcaccatcacttgccgggcgagtcgagacattagcatgtatctagaattgatacagacaaaagtagggacacgacccctaatcctagactcctacgatcgactactacccgtaacgtttcgggaacgaccgtacgggggtacccaacgtaccgtaaagggtttacgagggtagggtaaggttcgggtacgttaacggtaggggaaaccctttaaagggtacttttttaacccggttacctaacccggtaaattccgtaaacggaccttaaggggtccctaggacccgtaaacggcccgtttaaaggggaattaccgttagggttaccgaactaaaccgttaagtttaaacgtttaactacggttaaacctaaaaccggtaagttaaacgttaaaacttccccggttaacctcccccgggtaactttcccgggttaaaccgggttttaaccggggggacccggggggggttaaacccgtaaagggggttaccggaaacggggttaaacgaaaccgggttaaacgggttaccggtaacggttccgggtaacggtcccggtacgacccgtaaccgtttcgtaaccg

SEQ ID NO: 404963 - DNA, 681 bp, Homo sapiens
  misc_feature: GZ8MTXP01DDQJG.52.19.B08.1.454.CMB.2.raw
  modified_base (626)..(626): a, c, t, g, unknown or other
  modified_base (664)..(664): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgacccagtcctccttcctcctgtctgcatctagtaggagacagatcacatcacttcggccggagagtcgagacattagctatgtatctagtaattgatacaagaacgaaaaaaggtggaacaaccgtacccctaaactcctagtaactcccgtacgaattcgactactacccttaacggtttacgggaacgtaaccgtaacgggggtaccctaagttaccgtaaagggtttacgaagggtaggggaaacgttcgggtacgttcggtacggggtaaacttacggtttaatttttacccgttactaacctactaccgaagccgtaacgggcttacggacgaaccgtacgtaaggtaagtagttcggtaagtaacctaaacttaattaacgtttaactaacggtacctaaagtaagttacttaacttccggtacctcccggtctaccggtacggttcggggacgggggacttaaaggggngaaacgcttaggacgacggtaacgtggttccgcgtacnccgtaacttggtttccg

SEQ ID NO: 404964 - DNA, 753 bp, Homo sapiens
  misc_feature: GZ8MTXP01C7IWP.52.19.B08.1.454.CMB.2.raw
  modified_base (187)..(187): a, c, t, g, unknown or other
  modified_base (211)..(211): a, c, t, g, unknown or other
  modified_base (234)..(234): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctagtagganacagaatcacatcacttggccggngagtcgagacattagcatgtatntagtatgatcgaagaacgaaaaggtggaaccacgtaccctaaactccgtagtactccctgatcgacctactacccgttaacgtttacgggaacgtaaccggtacgggggtacccctaacgttaacccggtaaacggggtttacgagggttagggggtaaacgttcccggggtaccgtttaaccgggtaagggggtaaaccctttaaacgggttttaaaccttttttaccccgtttaacctaaaccccgtaagttacccgaaaggtccggtaacggggcctacggaccgaacggtacccgtttaagaaaggttcttaggttaccgaaattaaacccgtagtttaaactttacgtaacgtaactaaaacgttacgttaacttaaccgttccccggttccctccccgtacgtacccgtttacgggttcccggggggaaccggggttaacgtaaggggttagtaaacgtcgttaaacggacgttaccggaagttgaacggtcgacgttccgaaccttgttccg

SEQ ID NO: 404965 - DNA, 756 bp, Homo sapiens
  misc_feature: GZ8MTXP01BBI2G.52.19.B08.1.454.CMB.2.raw
  modified_base (188)..(188): a, c, t, g, unknown or other
  modified_base (214)..(214): a, c, t, g, unknown or other
  modified_base (239)..(239): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgaccagttcctccttcctcctgtctgcatctagtagganacagactcacatcacgttcggccggnagtgaagactattagctatgtactntagtaattggatacgaagtaaacgaaaaagtcgggaacctaaccgtacccctaaactccgtacgaaccttccgtacgtactcgtactacttacccgtaacgtttacgggaacgtaccggtaccggggtaccctaaacgttaccccggtaaagggtttacgtaaggggtacgggtaacgttcgggtacgtccgggttagggtaaaccttaacgtttaccttttaccgttaccaacgtacgttcaaacggtcaaccgggttgaccgttacgacgtaccgtaaggaacgttacgtaggtaactaaccaaagtttaattaaccgtttaacggtaacttaacctaaaagtaacccgttaatttaaccgttacccccggttctaccccggtactttacccggggtacccgggtttaacggggggcccgggttaaaccggaagggttacggaaagtaacggttacgttaacgggaccgttaaacgtgggtaaccgtcggttaccgactaacccggtttgttccg

SEQ ID NO: 404966 - DNA, 492 bp, Homo sapiens
  misc_feature: GZ8MTXP01DYV1G.52.19.B08.1.454.CMB.2.raw
  modified_base (186)..(186): a, c, t, g, unknown or other
  modified_base (211)..(211): a, c, t, g, unknown or other
  modified_base (273)..(273): a, c, t, g, unknown or other
  modified_base (337)..(337): a, c, t, g, unknown or other
  modified_base (368)..(369): a, c, t, g, unknown or other
  modified_base (372)..(374): a, c, t, g, unknown or other
  modified_base (388)..(388): a, c, t, g, unknown or other
  modified_base (390)..(390): a, c, t, g, unknown or other
  modified_base (392)..(392): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcgacttgccggnagtcgagacattagcatgatctgaattggatcaagacaaaaagtagggacagcccctaaaancctagattccctgatgcatcacttgtagacaggtccgatacccagttacgagtggaagtaaggntcgtgggacgagtatttacttctacatacannagnnnacgcagagatgtanananatattatatacaacatatactactctcctactctcgttcggtacgggacggaacgaggagacgacgacgacgaacgtagtcgtcgtcgactaacaactcg

SEQ ID NO: 404967 - DNA, 736 bp, Homo sapiens
  misc_feature: GZ8MTXP01A60KF.52.19.B08.1.454.CMB.2.raw
  modified_base (222)..(222): a, c, t, g, unknown or other
  modified_base (482)..(482): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctataggagacagaatcacatctacgttggccggagagtcgaanactattagctatgtatctagaattcggatacaagtaacaaaaggtacggactaaccgaaccccttaactcctacgactccgtagatgactactacctttacggtttacgggacgtaaccggtacgggggtacccaacgtttaccccgtaaaggttaccgtaagggtacgggtaaacggtcgaccgttcggtaacgggtacgtacggtttaacttttaccttacgtaaccagttccgagacgtacggatcgacgaccggtntacgagtacgtagttacgaactaacctagtttaacgttacttacggtaacctaaaggttacgttaacttaaccttacccgggttcccttaccccgtatttaacccggggtacccggtttaacggggggtaacccggggggaaacgtaaaccggggttgggtaaacgtaacgttacgggaaaccggttacggtaaacccggtttagggcccggggtaaccttacgacccgttaaaccggttcttttaaccccggg

SEQ ID NO: 404968 - DNA, 501 bp, Homo sapiens
  misc_feature: GZ8MTXP02F6TW1.52.19.B08.1.454.CMB.2.raw
  modified_base (390)..(390): a, c, t, g, unknown or other
  modified_base (404)..(404): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggatcagacaaaaaagtagggacagcccctaaaatcctgatcctcgatgcatccactttggagacaggggtcccatccaaggttcagtggaagtggctcgtgggactagtatttacttcacatcagcagctgcagcctagaagatgttanacaatattatactntacaataagtaatactcgtctccgactcgtacggttcgggacggggtaacaggtagaacgacgtacgaagacgaacgtggtacgctcgacactatcg

SEQ ID NO: 404969 - DNA, 535 bp, Homo sapiens
  misc_feature: GZ8MTXP02FZP28.52.19.B08.1.454.CMB.2.raw
  modified_base (399)..(399): a, c, t, g, unknown or other
  modified_base (403)..(403): a, c, t, g, unknown or other
  modified_base (416)..(416): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcaagacaaaaaggtagggacacgacccctaaactcctgactcctgatgcatccatttggacgacgaggggtacccatccgaaaggttcaggtaggaagtggctcgtgggactagtacttttacttcaccatcagcaggctgcagcctagaagtntgtnacaatatattacntacaatagtataactcgtacctcccgtactccgtacgtttccggggcgggggtaaacctaggggtaggaagtactaccgaaggacgaaacgttggacggactggaccaaccgttcttcg

SEQ ID NO: 404970 - DNA, 585 bp, Homo sapiens
  misc_feature: GZ8MTXP02FW49E.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagacaaaaagtagggacacgacccctaaactcctgactcctcgatgcatccactttggagacgaggggtcccatccaaggttcagtggaagtggctcgtgggactagttactttctacactatacgagcgaggctacgcgacgtccgtaagaagttgttagtacgaacctaaatatttacttacgttagtaacctaaataagttacttaacgtccgttaccacccgtctaccgttaccggggtttaccgggggacgggggtaaccgagggttacggaacgtacgtaacggaacggtacgtaacggttcgggtaggtcgtacgaccctaacgtctttccg

SEQ ID NO: 404971 - DNA, 591 bp, Homo sapiens
  misc_feature: GZ8MTXP02G1YX6.52.19.B08.1.454.CMB.2.raw
  modified_base (380)..(380): a, c, t, g, unknown or other
tcagcgcagtacgacacgaccggtgctcgatttagtgagtcagtaagggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagacaaaaaagtagggacagacccctaaaatcctgatcctcgatgcatccactttggagacgaggggtcccatccaaggttcagtggaagtggctctgggactagttatttacttcactatacgagacgaggtcngacgacgtacgtagtaagtagtagtacgtaactaactaattaacttacgtacgtaacgtaactaagtaacttaacgttacgtaccgtacccgtaccgttaccgttaccggttaccggggtaccggggtaaccgggtaacgggtacggtaacggtacgtaacgtaacggtaacgtaacgtacggtacggtacgtacgtacgtacctacgtcg

SEQ ID NO: 404972 - DNA, 514 bp, Homo sapiens
  misc_feature: GZ8MTXP02GWNA0.52.19.B08.1.454.CMB.2.raw
  modified_base (186)..(186): a, c, t, g, unknown or other
  modified_base (211)..(211): a, c, t, g, unknown or other
  modified_base (303)..(303): a, c, t, g, unknown or other
  modified_base (387)..(387): a, c, t, g, unknown or other
  modified_base (392)..(392): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggnagtcgagacattagcatgtatctgaattggtatcagacaaaaagtagggacagacccctaaactcctgatcctcgatgcatccactttgganacgaggggtcccatcccaaggttcagtggaagtggctcgtgggactagtatttacttcacatcagcagctgcagcctagaagtntgtanactaatatattatatacaatatatactcgtacctccgtctacgtacggttcggggacggggtaacgtaggtaggaacgtacgacgaacgacgaacgtggtacgtctacgacctaccgtatcg

SEQ ID NO: 404973 - DNA, 523 bp, Homo sapiens
  misc_feature: GZ8MTXP02H0JRZ.52.19.B08.1.454.CMB.2.raw
  modified_base (258)..(258): a, c, t, g, unknown or other
  modified_base (336)..(336): a, c, t, g, unknown or other
  modified_base (351)..(351): a, c, t, g, unknown or other
  modified_base (416)..(416): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggaggcgtggtccagcctgggaggtccctgagactctcttgtgctgcctntggattcacttcaggtctatgacatgcacgtgggtccgcaggcctccgaggcaaggggctgggagtgggtgctattanatcatatgatggaancagatatactatgtagacttccgtagaggccgattcatcatcacagagacaactaccgagaaacncgactagtatctagacaaaatgaatcgaaggctaggagagtcagaaagaactacggtactttaatattaacgtgtacgacgtaaaactttaagtccgaacgggaagg

SEQ ID NO: 404974 - DNA, 512 bp, Homo sapiens
  misc_feature: GZ8MTXP02IYFK3.52.19.B08.1.454.CMB.2.raw
  modified_base (389)..(389): a, c, t, g, unknown or other
  modified_base (405)..(405): a, c, t, g, unknown or other
  modified_base (433)..(433): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcagtcgagacattagcatgtatctgaattggtatcagacaaaaagtagggacagaccccctaaatcctgatcctcgatgcatccactttggagacaggggtccatccaaggttcagtggaagtggctcgtgggactagtattttacttcactatcagtcagctgcagcctgaagatgtnacaacattacttagtntacaactagtattaatcgtacttcccgnttacgtacgtttcggggcgggggtaaaccaggggtaggagtacgtcgaagacgaactcggtagctgacctacactttcg

SEQ ID NO: 404975 - DNA, 498 bp, Homo sapiens
  misc_feature: GZ8MTXP02G90WG.52.19.B08.1.454.CMB.2.raw
  modified_base (186)..(186): a, c, t, g, unknown or other
  modified_base (412)..(412): a, c, t, g, unknown or other
  modified_base (464)..(464): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcgagtcgagacattagcatgtatctgaattggtatcagacaaaaagtagggacagacccctaaatcctgatcctcgatgcatccactttggagacgaggggtcccatccaaggttcagtggaagtggctcgtgggactagtatttacttcacatcagcaggctgcagcctagaagatgttgacaactatattactgactaanagtataactcgtactccgtctctacgtttcgggcgggggtaccaaggtgganactacgaagcgaacgtgcggactgaccacattcg

SEQ ID NO: 404976 - DNA, 556 bp, Homo sapiens
  misc_feature: GZ8MTXP02IWS65.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggcagtcgagacattagcatgtatctgaattggtatcagacaaaagtagggacacgacccctaaactcctgatcctcgatgcatccacttggacacgtaggggtccatccaaggttcagtaggaagtggctcgtgggactagtatttacttcacctatcagtcaggctgcagcctagaagtagtgttcgactaaactattaactttactagttacaaaactagttaataaacttccgtactccccgtattccgtaacgtttcggggacgggggtacctaaaggggtcggaagtacgtaccgaaggaccgtaaacgtcggtacgggtactacggacctacgtactttccg

SEQ ID NO: 404977 - DNA, 510 bp, Homo sapiens
  misc_feature: GZ8MTXP02JGQYF.52.19.B08.1.454.CMB.2.raw
  modified_base (186)..(186): a, c, t, g, unknown or other
  modified_base (274)..(274): a, c, t, g, unknown or other
  modified_base (341)..(341): a, c, t, g, unknown or other
  modified_base (386)..(386): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcagtcgagacattagcatgtatctgaattggtatcagacaaaaagtagggacagccccctaaancctgactcctcgatgcatccactttggagacaggggtcccatccgaagttcagtggaagtggctcgngggacagtatttacttcaccatcagcaggctgcagactagaagtntgttgactaaacattacttactgtacaaactagtaatatcgtctcccgattcacgtttcgggacgggggacctaagggtcggaacgtgtacgaagtcgaaacgtggtcggcagaccacattccg

SEQ ID NO: 404978 - DNA, 529 bp, Homo sapiens
  misc_feature: GZ8MTXP02HRTF8.52.19.B08.1.454.CMB.2.raw
  modified_base (186)..(186): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcagtcgagacattagcatgtatctgaattggtatcaagacaaaaagtagggacagacccctaaatcctagactcctcgatgcatcctactttggagacgaggggtcccatccaaggttcaggtggaagtggctcgtgggactagtattttacttcacctatcagcaggctgcagcctagaagattgttgactaaactattactttactagttacaaactagtaattaactcgtcctaccgctcgtacgtttcgggacgggggtaccaaggtggaacgacgtacgaagacgaacgtggacggctcgaccactacgttccg

SEQ ID NO: 404979 - DNA, 554 bp, Homo sapiens
  misc_feature: GZ8MTXP02G6ATF.52.19.B08.1.454.CMB.2.raw
  modified_base (185)..(185): a, c, t, g, unknown or other
  modified_base (208)..(208): a, c, t, g, unknown or other
  modified_base (395)..(395): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagaatcacatcacttgccggngagtcgagacattagcatgtatctgaattggtatcagacaaaaagtagggacagacccctaaatcctgactcctacgatgcatccactttggagacgaggggtcccatccgaaaggttcaggtaggaagtggctcgtgggactagtattttacttcacctatcagcaggctgcagccctagaaagtntgtagactaataattacttacagtaacaaatagttaataacgtccgtcctcccgtcttaccgtacggtttaccggggaccgggggtaaacgtaagggtcggaaacgtacgtaacgaacggaccgtaacgtcggtacggtactacgacctaccgtactcg

SEQ ID NO: 404980 - DNA, 536 bp, Homo sapiens
  misc_feature: GZ8MTXP02ILZGK.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggcgagtcgagacattagcatgtatctgaattggtatcagacaaaaagtaggacacgacccctaaatcctgactcctcgatgcatccctacgtttggagtacgaggggtacccagtcccgaaaggttcagtggaagtggctcgtgggactagtattttacttcactatcagcagctgctagcctagaagtatgttgacaaactaatatttactagtaccaaatagtaataatcgtcctccgtctaccgtacgtttcggggacgggggtaccaaaggggtcggatacgtacgaagacggaaagttggacggctagacctaacgtacttcg

SEQ ID NO: 404981 - DNA, 513 bp, Homo sapiens
  misc_feature: GZ8MTXP02INC3Y.52.19.B08.1.454.CMB.2.raw
  modified_base (361)..(361): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggcgagtcgagacattagcatgtatctgaattggtatcagcaaaagtagggacagcccctaaactcctgatcctcgatgcatcccactttggagacaggggtcccatccaaggttcagtggagtggctcgtgggacagtactttacttcactanctagcgagtctgcgacgccgttagaagtataggttcaacaaactattatttatcttacaaactagtaataactcgtctccgctctacggttcgggacggggtagacggtgagtacgacgaagccgtaagtcgcggtactgacctactattcg

SEQ ID NO: 404982 - DNA, 555 bp, Homo sapiens
  misc_feature: GZ8MTXP02FSTAZ.52.19.B08.1.454.CMB.2.raw
  modified_base (186)..(186): a, c, t, g, unknown or other
  modified_base (300)..(300): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcagtcgagacattagcatgtatctgaattggtatcagacaaaaagtagggacagcccctaaatcctgatcctgatgcatccactttgganacaggggtcccatccaaggttcagtggaagtggctcgtgggactaagttacttttacttacactatacgagacgagtctgcgacgccgtagaagttagtagtacgaactaatattacttacgtacgtaactaagtaagtaagtactcgtcctccgtacgttacgtacggttaccgggggacgggtaacggtacggtacggaacgtacgtacgaacggtacgtaacgtcggtacgtacgtacgacctacgtactcg

SEQ ID NO: 404983 - DNA, 517 bp, Homo sapiens
  misc_feature: GZ8MTXP02JL3ZG.52.19.B08.1.454.CMB.2.raw
  modified_base (401)..(401): a, c, t, g, unknown or other
  modified_base (403)..(403): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggcagtcgagacattagcatgtatctgaattggtatcagacaaaaagtagggaacagacccctaaactcctgactcctcgatgcatcccactttggagtacgacggggtacccataccaaggtttcaagtggaagtggctcgtgggactagtatttacttcaccatacagcaggctgcagcctagagatgttananatatatactatacaatatatactcgtctccgtactcgtacggttcgggacgggtacgtagggtaggaacgtactacgagacgtaacgtggtacgacgtacgacctactacgtcg

SEQ ID NO: 404984 - DNA, 502 bp, Homo sapiens
  misc_feature: GZ8MTXP02JY5JT.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagacaaaaagtagggacagcccctaaactcctgatcctcgatgcatccactttggagacaggggtcccatccgaagttcagtggaagtggctgtgggacagtatttacttcacatcagcaggctgcagcctagaagatgttgcaaacatattactagtacaaacagtataactcgtactccccgtctacgacgtttcgggacgggggtaccaaggggtaggagactacgaaggcgaacgtggtgctgcacctatcg

SEQ ID NO: 404985 - DNA, 504 bp, Homo sapiens
  misc_feature: GZ8MTXP02JS2HE.52.19.B08.1.454.CMB.2.raw
  modified_base (186)..(186): a, c, t, g, unknown or other
  modified_base (385)..(385): a, c, t, g, unknown or other
  modified_base (434)..(434): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcagtcgagacattagcatgtatctgaattggtatcagacaaaaagtagggacagacccctaaactcctgatcctcgatgcatccactttggagacgaggggtcccatccgaaggttcagtggagtggctcgtgggacagtatttacttcaccatcagcaggctgcagcctgaagntcgttagacaactatattactgttacaactagtataactcgtactccgntcgacgtttcgggacggggtaccagggtcgacgtactacgaagcgaacgtggtcggctgcaacctagtcg

SEQ ID NO: 404986 - DNA, 563 bp, Homo sapiens
  misc_feature: GZ8MTXP02HFJ5F.52.19.B08.1.454.CMB.2.raw
  modified_base (298)..(298): a, c, t, g, unknown or other
  modified_base (329)..(329): a, c, t, g, unknown or other
  modified_base (337)..(337): a, c, t, g, unknown or other
  modified_base (351)..(351): a, c, t, g, unknown or other
  modified_base (353)..(353): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagcctgggagtccctgagactctcttgtgctgcctctggattcaccttcgagggtctatgacatgcactggggtcccncaggctccgaggcaaggggctgggagtgggngctattantcatatgatggaananagatatactatagtacgctcggagacggcctatcatcactcacaagacacaacgtacgaacgaaccgacgtactagtactactacgaactaaagtgaactcgacggtcgtaggaacgagtacgtaacgaaacggtaacgtacggttactttaagtaacgtttaacgtacgtaacggtacgttaaacttaacgtaccggtaacgggtaacg

SEQ ID NO: 404987 - DNA, 498 bp, Homo sapiens
  misc_feature: GZ8MTXP02I0VBX.52.19.B08.1.454.CMB.2.raw
  modified_base (389)..(389): a, c, t, g, unknown or other
  modified_base (425)..(425): a, c, t, g, unknown or other
  modified_base (431)..(431): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtgggacagacccctaaatccctgatcctcgatgcatcccatttggagacaggggtcccatccaaggttcagtggaagtggctcgtgggacagtatttacgttcacatcagtcaggctgcagcctagaagatgtnacaaactatattactgtaccaaatagtataatctcncccgtntcacgtttcggcgggggtacagggtggatagtacgaagcgaacgtggtacgctacgcacctattccg

SEQ ID NO: 404988 - DNA, 536 bp, Homo sapiens
  misc_feature: GZ8MTXP02H9YJ3.52.19.B08.1.454.CMB.2.raw
  modified_base (186)..(186): a, c, t, g, unknown or other
  modified_base (380)..(380): a, c, t, g, unknown or other
  modified_base (396)..(396): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcgagtcgagacattagcatgtatctgaattggtatcagacaaaaagtagggacagcccctaaatcctgatcctcgatgcatccactttggagacaggggtcccatccaaaggttcaggtggaagtggctcgtgggactagtattttactttcacctatccagcaggctgnagcctgaagatgttanactaactattattactagtacaatagttaatacttcgtacctcccgtcgtacgtaccggtttacggggacgggggtaaccgtaagggtacggaacgtacgtacgaacgacgtaacgtggtcggactcgacctactactcg

SEQ ID NO: 404989 - DNA, 502 bp, Homo sapiens
  misc_feature: GZ8MTXP02GOSTH.52.19.B08.1.454.CMB.2.raw
  modified_base (428)..(428): a, c, t, g, unknown or other
  modified_base (445)..(445): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagacaaaaagtagggacacgacccctaaatccctagactcctcgatgcatcctactttggacgacgacggggtcccagtaccgaaaggttcaggtggaagtggctcgtgggactagtattttacgttcacatcagtcagctgctagcctagaagtatgttgacaactatattactgtacaanagtatatcgtactccgntcgcgttcgggcggggacaggtgacgagtcgaagcgaacgtggcggctgcacattcg

SEQ ID NO: 404990 - DNA, 512 bp, Homo sapiens
  misc_feature: GZ8MTXP02H04U2.52.19.B08.1.454.CMB.2.raw
  modified_base (211)..(211): a, c, t, g, unknown or other
tcagcgcagtacgacacgaccggtgctcgatttagtgagtcagtaaggggcagtcctaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggngagtcgagacattagcatgtatctgatggtatcagacaaaagtagggacagacccctaaactcctgactcctcgatgcatccatttggagacgaggggtcccatccaaggttcagtggaagtggctcgtgggacagttatttactttcactatcagcaggctgcagcctgaagatgttagactaaactatatttactagtacaacagtaataatcgtactccgctacgtacgtttcgggacgggggtaccaaggtaggagacgtacgaagacgtaacgtgtacggctagaccacgtactcg

SEQ ID NO: 404991 - DNA, 687 bp, Homo sapiens
  misc_feature: GZ8MTXP02G4N0Q.52.19.B08.1.454.CMB.2.raw
  modified_base (188)..(188): a, c, t, g, unknown or other
tcagcgcagtacgacacgaccggtgctcgatttagtgagtcagtaagggcagtcccaaccaggacacagcatggacatgagggtccctgctcagctcctggggctcctgctgctctggctctcaggtgtcagatgtgtcatccagatcgaccctagtcctccttcctccctgtctgcatctatagganacagaatcaccatccacttcggccgggcgagtcgagacattagctatgtatctgaattggtatcaagaacaaaaggtaggacacgacccctaaactccagactcctgatgctactacctacgttggaacgtacgacggggtccagtacccgtaaggtcaggtacggtagttggctggtacgggtactacgttacttttaccttcgaactatcgaacgtccgagtccgagtaccgtacgaccgttagaaagttcgttaggttacgaaacctaaacgttaaatttacctttaaggtacgtttaacccaaaagttaacggtttaaacttaacggtacccgttacccgttacccgggttccttaaaccggttacccgggggtttaaccgggggaacccgggggttaaaccgtaaaacggggttcgggaaagttacccggtaaacgaaaccggtcccggtaaagtttcggcggtacttaaccggccgtaaccgtacgtttcccg

SEQ ID NO: 404992 - DNA, 510 bp, Homo sapiens
  misc_feature: GZ8MTXP02FVQCI.52.19.B08.1.454.CMB.2.raw
  modified_base (268)..(268): a, c, t, g, unknown or other
  modified_base (294)..(294): a, c, t, g, unknown or other
  modified_base (333)..(333): a, c, t, g, unknown or other
  modified_base (340)..(340): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggagcgtggtccagcctgggagtccctgagactctcttgtgctgcctctggattcaccttnaggtctatgacatgcactgggtcccncaggctccaggcaaggggctgggagtgggtgctatttanatcatangatggaagcagatatactatgtagactccgtagaagggccgatcatcatctccagacgaacaactaccgaagaacacgctgtatctgacaaatgatcgaggctagagagctagaacgacacggtactttataattaacgtgtacgacgtaactaatacgaacggtaacgg

SEQ ID NO: 404993 - DNA, 543 bp, Homo sapiens
  misc_feature: GZ8MTXP02HM2PP.52.19.B08.1.454.CMB.2.raw
  modified_base (298)..(298): a, c, t, g, unknown or other
  modified_base (367)..(367): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagcctgggagtccctgagctctcttgtgctgcctctggattcaccttcagggtctatgacatgcacgtcggggtcccnccagggcctcccgaggccgaaagggggctggggagtggggtggctatttatatccgattatgatggaancagattaatactatgtaagactccgtagaacgggccgtaattcatcactctaccagaacgacaactaccgagaaaccactctagtacttcagacaaatgaactcgaggctaggacgagctaagagacacgtactttaatattaacgtgtacgactaaactactacgaacggaacgg

SEQ ID NO: 404994 - DNA, 567 bp, Homo sapiens
  misc_feature: GZ8MTXP02F2M4N.52.19.B08.1.454.CMB.2.raw
  modified_base (278)..(278): a, c, t, g, unknown or other
  modified_base (402)..(402): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctagaattggtatcagacaaaagtaggacacgacccctaaatccngactcctagatgcatcctattggagacgaggggtcccatccgaaggttcaggtaggaagtggctgtgggactagtattttacttacacctatcagcaggactgcacgcctagaacgtatagttnaactaactattaatttacctagtaccaaactaagttaacttaagtaccgttcctaccccgtcttaccgtacggtttacggggaccggggggtaaacctagggggtacggagtacgtacgaaaggacgtaacgtcggtacggacgtacgactacccgtatttcccg

SEQ ID NO: 404995 - DNA, 565 bp, Homo sapiens
  misc_feature: GZ8MTXP02JJP5H.52.19.B08.1.454.CMB.2.raw
  modified_base (402)..(402): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttggccgggcagtcgagacattagcatgtatctgaattggtatcagacaaaaagtagggacagacccctaaaactcctgaactcctcgatgcatccactttggagacaggggtccatccgaaggttcagtcggaagtgctcgtgggactagtatttactttacacctataccagccagggctgcagcctagaagatgttanacaactatattactagttacaaactagttactaaactcgtactcccgtactcgtacggtttcgggaccgggggtaacctaaggggttccggaagttacgtaccgaaaggaccggtaaagttcgggttaacggggcttacgggaccgtaccctaaggtttcccg

SEQ ID NO: 404996 - DNA, 619 bp, Homo sapiens
  misc_feature: GZ8MTXP02J4MMW.52.19.B08.1.454.CMB.2.raw
  modified_base (186)..(186): a, c, t, g, unknown or other
  modified_base (248)..(248): a, c, t, g, unknown or other
  modified_base (416)..(416): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcagtcgagactattagcattgtatctgaattcggtaanacaagaacaaaaggcggacacctaccctaactctagactcctagatcgactacttaccgtacggttagggaacgacggtaaccggggtacctagtaccgtaggttacgaggtagggtaggtcggttcgtcggtacggtaacttagtttacttttactactacacgtanacgacgacgacgcgcgacgtacgtacgtaagtaagtagttacgtactaactaacttattacttacgtactaactaacgtaactaactacgtaccgtaccgtaccgtaccgtaccggttacgggtacggggtacgggtacgggtaacgggacggtaacgtacgaacgacgtaacgtacgtacgtacgtcgtaccgtactactac

SEQ ID NO: 404997 - DNA, 550 bp, Homo sapiens
  misc_feature: GZ8MTXP02FYU73.52.19.B08.1.454.CMB.2.raw
  modified_base (186)..(186): a, c, t, g, unknown or other
  modified_base (211)..(211): a, c, t, g, unknown or other
  modified_base (405)..(405): a, c, t, g, unknown or other
  modified_base (457)..(457): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggnagtcgagacattagctatgtatctagaattggatcaagacaaaaaggtagggacacgacccctaaatcctagactcctcgatgcatcctagttggagacgaggggtcccataccgaaggttcaggtaggaagtcgctcgtgggactagttatttacttcacctatcagtcaggctgcagcctagaagtatgttnaacaactattacttactgttaacaaacgtattataacttccgtactcccgtntaccgtacgggttcggggaccgggggaactaggggtaggaacgtacgtacgaacgtaccggtaagtggtacggctacggaccaactacttccg

SEQ ID NO: 404998 - DNA, 592 bp, Homo sapiens
  misc_feature: GZ8MTXP02I5OMV.52.19.B08.1.454.CMB.2.raw
  modified_base (186)..(186): a, c, t, g, unknown or other
  modified_base (210)..(210): a, c, t, g, unknown or other
tcagcgcagtacgacacgaccggtgctcgatttagtgagtcagtaaggggcagtcccaaccaggacacagcatggacatgagggtccctgctcagctccgtggggctcctgctgctctggctctcaggtgtcagatgtgtcatccagatgacccagtctccttcctcctgtctgcatctatagganacagaatcaccatcacttgccggnagtcgagacattagctatgtatctagtaattggtatcagacaaaaagtaggacacgacccctaaactcctagactcctcgatcgactactccctacgtttggacgacgtacggggtacccagtaccgtaaggttcacggtaggaagtcggactcggtagggactagttactttaccgttcaacctatacgagcgacggtctagaccgagtaccgtagaagtagttagtacgactaaacttaattaacttacgtactaactaaatagttaataacttccgtacctcccgtactacgtacggtttaccgggggaccggggtaaccgtagggtacgacgtacgtaccgaaggtaccgtaagcgtcggctacgacaccgtattccg

SEQ ID NO: 404999 - DNA, 502 bp, Homo sapiens
  misc_feature: GZ8MTXP02J3L6L.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctataggagacagaatcaccatcacttgccgggcgagtcgagacattagcatgtatctgattggtatcagacaaaagtaggacagcccctaaactcctgatcctcgatgcactccactttggagacgacggggtccagtccaaggttcaggtaggagtggctcgtgggactagtatttacttcacatcagcagctgcagctagagatgttagactaacatattactgtacaacgtatattaactcgtctaccgctacgacgtttcgggacgggggtaccaggtggacgacacgaagacgaacgtgtcggctacgcacctactcg

SEQ ID NO: 405000 - DNA, 494 bp, Homo sapiens
  misc_feature: GZ8MTXP02FR43L.52.19.B08.1.454.CMB.2.raw
  modified_base (387)..(387): a, c, t, g, unknown or other
  modified_base (413)..(413): a, c, t, g, unknown or other
  modified_base (431)..(431): a, c, t, g, unknown or other
  modified_base (491)..(491): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcagtcgagacattagcatgtatctgaattggtatcagacaaaaagtaggacacgacccctaaatcctgatcctcgatgcatccactttggagacgaggggtcccatccaaggttcagtggaagtggctgtgggactagtattttacttcaccatcagcaggctgcagcctagaagtntgtgacaaactatattactgtacaanagtataatcgtctcccgntcgtacgttcgggcgggggtaccaagggtgagtactacgagccgaagtgtcgctgcactntcg

SEQ ID NO: 405001 - DNA, 517 bp, Homo sapiens
  misc_feature: GZ8MTXP02GHW7A.52.19.B08.1.454.CMB.2.raw
  modified_base (298)..(298): a, c, t, g, unknown or other
  modified_base (397)..(397): a, c, t, g, unknown or other
  modified_base (432)..(432): a, c, t, g, unknown or other
  modified_base (434)..(434): a, c, t, g, unknown or other
  modified_base (441)..(441): a, c, t, g, unknown or other
  modified_base (443)..(443): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggaggcgtggtccagcctgggaggtccctgagactctcttgtgctgcctctggattcaccttcaggtctatgacatgcacgtgggtcccnccaggcctccgaggcaaggggctgggaggtgggtggctagtttatatccatatgatggaagcagatatactatgtagactcgtagacgggcatcatcanctcaagacgacaactcgaagaacacgctgtatcananaatagananagagagacgagagacgaacgacgacgtacttattattaagtacgtacgtacgtaacgtaacgtacgacggaacg

SEQ ID NO: 405002 - DNA, 549 bp, Homo sapiens
  misc_feature: GZ8MTXP02GDAN4.52.19.B08.1.454.CMB.2.raw
  modified_base (349)..(349): a, c, t, g, unknown or other
  modified_base (355)..(355): a, c, t, g, unknown or other
  modified_base (379)..(379): a, c, t, g, unknown or other
  modified_base (411)..(411): a, c, t, g, unknown or other
  modified_base (433)..(433): a, c, t, g, unknown or other
  modified_base (469)..(469): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagcttgggttttcctcgttgcttcttttaagaggtgtccagtgtcaggtgcaactggtggagtcgtgggggagcgtggtccaggccgtggggacggtccctgacgactctcttgtgctgcctctggattcaccttgagggtctatgacatgcacgtgggtccccgaggcctccgaggcgaaggggctgggaggtggggtgctatttanatcatngatggaagcagatatactatgtanactcgtagaaggcctatcatcatcctacaganaaccactaccgaacaacacgtntagtatcgtagacaaatgactcgagggtctaggaanacgacgtaggaaacgacgtaccggttactttaagtacttaacgtgtacgtacgtaaactttaacgacggaacggaaccgg

SEQ ID NO: 405003 - DNA, 510 bp, Homo sapiens
  misc_feature: GZ8MTXP02GK0PC.52.19.B08.1.454.CMB.2.raw
  modified_base (249)..(249): a, c, t, g, unknown or other
  modified_base (257)..(257): a, c, t, g, unknown or other
  modified_base (295)..(295): a, c, t, g, unknown or other
  modified_base (352)..(352): a, c, t, g, unknown or other
  modified_base (435)..(435): a, c, t, g, unknown or other
  modified_base (450)..(450): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctctttaagaggtgtccagtgtcaggtgcaactggtggagtcgtgggggagcgtggtccagccgtgggacgtccctgagactctcttgngctgcctntggattcaccttcaggtctatgacatgcacgtggcccncaggctccgaggcaaggggctgggagtgggtgctagtttatatccatatgatggaancagatatactatgtagactcgtagaggccgattcatcatctcagagacaacgtccgaagaacacgctgtactctagacaaatnatcaggctgacgagntagaaacgacaccgtactttagtacttaacgtgtacgacgtaactactacgaacggaacg

SEQ ID NO: 405004 - DNA, 508 bp, Homo sapiens
  misc_feature: GZ8MTXP02F0UDD.52.19.B08.1.454.CMB.2.raw
  modified_base (187)..(187): a, c, t, g, unknown or other
  modified_base (346)..(346): a, c, t, g, unknown or other
  modified_base (395)..(395): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcaccatcacttgccgggcgagtcgagacattagcatgtatctgaattggtatcagacaaaaagtaggacacgcccctaaactcctgatcctcgatcgcatcccactttggagacgaggggtcccatcccaaggttcagtggaagtggctcgngggacagtatttacttcaccatcagcaggctgcagctagaagtatgtanacaatatatactatacaatataactactcgtctccgtactacgtacggttcggggacggggtacgagggtagacgacgtacgaagacgaacgtgtacgctacgactactatcg

SEQ ID NO: 405005 - DNA, 577 bp, Homo sapiens
  misc_feature: GZ8MTXP02JV681.52.19.B08.1.454.CMB.2.raw
  modified_base (210)..(210): a, c, t, g, unknown or other
  modified_base (388)..(388): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggnagtcgagacattagcatgtatctgaattggtatcagacaaaagtggacagcccctaaactctgatcctcgatgcatccactttggagacgacggggtcccatcccgaaggttcaggtggagtggctcgtgggactagtatttacttcacctatcagcgagctgcagccgtagaagtangttagaccaatattaacttactacgtactaaacctaagttaacttaacgttccggtaccttcccccggacttccgtaaccggttttccggggaccggggggacctaacgggggttcggaagggtacttacgaaacggtacggtaaacgttcggggttaacgaccgttcggaccgtacccgtatttcccg

SEQ ID NO: 405006 - DNA, 600 bp, Homo sapiens
  misc_feature: GZ8MTXP02HNPCQ.52.19.B08.1.454.CMB.2.raw
  modified_base (185)..(185): a, c, t, g, unknown or other
  modified_base (383)..(383): a, c, t, g, unknown or other
  modified_base (394)..(394): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagaatcaccatcacttgccgggcagtcgagacattagcatgtatctgaattggtatcagacaaaaagtagggacagacccctaaatccctagactcctcgaatgcatcccactttggagacgacggggtcccatacccaaaggttcagtaggaaagtgggctcgtagggactaagttacttttacttacactactnagacgacggcncgacgtacgtacgtagaagtagtacgtacaactaactaacttaacttacgttacgtaactaaacgtaacgttaacttaacgttacgtccgtaccgtaccgtacgttaccggttaccggggtacggggtaacggtaacggtaaggtaacgtacgtaacgtaacgtaacgtaacgtacgtacggtacgtacgtacgtacgtacgtacg

SEQ ID NO: 405007 - DNA, 477 bp, Homo sapiens
  misc_feature: GZ8MTXP02GBFBC.52.19.B08.1.454.CMB.2.raw
  modified_base (299)..(299): a, c, t, g, unknown or other
  modified_base (355)..(355): a, c, t, g, unknown or other
  modified_base (377)..(377): a, c, t, g, unknown or other
  modified_base (389)..(389): a, c, t, g, unknown or other
  modified_base (409)..(409): a, c, t, g, unknown or other
  modified_base (422)..(422): a, c, t, g, unknown or other
  modified_base (458)..(458): a, c, t, g, unknown or other
tcagcgcagtacgacacgaccggtgctcgatttagtgagtcagtaagggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcagtcgagacattagcatgtatctgaattggtatcagacaaaaagtagggacagcccctaaatcctgatcctgatgcatccactttgganacgagggtcccatccaagttcagtggaagtggctcgtgggactagtattttacttnacatcagcagctgcagctgaanatgtgataaacnttatactgtacaaatagtanaatcgtactccgntcaacgtttcggacgggggacaggtggacatcgaangaactgtcggctgcacatc

SEQ ID NO: 405008 - DNA, 704 bp, Homo sapiens
  misc_feature: GZ8MTXP02J31JT.52.19.B08.1.454.CMB.2.raw
  modified_base (188)..(188): a, c, t, g, unknown or other
  modified_base (214)..(214): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgacccagtcctccttcctccctgtctgcatctatagganacagaatcaccatcacgttgccgggnagtcgagactattagctatgtatctgtaattggtatacgagaacaaaaggtcggacacgtacccctaaactcctagtactcctagatcgactactaccgtacgtttaggacgtaccgtaacggggtaccctaagtaccccgtaaggttcagggttaggagtggctcgtagggtaactagttattttaccttacaactctacaacgcgaagggtctacggcacggtacctaaggtaagtaacgtttggtacgaacctaaacttattaacgttacctaggtaaacctaaaccgttaagttaaaccgttaaactcccggttacccttaccccggttccgtaacccgggttaccgggtttacccggggggaaccgggggttaaacccgaaagggggttaccggtaaacgggtactaaaccggtaaccgggaaccggtaaccggtttaggtccggggaacctttcggaccccgttaaaccgtacttttaccccgg

SEQ ID NO: 405009 - DNA, 526 bp, Homo sapiens
  misc_feature: GZ8MTXP02JAVW0.52.19.B08.1.454.CMB.2.raw
  modified_base (186)..(186): a, c, t, g, unknown or other
  modified_base (212)..(212): a, c, t, g, unknown or other
  modified_base (522)..(522): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttggccgggnagtcgagacattagctatgtatctgaattggtatcagacaaaaagtagggacacgacccctaaactcctgactcctcgatgcatccactttggagacaggggtcccatccgaaggttcagtggaagtggctcgtgggacagttattttacttcaccatcagtcaggctgcagcctagaagtgtgttgacaactattattactgtacaaactagttataaactccgtactcccgtctacgacgtttccgggggacggggtaccgacgggtaggacgacgtacgaagcgaacgtggtcgactcggacacgtnttcg

SEQ ID NO: 405010 - DNA, 608 bp, Homo sapiens
  misc_feature: GZ8MTXP02JTT9A.52.19.B08.1.454.CMB.2.raw
  modified_base (227)..(227): a, c, t, g, unknown or other
  modified_base (413)..(413): a, c, t, g, unknown or other
  modified_base (589)..(589): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtcgtcatctataggagacagaatcaccatcacttcgccgggcgagtcgacgacatancgatgtatctgtaattggtatcagacaaaaggtaggacacgacccctaacctactgtactcctcgatcgacactcctacctttagggtacgacggaaccgggtccactacgaacggttacaggtaggaaggtggcgtcgtggggactaaggttattttacctttcacctatcgagcgtacgcgtcnccgagccctaggaataagtgttcgacaaacgtacttaaattccttagtaacctaataaagttattaaaccgttcggttccctaacccgccgttacctacgggtttaccggggaccggggggaaacctaggggttagaacgacttacggaacgaccgtaagtcgttggaccggtacncgtaccctagttcgttacc

SEQ ID NO: 405011 - DNA, 504 bp, Homo sapiens
  misc_feature: GZ8MTXP02HQYQH.52.19.B08.1.454.CMB.2.raw
  modified_base (211)..(211): a, c, t, g, unknown or other
  modified_base (283)..(283): a, c, t, g, unknown or other
  modified_base (302)..(302): a, c, t, g, unknown or other
  modified_base (390)..(390): a, c, t, g, unknown or other
  modified_base (417)..(417): a, c, t, g, unknown or other
  modified_base (436)..(436): a, c, t, g, unknown or other
  modified_base (473)..(473): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggnagtcgagacattagcatgtatctgaattggtatcagacaaaaagtagggacagacccctaaatcctgatccncgatgcatccactttgganacgaggggtccatcaagttcagtggaagtggctcgtgggactagtacttttacttcacctatcagcagctgcagcctagaagattgtnactaaactattatttactagttacaanatataatcgtactcccgtntacgtacgtttcgggacgggggtacagggtgacgtanacgaagcgaagtgaggctgaccactattccg

SEQ ID NO: 405012 - DNA, 598 bp, Homo sapiens
  misc_feature: GZ8MTXP02GN46F.52.19.B08.1.454.CMB.2.raw
  modified_base (185)..(185): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagaatcaccatcacttggccgggcagtcgagacattagcatgtatctgaattggtatcagacaaaagtaggacacgacccctaaatcctgactcctcgatgcactccactttaggagacgacggggtcccagtcccgaaggtttcgaggtaggaaggtcggctcgtagggaactagttacttttacgttcactatcagcaggctgcacgcctagaagtagtgttacaactaaactattaacgtttacgtacgtaactaaacgtaacgttaacttaacgtccgtaccttcccgtacttaccggtaccgggtttaccgggggaaccgggggtaaccgtaaaggggtacggaaacgtacgtaacgaacggtacgtaaacggtcgtacggtacgtacgacctaccgtacgttccg

SEQ ID NO: 405013 - DNA, 532 bp, Homo sapiens
  misc_feature: GZ8MTXP02J0S0T.52.19.B08.1.454.CMB.2.raw
  modified_base (304)..(304): a, c, t, g, unknown or other
  modified_base (358)..(358): a, c, t, g, unknown or other
  modified_base (379)..(379): a, c, t, g, unknown or other
  modified_base (390)..(390): a, c, t, g, unknown or other
  modified_base (437)..(437): a, c, t, g, unknown or other
  modified_base (445)..(445): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggaggcgtggtccagccgtggggacgtccctgacgactctcttgtgctgcctctggattcaccttcagggtctatgacatgctacgtggggtcccnccagggcctcccgaggccaaagggggcctaggggaggtggggtggctagtttanatccatatgatggaagcaagntatactatganactccgagacggccgtattcatcatctaccagacgacaactccgaanacacgctntactctgacaaatgatcagctagacgagcagaaacgacacgtactttatattaacgtgtacgacgtaactaactacgaacggaacgg

SEQ ID NO: 405014 - DNA, 828 bp, Homo sapiens
  misc_feature: GZ8MTXP02GNCQ1.52.19.B08.1.454.CMB.2.raw
  modified_base (212)..(212): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttggccgggngagtcgagacattagctatgtatctagaattggtatcagaacaaaagtagggacacgacccctaaatcctagactcctagatcgacacttaccctaacgtttaggaacgtaaccggtacggggtacccctaagtacccggtaaacggtttcgaagggtacgggtaaaggttcgggtacgttcgggttaggggaaccgttaaaggtttaacttttttaaccttaccgaaaccttaacttaccgaaacgttaccggaaacggggtccttacgggaacccgttaacggtaccccgttaaaggggtaaaacggtacgtttaggggttaccgaaaaccgttaaaaaccgttaagttttaaacgttttaaacttacgggttaaaacccctaaaagttaaaaccggttttaaaacttaaaacccgtttcccggtttacccctttaacccccgggttcctttaaaaccgggttaacccccggggtttttacggggggggaaccccgggggttaaaccgtaaaagggggtttcgggaaaacgtaccgttaaccggaaaacggtacgggtaaaccgttgggtaacgggtccgtaccggaacccgttaaccctaaggttttacccgg

SEQ ID NO: 405015 - DNA, 558 bp, Homo sapiens
  misc_feature: GZ8MTXP02FEUC2.52.19.B08.1.454.CMB.2.raw
  modified_base (246)..(246): a, c, t, g, unknown or other
  modified_base (267)..(267): a, c, t, g, unknown or other
  modified_base (295)..(295): a, c, t, g, unknown or other
  modified_base (338)..(338): a, c, t, g, unknown or other
  modified_base (347)..(347): a, c, t, g, unknown or other
  modified_base (359)..(359): a, c, t, g, unknown or other
  modified_base (361)..(361): a, c, t, g, unknown or other
  modified_base (430)..(430): a, c, t, g, unknown or other
  modified_base (434)..(434): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtgagtcgtgggggagcgtggtccagcctgggagtccctgagctctcttgngctgcctctggattcaccttnagggtctatgacatgcacgtgggtcccnccaggcctccgaggcgaaggggctgggagtggggtgcatttanatccattangatacgggaaananagataatactatgtaacgactcgtagaacggcctatcatcactccacagacaacaacgtacgaagaacncgtntagtactcagaactaaagtgaactacgacgtacgagacgagacgacgaaacgtaacgtaacgttactttaattaacgttaacgtacgtacgtaacgtaaacgttaaacgtaacggacggaacgg

SEQ ID NO: 405016 - DNA, 539 bp, Homo sapiens
  misc_feature: GZ8MTXP02G1R60.52.19.B08.1.454.CMB.2.raw
  modified_base (258)..(258): a, c, t, g, unknown or other
  modified_base (299)..(299): a, c, t, g, unknown or other
  modified_base (363)..(363): a, c, t, g, unknown or other
  modified_base (428)..(428): a, c, t, g, unknown or other
  modified_base (432)..(432): a, c, t, g, unknown or other
  modified_base (435)..(435): a, c, t, g, unknown or other
  modified_base (505)..(505): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagccgtgggacgtccctgagactctcttgtgctgcctntggattcaccttcagggtctatgacatgcacgtgggtcccnccaggcctccgaggcgaaggggctgggaggtgggtgctagtttatatcctatatgataggaagnagtatatactagtagatactccgtagaggccgtattcgatcatcctcaagagacaaactccgaanaacncgntacgtatcagacaaatgatcgagctgagagctaggaaacgtacgaccgttactttaatacgtttaaccgngtacgaacgtaaacctagtacaacgggtaaccgg

SEQ ID NO: 405017 - DNA, 507 bp, Homo sapiens
  misc_feature: GZ8MTXP02JOA98.52.19.B08.1.454.CMB.2.raw
  modified_base (394)..(394): a, c, t, g, unknown or other
  modified_base (402)..(402): a, c, t, g, unknown or other
  modified_base (406)..(406): a, c, t, g, unknown or other
  modified_base (416)..(416): a, c, t, g, unknown or other
  modified_base (421)..(421): a, c, t, g, unknown or other
  modified_base (425)..(425): a, c, t, g, unknown or other
  modified_base (436)..(436): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggcagtcgagacattagcatgtatctgaattggtatcagacaaaagtagggacagacccctaaatcctagactcctgatgcatccactttggacgacgacggggtacccagtacccgtaaggttcaggtagggaacgtggactcgtagggactagttatttacttacacctatcagcaggctgctancctgaagntgtnacatatatcntacanatanactctctccgntcacgtttcgggacggggtacagggtgaagacgtacgaacgcgtaagtggtacggcacgacaaccttctcg

SEQ ID NO: 405018 - DNA, 521 bp, Homo sapiens
  misc_feature: GZ8MTXP02F3PNI.52.19.B08.1.454.CMB.2.raw
  modified_base (391)..(391): a, c, t, g, unknown or other
  modified_base (395)..(395): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagacaaaaaggtagggacacgacccctaaatcctgactcctgatgcatccactttggagacgaggggtcccagtccaaggttcagtggaagtggctcgtgggactagtatttacttcacctatcagcaggctgcagcctagaatntgtnacaactatacttactgtacaaactagttataactcgtctcccgtatcgtacgtttcggggacgggggtaccaagggttcggatacgtacgaaggcgtaagtggacggctaggacctaccgattccg

SEQ ID NO: 405019 - DNA, 528 bp, Homo sapiens
  misc_feature: GZ8MTXP02FKS1F.52.19.B08.1.454.CMB.2.raw
  modified_base (392)..(392): a, c, t, g, unknown or other
  modified_base (412)..(412): a, c, t, g, unknown or other
  modified_base (420)..(420): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcagtcgagacattagcatgtatctgaattggtatcaagacaaaaagtagggaacagacccctaaactcctgactcctcgatgcatcccactttggagacgaggggtcccatccaaggttcagtggaagtggctcgtgggactagtattttacttcaccatcagcaggctgcagcctagaagntagtgacaacatacttactnttacaaanagtataatcgtcctaccgctacgtacgtttcggggacgggggtacctaaagggtggaagtacgtacgaagaccgtaaacgtggtcgggactggaccaacgtactttcg

SEQ ID NO: 405020 - DNA, 577 bp, Homo sapiens
  misc_feature: GZ8MTXP02HVSMO.52.19.B08.1.454.CMB.2.raw
  modified_base (154)..(154): a, c, t, g, unknown or other
  modified_base (432)..(432): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccngtctccttcctcctgtctgcatctataggagacagaatcaccatcacttggccgggcagtcgagactattagctatgtatctgaattggtatcagacaaaaagtaggacacgacccctaaactcctagatcctacggaatgacacttccctacttttaggaacgacgtacggggtcccattaccgaaggtttcgagtacgggtaagtcggctcgtagggactaggtacttttacgttcactatcagcaggctgacagaccgttagaagtattagttanactaaactaatactttaactagttaacaaactagttaataaactccgttactaccggtactacgtacggtttacgggacgggggtaaccgagggttacgggaatacgacgtaagaccgaaagtgtcggctacggacactacgttc

SEQ ID NO: 405021 - DNA, 504 bp, Homo sapiens
  misc_feature: GZ8MTXP02GC0Y8.52.19.B08.1.454.CMB.2.raw
  modified_base (340)..(340): a, c, t, g, unknown or other
  modified_base (411)..(411): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagacaaaaagtaggacagacccctaaactcctgatcctcgatgcatccatttggagacaggggtcccagtcccaaggttcagtggagtggctgngggactagtattttacttcaccatcagcaggctgcagcctagaacgatgttagactaaactattacttacngtaccaaatagtataatcgtctccgatcgacgttcgggcggggacaagggtcgaagtactacgaagacgaacgtgtacggcttagcactatcg

SEQ ID NO: 405022 - DNA, 535 bp, Homo sapiens
  misc_feature: GZ8MTXP02G6SRC.52.19.B08.1.454.CMB.2.raw
  modified_base (399)..(399): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttggccgggcgagtcgagacattagcatgtatctgaattggtatcagacaaaaagtaggacagacccctaaatcctagactcctcgatgcatccctacgtttggacgacgacggggtcccatcccgaaggttcagtaggaagtggctcgtgggactagtatttacttcactatcagcaggctgcagtcctagaagtntgttcgacaacattacttactgtacaaactagtaattaactcgtacctcccgtactcgtacggtttcgggggacgggggtaaccaaggggttggaaagtcgaacgaagaccgaagtggtacggctagcaacctatc

SEQ ID NO: 405023 - DNA, 591 bp, Homo sapiens
  misc_feature: GZ8MTXP02HUY3L.52.19.B08.1.454.CMB.2.raw
  modified_base (300)..(300): a, c, t, g, unknown or other
  modified_base (344)..(344): a, c, t, g, unknown or other
  modified_base (362)..(362): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggaggcgtggtccaggccgtggggagtccctgagactctctgtgctgcctctggattccaccttcgaggtctatgacatgcacgtgggtccnccgaggctccgaggcgaaggggctgggagtgggtgactagttanatccatatgagtaggaancagtatatactatgtacgactccggtagaacggggcctagttcatctatcctaccgaagaacgacctaaaccgaccgaaacgtaaaccacgtactaggttactaccgtagaactaagtcgaactcgaggactagaacgcgtacgtagaaacgccgtaacggttactttaacgtacgtttaacgtacggtaacgtaccgtaaacgtttaacgaccggtaacgggaaccgg

SEQ ID NO: 405024 - DNA, 617 bp, Homo sapiens
  misc_feature: GZ8MTXP02HPQ2Z.52.19.B08.1.454.CMB.2.raw
  modified_base (186)..(186): a, c, t, g, unknown or other
  modified_base (211)..(211): a, c, t, g, unknown or other
  modified_base (420)..(420): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcacatcacttggccgggngagtcgagacattagcatgtatctgaattggtatcagacaaaaaggtaggacagaccccctaaatcctagactcctcgatcgactactcctacgtttggacgacgtacggggtcccctagtaccgtaaaggttcgaagttaggggaagtcggtctcgggtagggactaagttactttttacttacaacctataccgagccgagggtccngacgacgtacgtagaagtagttcgtacaactaactaatttaacgtttactacgtaacaaacgtaagttaactacgtccgtccctccgtacttaccgggttacgggtttacgggggaccgggggtaacgtaacggggtacggaacgtacgtacgaacggtacggtaacggtggtacgtcgacgacctacgtacgttcg

SEQ ID NO: 405025 - DNA, 522 bp, Homo sapiens
  misc_feature: GZ8MTXP02HRO7F.52.19.B08.1.454.CMB.2.raw
  modified_base (257)..(257): a, c, t, g, unknown or other
  modified_base (299)..(299): a, c, t, g, unknown or other
  modified_base (344)..(344): a, c, t, g, unknown or other
  modified_base (362)..(362): a, c, t, g, unknown or other
  modified_base (420)..(420): a, c, t, g, unknown or other
  modified_base (428)..(428): a, c, t, g, unknown or other
  modified_base (436)..(436): a, c, t, g, unknown or other
  modified_base (454)..(454): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggaggcgtggtccaggcctgggagtccctgagactctcttgtgctgcctntggattcaccttcaggtctatgacatcgcacgtggggtcccnccaggctcccgaggccaagggggctgggaggtgggtgctatttanatcatatgatggaacganagtatatactagtgtacgactcgtagacggcgtatcatcatctacagacacacacganaacacgtntatactcngactaagtgacacgacgntgacgagagacgacgacgtacgtacttattattaacgtacgtacgtactaactaacgtacgacggacg

SEQ ID NO: 405026 - DNA, 512 bp, Homo sapiens
  misc_feature: GZ8MTXP02GVQ7L.52.19.B08.1.454.CMB.2.raw
  modified_base (186)..(186): a, c, t, g, unknown or other
  modified_base (402)..(402): a, c, t, g, unknown or other
  modified_base (430)..(430): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcagtcgagacattagcatgtatctgaattgtatcagacaaaaagtaggacagacccctaaatcctgatcctcgatgcatccactttggagacgaggggtcccatccaaggtcagtggaagtggctcgtgggacagtattttacttcaccatcagcagctgcagcctagaagtatgtgacaactatagttacngtacaaacagtaataagtctctacccgntcgtacgtttcggggacgggggtaaccaagggtggaacacgtaccgaaggaccgtaagtggtcgcgtagaccacctattccg

SEQ ID NO: 405027 - DNA, 725 bp, Homo sapiens
  misc_feature: GZ8MTXP02H987B.52.19.B08.1.454.CMB.2.raw
  modified_base (213)..(213): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcacctatcacttcggccgggngagtcgaagactattagactatgtatcgtagtaatggtatacaagaacgaaaaaggtagggaactacgacccctaaactccgtagtactccctacgtactgacctacgttaccctacgtttagggaacgaaccggtacggggtacccctagtaaccccgtaagggttacgaggtagggtaacggtggtctcgtaggggtaaactacggtttaactttttaccttaccgaacctactacgtaacgtacgaacggttcctaggacgtacggtacctaaggtaaacggtacgtttacgttaaggaaccgtaaaaccgttaattttaaacgtttaaccgtagttaacccgtaaaataacggttaaattaaacgtcccttaccggtaaccctccgttaccgtaccggtttacgggggaaccgggggtaacccgaaacggggttcgggaaagtaccgtaacgtaaacgacggtaaaccgttcgggtacggtaccgtacgacccgtaacgttacgtacg

SEQ ID NO: 405028 - DNA, 610 bp, Homo sapiens
  misc_feature: GZ8MTXP02JG43K.52.19.B08.1.454.CMB.2.raw
  modified_base (186)..(186): a, c, t, g, unknown or other
  modified_base (211)..(211): a, c, t, g, unknown or other
  modified_base (399)..(399): a, c, t, g, unknown or other
  modified_base (439)..(439): a, c, t, g, unknown or other
  modified_base (460)..(460): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggnagtcgagacattagcatgtatctagtaattggtatacagaacaaaaaaggtagggaacacgaccccctaaactcctagactcctcgatgcacgttccctagtttaggacgaccgtacggggtcccataccgtaaggttcaggtaggtaaggtggtcctggtagggactagttacttttacttcaactntacgagtcacgggctagcgacgcctaggaagtattggtanactaaactattactttaacgngttaactaaacgtagttaactaaacttcccggtcctaccccggtataccggtaccggtttaccgggggacgggggtaaccaaggggttcggaagttacgaccgtaacgtacgtaacgtcgggtacggcctacggacctaccgtactttcg

SEQ ID NO: 405029 - DNA, 595 bp, Homo sapiens
  misc_feature: GZ8MTXP02F7ARC.52.19.B08.1.454.CMB.2.raw
  modified_base (296)..(296): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtctgggggagcgtggtccagcctgggagtccctgagactctcttgtgctgcctctggattcaccttcagggtctatgacatgcacgtggggtccncgcgcgtccacggcggaacggggacggtcggtagggtaggggttgggcgtatttaagttatacctatatagagtacggaaggacagaataatactactgtagactccgtacgaggacggactactatactactctaccacgagaacgaactaaccgacgaaacgaccgacgtactagtacttacgacgaaatagtatacgagacgtagaggagacgtacgaaaggaacgtacggtaccgtttatttattaacgttacgtaggtaacgtaacctttaaagttacgaacgggtaaaccggg

SEQ ID NO: 405030 - DNA, 540 bp, Homo sapiens
  misc_feature: GZ8MTXP02IPZDO.52.19.B08.1.454.CMB.2.raw
  modified_base (189)..(189): a, c, t, g, unknown or other
  modified_base (257)..(257): a, c, t, g, unknown or other
  modified_base (301)..(301): a, c, t, g, unknown or other
  modified_base (363)..(363): a, c, t, g, unknown or other
  modified_base (381)..(381): a, c, t, g, unknown or other
  modified_base (409)..(409): a, c, t, g, unknown or other
  modified_base (420)..(420): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtncaactggtggagtcgtgggggagcgtggtccaggcctggggagtccctgagctctcttgtgctgcctntggattcaccttcaggtctatgacatcgcacgtcggggtccccnccgaggcctccgaggcgaaggggctgggaggtgggtgctatttatatccatatgataggaancagtataatactatgtanactcgagaggcctatcatcatcacaganacaactcgaanaacacgtctgtactctgactaaagtagactacgagctaggagacgtcgaagaaacgaacgtacggttactttaatacgttaagtgtacggtactaaagttaacgtacgtaaacggaacgg

SEQ ID NO: 405031 - DNA, 664 bp, Homo sapiens
  misc_feature: GZ8MTXP02H783L.52.19.B08.1.454.CMB.2.raw
  modified_base (185)..(185): a, c, t, g, unknown or other
  modified_base (189)..(189): a, c, t, g, unknown or other
  modified_base (207)..(207): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacanaatcacatcatggccggngagtcgagatattagcatgtatctgatgtatacaagaacaaaaaggtaggaacaacgtacccctaaactcctagtactcctacgatcgactactacctacgtttaggaacgaccgaacggggtaccaagtaccgtaaaggttacgaggtagggtaacggtcggcttcgtagggaactagtttactttttaccttactaactactactacgacgacgtacgtacgacgacgtacgtacgtaagtagttagttagtactaactaaattaactttaacttacgtaactaaactaaacgttaaacgttaaacgttaccgttaccgttacccgttaccgttaccgttaccggtttaccgggggtaccgggggtaaccggggtaaacgggtaacgggtaacggtaacgtacgtaacgaacggtaacgtacggtacggtacgtacgtaccgtaccgtacgtacg

SEQ ID NO: 405032 - DNA, 690 bp, Homo sapiens
  misc_feature: GZ8MTXP02GLC3Q.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttggccgggcagtcgagactattagctatgtatctagtaattggtatacgaagacaaaaagtacgggacacgaccccctaactcctagtactcctacgatcgctactccgtacgtttaggacgacgtacggggtaccctagtaccgtaacggttcgaggtaggaagtcggtacgttcggtaggggacttaaggtttacctttttaaccttaccgtaacctaacgttaccgacggtaccggtaacggtcgttacggacctaccggtacccgttaaggaaaacgtgttacgttacgaaaccttaaacgtaactttaactttaccgttacggtaacctaaacgttaagtaactttaaaccgttccgttacccgttccccgtcgtttaacgtacccggggtttaccgggggaccgggggttaaccgaagggttacggaacgtacgtacgtaacggacgtaacgtggtcggactacggctaaccgtgtttccg

SEQ ID NO: 405033 - DNA, 546 bp, Homo sapiens
  misc_feature: GZ8MTXP02IWHSW.52.19.B08.1.454.CMB.2.raw
  modified_base (186)..(186): a, c, t, g, unknown or other
  modified_base (397)..(397): a, c, t, g, unknown or other
  modified_base (451)..(451): a, c, t, g, unknown or other
tcagcgcagtacgacacgaccggtgctcgatttagtgagtcagtaaggggcagtcccaaccaggacacagcatgaacatgagggtccctgctcagctcctggggctcctgctgctctggctctcaggtgtcagatgtgtcatccagatgacccagtctccttcctccctgtctgcatctatagganacagaatcaccatcacttgccgggcgagtcgagacattagcatgtatctgaattggtatcagacaaaaaagtgggaacagacccctaaactcctgactcctcgatgcatcctactttggacgacgtacggggtccatccaaggttcaggtggaagtcggctcgtgggactagtattttacctcacctatcagcagctgcagcctagaagtntgttagacaaactatactttatcgtacaaactagttaataactcgtcctacccncgtacacgtttccggggacgggggtaaccgtaagggtacggacgtacgtacgaacggacgtaacgtggtacgtcgtagaccgacccgtatttccg

SEQ ID NO: 405034 - DNA, 540 bp, Homo sapiens
  misc_feature: GZ8MTXP02IURZE.52.19.B08.1.454.CMB.2.raw
  modified_base (210)..(210): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggnagtcgagacattagcatgtatctgaattggatcagacaaaaaggtacgggacacgacccctaaactcctgactcctcgatgcatcctagtttggacgacgacggggtcccatccgaaggttcagtggagtggctcgtgggactagtacttttactcgaccatcagctagctgcagcctagaagtatgttagactaactattacttactagtacaaactagtactaatcgtacctcccgactctacggtttacggggacgggggtacctaggggtcggaagtacgtaacgaggtacgtaacgtggtacggacgtagccaacgtactttccg

SEQ ID NO: 405035 - DNA, 729 bp, Homo sapiens
  misc_feature: GZ8MTXP02JPFBG.52.19.B08.1.454.CMB.2.raw
  modified_base (178)..(178): a, c, t, g, unknown or other
  modified_base (340)..(340): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctagtctctnactactactaaggaggaacgaacaatactaccaactactactacggtcgggaccggagtacgacgaacactagtagactagtagtactgtaagtagtacgtacagaacgaaaagtaaagggacgaaccacccgtaaccctaacgtcctagacctacacgtancacctactcgttacggtacggaacgtaccgggtaccggtactaaccgtaacgttaaggtacgaaggggtaggtaacggtcgtaccggtcggggtaaacggtaacttaacgtttttactttttaacccgaacccaactaacgtacgaacgttaccggaacggttcaccgtacggaccttacggaaaggaaattcgttaggtaacaaacctaaataactttaacgtacccgtagtaaaaccaaaggtaagtttaaactaccggttccctcccgtacccgttacgtacccggttttacgggggaccgggggaacccggaaacggggtacgtagggaactaaccggaagaacgtaacggtaagacggtcgactccggaaaccctcggtttacg

SEQ ID NO: 405036 - DNA, 595 bp, Homo sapiens
  misc_feature: GZ8MTXP02GODJX.52.19.B08.1.454.CMB.2.raw
  modified_base (211)..(211): a, c, t, g, unknown or other
  modified_base (388)..(388): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggnagtcgagacattagcatgtatctagattggtatcagacaaaagtacggacacgacccctaaactcctagactcctcgatgctatacctagtttggacgacgtacggggtcccagtaccccgtaaggttcgaggtaggaagtcggcgtcggtagggactagttacttttactcgaacntacagtcgaggctgcagtccgtaagaagtagttagttacgaacctaaatattaattactacggtaactaaactaagttactaaacggtccgttcctacccgtactacgtaccggtttcgggggaccgggggtaaccaaggggttaggaacgtacgtacgaaaggtaccgaaacggttggacggtctacggcctaaccgttacgttcg

SEQ ID NO: 405037 - DNA, 521 bp, Homo sapiens
  misc_feature: GZ8MTXP02F7IQU.52.19.B08.1.454.CMB.2.raw
  modified_base (301)..(301): a, c, t, g, unknown or other
  modified_base (345)..(345): a, c, t, g, unknown or other
  modified_base (363)..(363): a, c, t, g, unknown or other
  modified_base (375)..(375): a, c, t, g, unknown or other
  modified_base (399)..(399): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagccgtgggaggtccctgagactctcttgtgctgcctctggattccaccttcgagggtctatgacatgcactggggtcccnccaggcctccgaggcaagggggctgggagtggggtgctatttantcatatgatggaagcagntatactatgtanctcgtagaaggccgatcatcatcncagagacactaccgagaacacgctgtatctagacaaatagatacgagcgtagacgagacgtacgaagacgtacgtactttattattaacgtgtagtacgtaacttaactacgacggaaacgg

SEQ ID NO: 405038 - DNA, 538 bp, Homo sapiens
  misc_feature: GZ8MTXP02F72OQ.52.19.B08.1.454.CMB.2.raw
  modified_base (343)..(343): a, c, t, g, unknown or other
  modified_base (389)..(389): a, c, t, g, unknown or other
  modified_base (410)..(410): a, c, t, g, unknown or other
  modified_base (439)..(439): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcagtcgagacattagcatgtatctgaattggtatcagacaaaaagtagggacacgacccctaaactcctgactcctcgatgcatcccacgtttggagacgagggtcccatccaagttcagtggaagtgctcgngggacagttatttcttacacctatcagcaggctgcagcctagaagntagtgacaacattattacgtntacaaactagtaatactccgtactcccgnttaccgtacgtttccgggggacgggggtaacctagggtacggaagtacgtaccaaggaccgtaaacgtggttacggcgtacgaccgtacctagtttccg

SEQ ID NO: 405039 - DNA, 551 bp, Homo sapiens
  misc_feature: GZ8MTXP02FP4EI.52.19.B08.1.454.CMB.2.raw
  modified_base (211)..(211): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacgttgccgggngagtcgagacattagctatgtatctgaattggtatcagacaaaaagtggacacgacccctaactcctgactcctcgatgctatccctacgtttggagacgaggggtcccaatccgaaggttcaagtggaagtcggctcgtgggactagttacttttacttcacctatcagctagggactgacgtacgccttagaaggtattagttacgactaactaattacttacgtatacaaactatataactcgtactcccatccgtacggtttacgggcgggggtactaagggtacgaaggtactacgtaacgacgtaaacgtgtacggctcgaccgaactacttcg

SEQ ID NO: 405040 - DNA, 576 bp, Homo sapiens
  misc_feature: GZ8MTXP02J3KTG.52.19.B08.1.454.CMB.2.raw
  modified_base (339)..(339): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagcctgggaggtccctgagactctcttgtgctgccctctggattcaccttcaggtctatgacatgcacgtgggtcccgccaggcctccaggcaaggggctgggagtgggtgctatttanatcatatgagtaggaacgacagtataatactagtgtaacgtaccttccggaggaacggggcctattacactctacgtcctaccgaagaacgaacctaaccgtaccgaaagaaccgtacgtctagtactcgtagaacaaatagacgtacgacggacgtagacgagacgacgaacgaacgacgtactttaacttacttaacgttacgtacgtacgtaacgtaacgtacgtacggaacgg

SEQ ID NO: 405041 - DNA, 579 bp, Homo sapiens
  misc_feature: GZ8MTXP02G6WNS.52.19.B08.1.454.CMB.2.raw
  modified_base (299)..(299): a, c, t, g, unknown or other
  modified_base (362)..(362): a, c, t, g, unknown or other
  modified_base (367)..(367): a, c, t, g, unknown or other
  modified_base (440)..(440): a, c, t, g, unknown or other
  modified_base (444)..(444): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagcttgggttttcctcgttgctcttttaagaggtgtccagtgtcaggtgcaactggtggagtcgtgggggagcgtggtccagcctgggagtccctgagactctcttgtgctgcctctggattcaccttcgaggtctatgacatcgcacgtgggtcccnccgaggcctccgaggcaaggggctgggaggtgggtgctagtttatatccgatagtgatggaancagtntaatactagtgtagaccgtccggtagaaacgggtcccgtattcaatcactctacagaacgacaactaccgaanaacncgctagtactacgtagactaaagtgaactcgaggtcgagagacgtacgtacgaaacgaccgtacggttacttttaagtaacgttaacgtagtacgtaacgttaaacctttaaaggaccggtaaacggtaaaccgg

SEQ ID NO: 405042 - DNA, 591 bp, Homo sapiens
  misc_feature: GZ8MTXP02IJUML.52.19.B08.1.454.CMB.2.raw
  modified_base (210)..(210): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggngagtcgagacattagcatgtatctagaattggtaatcagacaaaaagtaggacacgacccctaaatcctagactcctacgatgacactaccctacgtttggagaccgaggggtacccagtacccgtaaggttccgaggtcgggaaagtcggactcggtagggaactaggtactttttaccttcacctagtaccagcagctgacgagcctagaagtatagtagactaaactattaacttactgttacaaactagtaactaacgtcgtctacccgtactacgtacggtttccggggacgggggtaaacctaagggtagggaacgtacgtaacgtaacggacgtaaaccgtggtacgggacttacggcctaaccgtatttaccg

SEQ ID NO: 405043 - DNA, 551 bp, Homo sapiens
  misc_feature: GZ8MTXP02IIH2L.52.19.B08.1.454.CMB.2.raw
  modified_base (185)..(185): a, c, t, g, unknown or other
  modified_base (210)..(210): a, c, t, g, unknown or other
  modified_base (285)..(285): a, c, t, g, unknown or other
  modified_base (392)..(392): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagaatcaccatcacttgccgggngagtcgaagacattagcatgtatctgaattggtatcagacaaaaagtaggacagacccctaaactcctgactccngatgcatccactttgagacgaggggtcccatccgaaggttcagtggaagtggctctggggaactagtactttactttcacctatcagctaggctgctagcctagaanagtgttgactaaactaattaatttatagttacaaactagtaattaaatccgtctacccgtacttctaaccggtttcgggaccgggggtaacaacgggtaggacgtacgtacgaagtaccggaaacgtgggttacggcgttacggacaccgtactttccg

SEQ ID NO: 405044 - DNA, 531 bp, Homo sapiens
  misc_feature: GZ8MTXP02FRVLT.52.19.B08.1.454.CMB.2.raw
  modified_base (379)..(379): a, c, t, g, unknown or other
  modified_base (401)..(401): a, c, t, g, unknown or other
  modified_base (406)..(406): a, c, t, g, unknown or other
  modified_base (441)..(441): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttggccgggcgagtcgagacattagcatgtatctgaattgatcagacaaaaggtaggacacgacccctaaactcctagactcctcgatcgcactccactttggacgacgaggggtaccagtacctaggttcaggtacgaagtggctcgtagggactagttattttacttacacctatnagcagctcgcagcctagaagtntagtnacaactatattactgtacaacgtatatacgtctcncctctacgtcgttacggggcggggtaaccaggggtacgacgtaagtaccgaagtacgtaacgtgtcggtactcggacaacccgttactcg

SEQ ID NO: 405045 - DNA, 564 bp, Homo sapiens
  misc_feature: GZ8MTXP02FGJYD.52.19.B08.1.454.CMB.2.raw
  modified_base (186)..(186): a, c, t, g, unknown or other
  modified_base (384)..(384): a, c, t, g, unknown or other
  modified_base (401)..(401): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcagtcgagacattagcatgtatctgaattggtatcagacaaaaagtagggacagctcctaaactcctgatcctgatgcatccacttttgggagacacgggggttccccatccgaaaggttcagttggaagttgggctctggggacagtattttactttcacctatcagcaggcngcagctagagtatgtanacaactattacttacgtacgtacaacgtaagttaataacgttccgtacctacccgtcgttaccgtaccggttaccggggaccgggggtaaaccgtaaggggtacggaacgtacgtacgaacggaacggtaacgtacggtacggtacgtacgaccgtacctacg

SEQ ID NO: 405046 - DNA, 585 bp, Homo sapiens
  misc_feature: GZ8MTXP02GD4VC.52.19.B08.1.454.CMB.2.raw
  modified_base (304)..(304): a, c, t, g, unknown or other
  modified_base (366)..(366): a, c, t, g, unknown or other
  modified_base (437)..(437): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcagggtgcaactggtggagtctgggggaggcgtggtccaggccctgggaggtccctgagactctcttgtgctgccctctggattcacctttcagggtctatgacatgcacgtggggtcccnccgaggcctccgaggacgaaggggctgggaggtgggtgctatttatatcatatgagtggaanacagatatactatagtagacgtcgtagaacggccgtattacatctatcctacaagacaacaactaccgaanaaaccgacgtactagtactctagactaaatgaactcgaaggtctaaggaacgacgacgtaacggaaacgaaccgtacggttaactttaagttaacgtttaacgtaggtacgtaacgttaaaacgttaacgtaaccgtaacgggaacgg

SEQ ID NO: 405047 - DNA, 630 bp, Homo sapiens
  misc_feature: GZ8MTXP02GZCB4.52.19.B08.1.454.CMB.2.raw
  modified_base (155)..(155): a, c, t, g, unknown or other
  modified_base (256)..(256): a, c, t, g, unknown or other
  modified_base (297)..(297): a, c, t, g, unknown or other
  modified_base (347)..(347): a, c, t, g, unknown or other
  modified_base (362)..(362): a, c, t, g, unknown or other
  modified_base (370)..(370): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttccncgttgctcttttaagaggtgtccagtgtcaggtgcaactggtggagtcgtgggggagcgtggtccagccgtgggagtccctgagactctctgtgctgcctntggattcaccttcaggtctatgacatgcacgtggggtcccncgaggcctccgaggccgaaggggctgggagtggggtgactatttacgatnaaccccgtatgaacnggggaaanagagtatactaactagtagtaacgtaccgtacgaggacggtactactcatactactacctacgaacgacgaacccaaccgtaccgaacgaaacgtacgtactacgtactacgtacgaacgtaaagtagtacgtacggtacgtacgtaggaacggtacgtacggtaaacggaaacggtaccgtaaccggttaactttaacgttacgttaacgtacggtaacgtaacgttaaacgttaacggtaccggtaaacgggtaaccg

SEQ ID NO: 405048 - DNA, 580 bp, Homo sapiens
  misc_feature: GZ8MTXP02FLQPI.52.19.B08.1.454.CMB.2.raw
  modified_base (187)..(187): a, c, t, g, unknown or other
  modified_base (211)..(211): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcacatcactggccgggnagtcgagacattagcatgtatctagtaattggtatcagaacgaaaaagtagggacaacgacccctaaactcctgactcctcgatgctatccactttggagacgaggggtacccataccgtaaggttcaggtggaaggtcggtcgtcgtagggactaggttacttttactttcacctatacgtaagcgaggtctggacctagcctaagaagtatgttacgactaaactattattactacgttacaaactagtaactaatccgtacctcccgtactccgtacggtttaccggggacgggggtaccgaacgggtagaaggtacgtaacgaacgtacgtaacgtggcgtaccgcgacctaacctacgtttccg

SEQ ID NO: 405049 - DNA, 615 bp, Homo sapiens
  misc_feature: GZ8MTXP02HCZR9.52.19.B08.1.454.CMB.2.raw
  modified_base (594)..(594): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctagtaggagacagaatcaccatcacgttggccgggcagtcgagactattagctatgtatctagtaattggtatcgaagaacaaaaaggtacggaacacgtacccctaaactcctagtactcctacgatgactacttaccctagtttacggaacgacgtaccggggtacccctagtacccgtaacggttacgtaaggtagggtaacgtggctccgggtagggactagttactttactcaacctatccaaggctagggcctagcgtaaggtccctaaggtaaagtgttaggttacaactaaaacttattactttaacacggtaataacctaagtttaacacggttccctaccgtccctaacttcgtaacggtttcggggacggggtaaacagggtagacgactacgaagcgttaacggngtacgctacgactacgtatcg

SEQ ID NO: 405050 - DNA, 517 bp, Homo sapiens
  misc_feature: GZ8MTXP02GGDRM.52.19.B08.1.454.CMB.2.raw
  modified_base (186)..(186): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcagtcgagacattagcatgtatctgaattggtatcagacaaaaagtagggacagacccctaaatcctgatcctgatgcatccactttggacgacgaggggtccccatcccgaaggttcagtggaagtggctcgtgggactagtattttacttcacatcagcagctgcagcctagaagattgttgacaaactattattactagtacaaactagtaataactcgtactcccgactcgtacgtttcggggcgggggtaaccaagggtcggagtacgacgaagccgaaagtgtacggctagctaccattcg

SEQ ID NO: 405051 - DNA, 671 bp, Homo sapiens
  misc_feature: GZ8MTXP02FKW04.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttcggccgggcgagtcgagactattagctatgtatctagtaatttggtatcagaacaaaaggtaggacacgacccctaaactcctagactactcgatcgacataccctagtttagggacgaccggtacggggtacccctataccccgtaaggtttacgaggtagggaaaggttcggcttccggtaggggactaaggtttacttttaccttacacctatacagacgaggctgacgagacccgttagaaagttagttaggttcgaacctaaactaatttaaccttatacggttaaaccaaaagtacgttaaataaacctttacgttcccgtaccccggtaccttccgtaaccgggtttaccgggggaccgggggaaaccggtaaaccggggttgggaaccgttagtaacgaacggtaacccggtaaagtttacgggtaccggtcggtaccacggaaacctacgtttacccg

SEQ ID NO: 405052 - DNA, 550 bp, Homo sapiens
  misc_feature: GZ8MTXP02HDHV4.52.19.B08.1.454.CMB.2.raw
  modified_base (206)..(206): a, c, t, g, unknown or other
  modified_base (420)..(420): a, c, t, g, unknown or other
  modified_base (528)..(528): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcacatcactgcggnagtcagactattagctatgtatctagtaattggtatacaagaacgaaaaagtaggacacgacccctaaactctagactcctgatcgacactcctacgttgacgaacgtacggggtacccatacccgtaaggttcaggtaggaaggtcgctcgtagggactattaacttttacttacaccataccagcaggctgaccagctaagaagtatggtanacaactatattactatactaactaataataactcgtacctccctacgtacgtacgttccggggtacggggaaccggtaacggacggaagacgacgaacgaacgaacgngtacgcgacgacacctacttcg

SEQ ID NO: 405053 - DNA, 562 bp, Homo sapiens
  misc_feature: GZ8MTXP02FLP92.52.19.B08.1.454.CMB.2.raw
  modified_base (186)..(186): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggcgagtcgagacattagcatgtatctgaattggtatcagacaaaaagtagggacacgacccctaaactcctagactcctacgatcgctatcccactttggacgacgaggggtcccatccgaaggttcaggtggaagtggctcgtagggactagtattttacttcactatcagcaggctgcagcctagaagtatgttcacaactattattactcgtacaaatagtattaacgtcgttacctcccgacttcgaccggttttaccgggaccggggggtaacctaaacggggtgggaaggtacttaacgaaacggtacggaaacgttcggtacggtctacggacctaccgatttccg

SEQ ID NO: 405054 - DNA, 729 bp, Homo sapiens
  misc_feature: GZ8MTXP02GHIYW.52.19.B08.1.454.CMB.2.raw
  modified_base (189)..(189): a, c, t, g, unknown or other
  modified_base (250)..(250): a, c, t, g, unknown or other
  modified_base (287)..(287): a, c, t, g, unknown or other
  modified_base (303)..(303): a, c, t, g, unknown or other
  modified_base (352)..(352): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtncaactggtggagtcgtgggggagcgtggtccagccgtgggacgtccctgagactctcttgngctgcctcgtggattcaccttcgaggtctagtgaacntgctacgtgggtcccncgaggcctccgaggcgaaggggtctgggaggtggggtggactatttaanactccagttatagagtaggaaacgacgaaggtattaaagtaaactttagtcgggttaacgtaacccggttcccgggttaagggaaaccgggggtacccgttaagtttaccgaatttacccaacgttcccttaacccgaaaggaaccgaaacccgtaaaccccgttacccggaaacgaaaccgtaccccgtacgttaggtaaactttccgtaacggaacctaaaaacgttggaacttacggaagggtaccgttaagggagtaacggcgtaaaggaaaaccggtaccgtaaccggttaactttttaacttaacggtttaaacgtgggttaacgtaaaccccgttaaaacgtttaaggaccgtaaaccgggggaaaccgg

SEQ ID NO: 405055 - DNA, 617 bp, Homo sapiens
  misc_feature: GZ8MTXP02HLVSR.52.19.B08.1.454.CMB.2.raw
  modified_base (302)..(302): a, c, t, g, unknown or other
  modified_base (347)..(347): a, c, t, g, unknown or other
  modified_base (370)..(370): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagccgtgggacgtccctgagactctcttgtgctgcctctggacttcaccttcgagggtctatgacatgacacgtggggcccnccgaggcctccgaggcgaaggggctgggaggtgggtggctatttnatccaatagtgaagttcggaaancgaagtattaataacttagtgtaacgaccgttacccggtagggtaacggacccgtattacacttacacgttcctacccgaaagaaccgaacctaaaccgtaccggaaacgaaaccaccgtcgttagttactccgtagaacctaaagtcgtaactaccgaaggtctaggaagacgtaccgtaaggaaacgtacgacgttactttaagtacttaacgtgtacgtaacgtaactacgtacgacggaacgg

SEQ ID NO: 405056 - DNA, 543 bp, Homo sapiens
  misc_feature: GZ8MTXP02JN66G.52.19.B08.1.454.CMB.2.raw
  modified_base (299)..(299): a, c, t, g, unknown or other
  modified_base (332)..(332): a, c, t, g, unknown or other
  modified_base (343)..(343): a, c, t, g, unknown or other
  modified_base (350)..(350): a, c, t, g, unknown or other
  modified_base (358)..(358): a, c, t, g, unknown or other
  modified_base (485)..(485): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggaggcgtggtccagccgtgggacgtccctgagactctcttgtgctgcctctggattcaccttcaggtctatgacatgcacgtgggtcccncaggcctccgaggcgaaggggctgggagtgggngactagtttanatcatangatggaancagatatactatgtagactcgtagacggccgtatcatctactcctaccagacacaaccgtaccgaaacgaaccgaccgctagtacgactacgactaaagtgatcgagtcaggacgagtcgagaaacncgtacgtactttaatacttaacgtgtacgtaacgtaaatttacgacgtacggaaacgg

SEQ ID NO: 405057 - DNA, 584 bp, Homo sapiens
  misc_feature: GZ8MTXP02F82PK.52.19.B08.1.454.CMB.2.raw
  modified_base (188)..(188): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgacccagtcctccttcctccctgtctgcatctatagganacagaatcaccatcacgttggccgggcgagtcgagactattagctatgtatctagaattggtatcagacaaaaggtaggacacgacccctaaactcctgactcctcgatcgcactcctacgtttggagacgacggggtcccataccgaagttcagtaggagtcggctcgtacgggactagttacttttaccttacaccgtatcgagccgagctgcagccgtagaagtgtgttagactaactattacttacgtataccgtaaatagttaactaattcccgtacccgtcctacgttacgtaccgggtttacgggggacgggggtaaccgtaagggtacggaacgtactaacggaacgacggtaacgtggtacggtcctacggacctactacgtttccg

SEQ ID NO: 405058 - DNA, 666 bp, Homo sapiens
  misc_feature: GZ8MTXP02JLQW5.52.19.B08.1.454.CMB.2.raw
  modified_base (184)..(184): a, c, t, g, unknown or other
  modified_base (212)..(212): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgaccagtctccttcctcctgtctgcatctatagganacagaactcaccatcacgttggccgggngagtcgagactattagctatgtatcgtagtaattggtatcaagaacgaaaaaggtacgggaaccaccgtaaccccctaaactcctagtactccgtagtatcgactacttcccgtaagtttacgggaacgtaaccggtaccggggtaccctagttacccgtaaggttacgaggtacggtaagtcggacttggtacggtatacgtttactttacttacactatacgacgcgagtctcgaccgtacggtacctaggtaagtagttacggtacaacctaaattacgttaacgtttactacgtaacctaaagtagttaaacttaccgttcgttacccgtacccgttcgtaaccgttacggggtttaccgggggacgggggtaaaccctaggggtacgaacgttacgacgttaacgacgtaacggtcggtacgtacgtacggacgtaccctaggtttccg

SEQ ID NO: 405059 - DNA, 516 bp, Homo sapiens
  misc_feature: GZ8MTXP02IXD27.52.19.B08.1.454.CMB.2.raw
  modified_base (420)..(420): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggcgagtcgagacattagcatgtatctgaattggtatcagacaaaaagtaggacacgaccccctaaatcctgatcctcgatgcatccctacgtttggacgacgacggggtcccagtccaaacggttcagtggaagtggctcgtgggactagttactttacttcactatcgagcaggctagcagcctagagtagtgttgacaactatatttacngtacaactagtataatcgtctaccgctcgtacgttcgggacggggaacaggtggaagtacgtacgaacgacgaacgtggtcgctagccactagttc

SEQ ID NO: 405060 - DNA, 809 bp, Homo sapiens
  misc_feature: GZ8MTXP02GP9HD.52.19.B08.1.454.CMB.2.raw
  modified_base (186)..(186): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcacatcacttcggccggcgagtcgagactattagctatgtatctagaattggtatacagaacaaaaaggtagggacacgtacccctaaactcctagtaactccctagtactcggaccaacttcccgtaacgttttaggggaacgtaaccggtaccgggggttaccccctaagttaccccgtaaacggggttttaccgaagggttaacggggtaaacggttccggggtaccgtttaccggggttacgggggtaaaccgtttaaacgggttttaaaccgtttttttaaccccgtttacccgtaaaaccctacgtttaaccgaacggttaacccgacgggggtacttcggacccgtaaacggtcccgttaaaggtaaacgttagttacggttacggaaacctaaaccttaaagtttaactttaacgtacggttaaaccaaaaccgttaaaggtttaaaccttaaaccggttccttaaccccgttccccggtaccttacccggttaacccggggtttaccgggggaccggggggttaaacccgtaaagggggtcggtaaacgttacgtaaccgaacggacgtaaccggtggtcgggactacggacctacgtacgtttccg

SEQ ID NO: 405061 - DNA, 527 bp, Homo sapiens
  misc_feature: GZ8MTXP02F45DH.52.19.B08.1.454.CMB.2.raw
  modified_base (298)..(298): a, c, t, g, unknown or other
  modified_base (341)..(341): a, c, t, g, unknown or other
  modified_base (356)..(357): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggaggcgtggtccagccgtgggaggtccctgagactctcttgtgctgcctctggattcaccttcaggtctatgacatgcactggggtccnccaggctccgaggccgaaggggctgggagtgggtgctatttanatcatatgatggaannagatatactatgtagactcgtagacggcatcatcatctcagacgacaactacgaagaacacgctagtactctagactaaatgaactcgagctagagacgacgtagaagactacggttactttaatattaacgtagtacgtacgtaaactttaacgacgaacgggtaacgg

SEQ ID NO: 405062 - DNA, 562 bp, Homo sapiens
  misc_feature: GZ8MTXP02F0TWX.52.19.B08.1.454.CMB.2.raw
  modified_base (251)..(251): a, c, t, g, unknown or other
  modified_base (304)..(304): a, c, t, g, unknown or other
  modified_base (349)..(349): a, c, t, g, unknown or other
  modified_base (355)..(355): a, c, t, g, unknown or other
  modified_base (436)..(436): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgcttcttttaagaggtgtccagtgtcaggtgcaactggtggagtcgtgggggagcgtggtccagccgtgggacgtccctgagactctcttgngctgcctctggacttcaccttcgaggtctagtgacatgccacgtcgggtcccnccgaggcctccgaggcgaaggggctgggagtgggtgctagtttantcatangatgaagcagatatactagtgtagactcgtagacgggtcctattcatcatcctacagacaccactaccgaagtaacacgtnttagtactacgtacgaaactaaagtgtaacgtacgacggtagtaggacgagtaccgtaaggaagtaccgtacgttactttataacgttaacgtgtacgacgttaaactacgacgtaacgggaacgg

SEQ ID NO: 405063 - DNA, 555 bp, Homo sapiens
  misc_feature: GZ8MTXP02F6RGM.52.19.B08.1.454.CMB.2.raw
  modified_base (211)..(211): a, c, t, g, unknown or other
  modified_base (417)..(417): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggngagtcgagacattagctatgtatctgaattggtatcagaacaaaaggtaggacacgacccctaactcctagactcctcgatgctactaccctacgtttagggacgtacgacggggtaccctagtaccgtaaggttcaggtaggtaagtcggctcggtagggactagttacttttacttacactatcaagcaggctgcagcctaganatgtgaccaatattattacgtagtacaactaagttataacgtctacctccgacttacgtaccggttcggggacgggggttaccaacggggtgacgtagtacgaagtacgaacgtcgtacggctagactcgtactttcg

SEQ ID NO: 405064 - DNA, 545 bp, Homo sapiens
  misc_feature: GZ8MTXP02JMH76.52.19.B08.1.454.CMB.2.raw
  modified_base (294)..(294): a, c, t, g, unknown or other
  modified_base (392)..(392): a, c, t, g, unknown or other
  modified_base (417)..(417): a, c, t, g, unknown or other
  modified_base (450)..(450): a, c, t, g, unknown or other
  modified_base (466)..(466): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctataggagacagaatcaccatcacgttcggccgggcgagtcgagacattagcatgtatctagtaattggatacagaacaaaaaggtaggacacgacccctaaatcctagactccngatcgcactcctagtttggagacgtacgggtcctagtaccgtaaggttcagtaggaacgtggctgtgggtaactagttactttacgttcacctatacngacgagctgacacgcctagaacgtntagttacgactatattattacctagtacctaanagttataactcgtacnccgtctacgtacggtcgggacggggacaagggtggacgtacgtaccgagacgtaacgtggtacggcagccaactcgtcg

SEQ ID NO: 405065 - DNA, 626 bp, Homo sapiens
  misc_feature: GZ8MTXP02GPS9E.52.19.B08.1.454.CMB.2.raw
  modified_base (186)..(186): a, c, t, g, unknown or other
  modified_base (212)..(212): a, c, t, g, unknown or other
  modified_base (490)..(490): a, c, t, g, unknown or other
  modified_base (500)..(500): a, c, t, g, unknown or other
  modified_base (520)..(520): a, c, t, g, unknown or other
  modified_base (580)..(580): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgaccagtctccttcctccctgtctgcatctatagganacagaatcacatcacgtcggccgggngagtcgagactattagctatgtatcgtagtaattggtatacgaagaaacgaaaaaggtacggaccaaccgtaaccccctaaacttccgtagtaacctcccgtacgtacgtcgtacctacttacccgtaacgtttcgggaacggtaaccggtaccggggtacccctaagtaccccgtaagttaccgtaaggtagggtaacgtcggtactcgggtagggtaaacttaaggttttacctttaacctaccacttacgacgtagacgaggtctagacgtacgngtagtaagtntgtacaataactattactanacgtaactaatactagtactcgtcctcgtacgttacgcgggtacgggaccgggagtaggngacgacgtacgagtacgtaagtcgcgtacacgtactacgtcttacg

SEQ ID NO: 405066 - DNA, 565 bp, Homo sapiens
  misc_feature: GZ8MTXP02JI4GW.52.19.B08.1.454.CMB.2.raw
  modified_base (253)..(253): a, c, t, g, unknown or other
  modified_base (420)..(420): a, c, t, g, unknown or other
  modified_base (432)..(432): a, c, t, g, unknown or other
  modified_base (448)..(448): a, c, t, g, unknown or other
  modified_base (457)..(457): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgacccagtcctccttcctcctgtctgcatctagtaggagacagaactcaaccatctacgtggccgggcagtcgagatattagctatgtatctagtaattggtanacaagaacgaaaaggtggaacctcgtaaccccctaaagtcctggaacttcccgagtatcgactcttacccgtagtttgggaacgtacggtaccgggtaccctagtaccgtaacggttgaagtacgggaagtcgtcgttgtaggactagttactttctaacgctatcngactgctgacgntacagagtatcgtaanacatatatntatactaatagtactactcgtcctcgtacgtcgtacggtacgggacggtagtacggtacgaacgtacgtacgacgtacgtcgtcggcgtacgtcgtacctacttagtc

SEQ ID NO: 405067 - DNA, 704 bp, Homo sapiens
  misc_feature: GZ8MTXP02I4226.52.19.B08.1.454.CMB.2.raw
  modified_base (187)..(187): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcaccatcacttggccggcagtcgagacattagctatgtatctagtaattggtatacgaagaacgaaaaaggtacggaccaacgtacccctaaactcctacgtaactccgtacgaactcgtacctactacccgtacgttttacgggaacggtaaccgtacggggtaccctaacggttacccgtaaacgggttccgtaagggttagggtaacggttcgggtaccgttcgggtacggggtaaaccttaaagggtttaacctttttaacccgtttaaccaaccgttaacgttaccgaaacgtaccggtaacggtcgttacgaccgtaaacgtcccgttaaggtaaacgtacgttagttacgaacgtaaactagttaacttacgtacgtacaacgtagtaactaacgtccgtactaccgtactacgtacggttaccggggacggggtaaccgagggtacgaacgtacgtaaccgagacgtaacgtggtacgtacgtacgaccgtactagtttccg

SEQ ID NO: 405068 - DNA, 551 bp, Homo sapiens
  misc_feature: GZ8MTXP02JR4DP.52.19.B08.1.454.CMB.2.raw
  modified_base (288)..(288): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccgggcgagtcgagacattagcatgtatctgaattggtatcagacaaaaagtagggacacgacccctaaacgtcctagactccngatgcatcctacgtttggagacgaggggtcccataccgaaggttcagtggaagtggctcgtgggactagttatttacttcacctatcagcaggctgcagcctagagtatgtagacaactatagttacagttacaaacgtatataacgtcgtacctccgtactccgtacggtttccggggacgggggtaacctaaggggtcggaaacgtacgtacgaaggtaccgaaacgttggtaacggctacggaccaacccgttacgtacg

SEQ ID NO: 405069 - DNA, 574 bp, Homo sapiens
  misc_feature: GZ8MTXP02J30KA.52.19.B08.1.454.CMB.2.raw
  modified_base (348)..(348): a, c, t, g, unknown or other
  modified_base (444)..(444): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgcttcttttaagaggtgtccagtgtcaggtgcaactggtggagtcgtgggggagcgtggtccagcctgggagtccctgagctctcttgtgctgaccctctggacttcaccttcgaggtctagtgacatgcacgtgggtcccgccgaggcctaccgaggccgaaaggggctgggagtggggtgctattanatcatatgatggaagtcagatatactatagagacgttccgagaacgggtccattcactcattccaccaagaacgaaccaaccgtccgaagaaaccncgtctagtactctagaactaagtcgacgtcgacggtacgtaggacgacgacgtaacgaaacgtacgttacgttactttaagtacgttaacgtacgtacgtaaccgtaaacttacgacggaacggtaacgg

SEQ ID NO: 405070 - DNA, 614 bp, Homo sapiens
  misc_feature: GZ8MTXP02II8IY.52.19.B08.1.454.CMB.2.raw
  modified_base (185)..(185): a, c, t, g, unknown or other
  modified_base (209)..(209): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagaatcaccatcacttgccggngagtcgagacattagctatgtatctagtaattggtatcagaacaaaagtaggaacacgacccctaaactcctagtactcctacgatgcactacctacgtttaggagtaccgacggggtaccagtaccctaaggttaccaggtacggaagttcggctcggtagggtaactagttactttttaacccttctacctactactacgcgaacggctcgactagaccgtagaacgtagttgttagacaaactattattaactagtacaaactaagttacttaaactccgttacctcccgtacgttaccgtaccgggttttacgggacgggggtaaacctaagggttacggaaacgtacgtaacgtaacgacgtaaaacgtcggtacggacttacgacctaacgtactttcg

SEQ ID NO: 405071 - DNA, 602 bp, Homo sapiens
  misc_feature: GZ8MTXP02I42GI.52.19.B08.1.454.CMB.2.raw
  modified_base (185)..(185): a, c, t, g, unknown or other
  modified_base (389)..(389): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctatagganacagaatcaccatcacttgccgggcagtcgagacattagcatgtatctagaattgatcagacaaaaagtaggacagacccctaaatcctagactcctgaatcggacatccctagtttggagactaggggtacccagtacccgaaaggttcagtaggaagtgctcgtgggactagtatttacttcaccatacgagtacaggtacngacagacgtagaagtagtacgtacgaactaaactattaacgttactacgtaactaaacgtaaagttaattaacgttccgtaccgttacccgtacgtaccggttaacgggtttaccgggggaaccgggggtaaacgtaacggggtaaggtaacgtaacgtaaccggaacgtaccggtaacgtggtacggtacgacgtacctaaccgttactacg

SEQ ID NO: 405072 - DNA, 527 bp, Homo sapiens
  misc_feature: GZ8MTXP02FI72N.52.19.B08.1.454.CMB.2.raw
  modified_base (248)..(248): a, c, t, g, unknown or other
  modified_base (296)..(296): a, c, t, g, unknown or other
  modified_base (336)..(336): a, c, t, g, unknown or other
  modified_base (351)..(351): a, c, t, g, unknown or other
  modified_base (418)..(418): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagcctgggagtccctgagactctcttgngctgcctctggattcaccttcagggtctatgacatgcacgtgggtccncaggctccgaggcgaaggggctgggagtgggtgcatttanatcatatgatggaancagatatactatgtagactcgtagaacgggccattcatcatctaccagagacaactaccgagaaacncgactgtaatctagacaaatcgatacgaaggtctaggaacgagactaggaaagtacgacggtactttaataattaacgtgtacgacgtaaacttaagacgacggaacgg

SEQ ID NO: 405073 - DNA, 582 bp, Homo sapiens
  misc_feature: GZ8MTXP02G7VP6.52.19.B08.1.454.CMB.2.raw
  modified_base (186)..(186): a, c, t, g, unknown or other
  modified_base (208)..(208): a, c, t, g, unknown or other
  modified_base (216)..(216): a, c, t, g, unknown or other
  modified_base (218)..(218): a, c, t, g, unknown or other
  modified_base (224)..(224): a, c, t, g, unknown or other
  modified_base (228)..(228): a, c, t, g, unknown or other
  modified_base (232)..(232): a, c, t, g, unknown or other
  modified_base (243)..(243): a, c, t, g, unknown or other
  modified_base (289)..(289): a, c, t, g, unknown or other
  modified_base (294)..(294): a, c, t, g, unknown or other
  modified_base (341)..(341): a, c, t, g, unknown or other
  modified_base (381)..(381): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcactgcggngagtcgananattagntatntatntagtattgtanacgaagaacgaaaagacggaacaccgtaaccctaactctatactcncgatnactactactacgtagagacgacggtactatacgtagtagagtagagngcgtcgtagatattattacttactacatacagacgagcgngacgacgacgtagaagtagtagtacgtaactaaactaaattaacttacgtacgtaacgtaaactaacgtaactaactaccgtaccgtacccgtaccgtacgttacggttaccggggtaccggggtaacggtaacggtaggaacgtaacgtaacgtaacgtaacgtaacgtacgtacgtacgtacgtaccgtacctacgtcg

SEQ ID NO: 405074 - DNA, 586 bp, Homo sapiens
  misc_feature: GZ8MTXP02H05SQ.52.19.B08.1.454.CMB.2.raw
  modified_base (301)..(301): a, c, t, g, unknown or other
  modified_base (347)..(347): a, c, t, g, unknown or other
  modified_base (364)..(364): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccaggccgtgggacgtccctgagactctcttgtgctgccttctggattccaccttgaggtctatgacatgcacgtgggtcccncgaggcctaccgaggcgaaggggctagggagtgggtgctagtttantaccatatgataggaanacagtattaatactagtagtacgaccttccgtaggaaacgggccctattacatctaatccctacaagaacgacaaactaccgaagaaaccacgtctagtatcctagacaatgaactcgagctagagagacgtaagaaacgtaccgtacgttaacttttaagactttaaaccggtgttaacggaaccgttaaacttaaaggttaccggaaaacgggtaaccgg

SEQ ID NO: 405075 - DNA, 530 bp, Homo sapiens
  misc_feature: GZ8MTXP02I9BMC.52.19.B08.1.454.CMB.2.raw
  modified_base (185)..(185): a, c, t, g, unknown or other
  modified_base (273)..(273): a, c, t, g, unknown or other
  modified_base (398)..(398): a, c, t, g, unknown or other
  modified_base (415)..(415): a, c, t, g, unknown or other
tcagcgcagtacgacacgaccggtgctcgatttagtgagtcagtaagggcagtcccaaccaggacacagcatggacatgagggtccctgctcagctcctggggctcctgctgctctggctctcaggtgtcagatgtgtcatccagatgacccagtcctccttcctcctgtctgcatctatagganacagaatcaccatcacttgccgggcagtcgagacattagcatgtatctgaattggtatcagcaaaaagtggacacgcccctaaatccngactcctgatgacatccactttggacacgaggggtcccataccgaagttcagtggaattgggctcgtagggactagtatttcgttacacgtatcagtcagggcctgcagcctaggaactatggtnacaactatagtttaccnggtactaaacagttataactcgtacctcctctacttccgttacggggcgggggtaaccaaggtcggaagacgtacaaacgccgggaattcgagggcttacgctaacctagtttcc

SEQ ID NO: 405076 - DNA, 610 bp, Homo sapiens
  misc_feature: GZ8MTXP02JZZEK.52.19.B08.1.454.CMB.2.raw
  modified_base (188)..(188): a, c, t, g, unknown or other
  modified_base (381)..(381): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgacccagtcctccttcctccctgtctgcatctatagganacagaactcaccatcacgttggccgggcgagtcgagactattagctatgtatctagtattggtatcagacaaaaggtaggacacgacccctaatcctgtactcctcgatcgctactcctacgtttaggacgacgacggggtccatccgaagttcagtggagtggctcgtaggactacgttattttactacacntacagtacgagctagcagtccgtaagtacgtagtcgttacgactaaactattacgttacttagtaactaaacgtaattaacttaacgttccgttacccgtcccgttaccgtaccgtttaacccgggtttcgggggaaccgggggtaaccgaggggttaacggaacggtacgttacgaaacggtacggtaacgtaggtacggtccgttaggaccctaccgtactttcccg

SEQ ID NO: 405077 - DNA, 649 bp, Homo sapiens
  misc_feature: GZ8MTXP02HRJ9R.52.19.B08.1.454.CMB.2.raw
  modified_base (154)..(154): a, c, t, g, unknown or other
  modified_base (186)..(186): a, c, t, g, unknown or other
  modified_base (190)..(190): a, c, t, g, unknown or other
  modified_base (212)..(212): a, c, t, g, unknown or other
  modified_base (422)..(422): a, c, t, g, unknown or other
  modified_base (619)..(619): a, c, t, g, unknown or other
  modified_base (638)..(638): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgaccngtctccttcctcctgtctgcatctagtagganacanaactcacatcacgtcggccggngagtcgagactagttagctatgtatcttagtaagttggtaatacgaaggtaaaaccgtaaaaaagggtcgggaaacctaaccggtaaccccccttaaaactcccgtagtaacctccgtacggtatcgtacctacgttacccgtacggtttacggaaacgtaccggtaccgggtacctagtaccgtaaaggttcgaggtacggtagtcggntcggtaggacttagtttacttttacctacacttacgcgtaacgcgtacgcgtgacccgtagtaccgtagaaggtattcggtacaacctaattattactttacgtactaacgtaactagttaactacgtccgtcctccgtaacgtcgtaccgggttcgggggaccggtaagtacggagtaactacgacgaagtaacgngtcggtcggcacgtaaccnctttacgttcg

SEQ ID NO: 405078 - DNA, 568 bp, Homo sapiens
  misc_feature: GZ8MTXP02FEHFV.52.19.B08.1.454.CMB.2.raw
  modified_base (252)..(252): a, c, t, g, unknown or other
  modified_base (260)..(260): a, c, t, g, unknown or other
  modified_base (272)..(272): a, c, t, g, unknown or other
  modified_base (302)..(302): a, c, t, g, unknown or other
  modified_base (375)..(375): a, c, t, g, unknown or other
  modified_base (388)..(388): a, c, t, g, unknown or other
  modified_base (449)..(449): a, c, t, g, unknown or other
  modified_base (458)..(458): a, c, t, g, unknown or other
  modified_base (471)..(471): a, c, t, g, unknown or other
  modified_base (553)..(553): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggtttttcctcgttgctcttttaagaggtgtccagtgtcaggtgcaactggtggagtctgggggagcgtggtccagcccgtgggaggtcccctgagactctcttgngctgcctntggatcaccttnagggtcaatgacatcgcacgtggggtcccncaggcctccgagggtaccgaaacgggggctaggggaggtggggtacggactagtttttataatcccaagttancgaagtagggaancaagatataactatgtagacctcggtagaacgggtccattcatcatctacagacactaacnccgaagacncgtctagtactcngactaaagtgaactgaaggtcagaggagctaaggaacgacgtaccggttactttataacctaagtgtacgacctaattaacncgagggtaaacccgg

SEQ ID NO: 405079 - DNA, 739 bp, Homo sapiens
  misc_feature: GZ8MTXP02GBEPG.52.19.B08.1.454.CMB.2.raw
  modified_base (188)..(188): a, c, t, g, unknown or other
  modified_base (249)..(249): a, c, t, g, unknown or other
  modified_base (305)..(305): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagagtgtccagtgtcaggtncaactgggtggagtcgtgggggagcgtggtccagccgtgggacgtcctgagactctcttgngctgcctctggtacttcaccttcgaggtctagtcgactatgctacgtcgggtcccnccgaggcctccgaggcgaaggggctaggggaggtggggtgactatttatactccgaattagtagacggttagggaaaactaacgtaagtattaacgttaacgtagttacggtaacgtaccggttacgggtaagggaaccgggtaccttaataccgtacttacctaacgtcccgtaacgaaacggaaccgtaaacccgtaaccgtaacccggaaaccgaaacccgtaccgttacgttaacgttaaacgttaccgtaaaccgtaaataaacggtacgtaaccgttacggaacggtcgaaacgggtaacggtaacgtaacggtaaaacggtaaaaccgtaccggttaaccgtttaacgtttaacgttaaccgttaacggtacggttacgttaaaaccggtaaacgtttaccggaaccggtaaaaccgggggtaaccg

SEQ ID NO: 405080 - DNA, 628 bp, Homo sapiens
  misc_feature: GZ8MTXP02HV3FE.52.19.B08.1.454.CMB.2.raw
  modified_base (187)..(187): a, c, t, g, unknown or other
  modified_base (212)..(212): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtcctgcatctatagganacagaatcaccatcacttgccgggngagtcagactattagcatgtatctgtaattggtatacaagaacaaaaagtaggacaacgacccctaaactcagctcctacgatgctactcctagtttggagacgtacggggtcctataccgtaaggttacaggtggtaagtggctcgtcgggactagttattttacttcactatcgagctacggctggactagacctagaagtgtacgttagacctaaatattacgttaacgtgtaacctaaactagtaaacttaattccggtacccttaacccggtctaaccgttacccgttttaccggggggaccgggggtaaacccgtaaacgggggttacgggtaaagacgttaaccgaaaaggaccggttaaaacggtcggttaacggggcttacggacctaaccccggtaatttcccggg

SEQ ID NO: 405081 - DNA, 745 bp, Homo sapiens
  misc_feature: GZ8MTXP02H10DI.52.19.B08.1.454.CMB.2.raw
  modified_base (261)..(261): a, c, t, g, unknown or other
  modified_base (304)..(304): a, c, t, g, unknown or other
  modified_base (333)..(333): a, c, t, g, unknown or other
  modified_base (353)..(353): a, c, t, g, unknown or other
tcagcgcagtacgacacgaccggtgctcgatttagtgagtcagtaaggggtctgggagaggaacccagcactagaagtcggcggtgcttccattcggtgatcagcactgaacacagaggactcaccatggagtttgggctgaactgggttttcctcgttgctcttttaagaggtgtccagtgtcaggtgcaactggtggagtcgtgggggaggcgtggtccagccgtggggacgtccctgagactctcttgtgctgccctntggattccaccttcgaggtctagtgacatgcacgtgggtcccncgaggcctccgaggccgaaggggctgggnggtggggtggtctatttaantctatagtgatagggaatacaaagatatacgttatgtaacgaccttcgggagtaacgggggccctaattcgactaccatacccttacccgaagaacgtaaaccgaaaacccgttcccggaaaacgaacccgtacccgggtatttacggttaacttacccggttaaggaacctaaaagttaggaacttaccgggaaaggttccgtaagggacgaaacggttccggtaaaaggggtaaaccgtaaacccggttaacggggtttaaccttttttaaaagtaccggttttaaaaccgttgggttaaaacccggtaaccgtttaaaaaaccggtttaacccggacccggtaaaaaccgggggtaacccggggtaaaaccccggtaaacccccggggg

SEQ ID NO: 405082 - DNA, 723 bp, Homo sapiens
  misc_feature: GZ8MTXP02FOJF0.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgacccagtcctccttcctccctgtctgcatctagtaggagacagaactccaccatcacgttggccgggcgagtcgatacattagctatgtatctagtattggtatcaagaacgaaaaggtcggacacgacccctaaactccgtagactccgtacgtatcgactactaccgtacgtttaggaacgtaccggtacggggtccctagtacccgtaacgggttacaagggtagggtaaggtcgtacgttcggtagggtaacttaacgtttactttttaccttacctaaccgtagtacccgtaggtaccgaggtccgttcgacccggtaacgtccgttaaggtaaacgttgttaacggtttacgaaccttaaacctaagtttacgttaaccttacggttaaacctaaaccgttaaggttaaacctttaaccggtcccggtttccccgaacccgttcgttaccccgggttaccgggtttaccgggggaccgggggtaaacctaaggggttacgaaacgttacgtaaccggaacgtaacggaacgtccggacgtacccgaccgtaaccttcgtaccttacg

SEQ ID NO: 405083 - DNA, 524 bp, Homo sapiens
  misc_feature: GZ8MTXP02FJK4Q.52.19.B08.1.454.CMB.2.raw
  modified_base (297)..(297): a, c, t, g, unknown or other
  modified_base (337)..(337): a, c, t, g, unknown or other
  modified_base (353)..(353): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagccgtgggaggtccctgagactctcttgtgctgcctctggattcaccttcagggtctatgacatgcactgggtccncaggctccaggcgaaggggctgggagtggggtgcatttanatccatatgatggaancagatatactatgtagactcgtgaggccgatcatcatctacagagacaactccgagaaacacgctagtactctagacaaagtgatcgaagtctagagacgcgtagaaacgacgtaccggtactttaatacttaacgtgtacgacgtaaacttaacgtcgaacgggtaacgg

SEQ ID NO: 405084 - DNA, 562 bp, Homo sapiens
  misc_feature: GZ8MTXP02JRQYM.52.19.B08.1.454.CMB.2.raw
  modified_base (257)..(257): a, c, t, g, unknown or other
  modified_base (271)..(271): a, c, t, g, unknown or other
  modified_base (298)..(298): a, c, t, g, unknown or other
tcagcgcagtacgacacgaccggtgctcgatttagtgagtcagtaaggggtctgggagaggagcccagcactagaagtcggcggtgattccattcggtgatcagcactgaacacagaggactcaccatggagtttgggctgagctgggttttcctcgttgctcttttaagaggtgtccagtgtcaggtgcaactggtggagtcgtggggggagcgtggtccaggcctgggagtcctgagactctcttgtgctgcctntggacttcaccttnaggtctatgacatcgcacgtgggtccnccaggcctccgaggcgaaggggctgggaggtgggtggctagtttacatccgaattagtacgagtaggaaacgtcaggtatagtactatgtaagacgttcgagacgggcctagttcatctatctcgaagacacgaactacgacaacacgactgtactactagactaaagtcgaagtacgaggcgagaacgtagagtacgaacgtacgtacgttacttaattagttaacgtcgtacgtacgttaactaacgtacggaacggtaacg

SEQ ID NO: 405085 - DNA, 685 bp, Homo sapiens
  misc_feature: GZ8MTXP02G6GMQ.52.19.B08.1.454.CMB.2.raw
tcagcgcagtacgacacgaccggtgctcgatttagtgagtcagtaaggggcagtcccaaccaggacacagcatggacatgagggtccttgctcagctcctggggctcctgctgctctggctctcaggtgtcagatgtgtcatccagatgacccagtctccttcctccctgtctgcatctataggagacagaatcaccatcacttgccgggcagtcgagacattagcatgtatctgaattggtatcagacaaaagtaggacacgacccctaaactcctgactcctcgaatgacctatcctacgtttcggacgtacgtacggggtacccctaagtacccgtaaacggttcgaaggtaggggaaagttcggtcgtcggttacggggaactagtttaacgtttttaccttacaacctacttaccgagtaccgaacggtcgttacgaccgtaacggtcccgttaaggaaagtacgttagttaccggaaacgtaaaccgttaaattaacttttaacgtaggttaaaccctaaaagtaaccggttaattaaacgttcccgttccgttaccccgtacttaccggttaccgggtttaccggggaccggggggtaaaccctaaggggtaccggtaagtacgttacgaaacggtacgtaaaccgtggtcgacgttacggaccacgtaacgtttccg

SEQ ID NO: 405086 - DNA, 566 bp, Homo sapiens
  misc_feature: GZ8MTXP02GPIM9.52.19.B08.1.454.CMB.2.raw
  modified_base (249)..(249): a, c, t, g, unknown or other
  modified_base (305)..(305): a, c, t, g, unknown or other
  modified_base (496)..(496): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagccgtgggagtccctgagactctcttgngcctgccctctggtacttcaccttcgaggtctatgacatcgaccacgtcgggtccnccgtaggcctccgaggcgaaggggctgggagtggggtgactaatttagtatccatatgagtggaatcagtataagtacttatgtaacgaccttgagaacgggtcctatcatcatcaccgagaacgaccctaaacgtcccggaataaaccgacgtcttagtactccaagtacaaatcgatcgagtcagagancgtagaaacgtacgacgttaacttagtacgtaacgtgtacgacgtaacttaacgacggaacgggaaccgg

SEQ ID NO: 405087 - DNA, 589 bp, Homo sapiens
  misc_feature: GZ8MTXP02H7FVA.52.19.B08.1.454.CMB.2.raw
  modified_base (191)..(191): a, c, t, g, unknown or other
  modified_base (353)..(353): a, c, t, g, unknown or other
  modified_base (392)..(392): a, c, t, g, unknown or other
  modified_base (461)..(461): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagcttgggttttcctcgttgcttcttttaagaggtgtccagtgtcaggtncaactggtggagtcggtggggagcgtggtccagccgtggggacgtccctgagactctcttgtcgctgccttcgtggacttcaccttcgtaggtcctatcgacagtcgctacggtcgggtcccacgaggccctacgaggccgaaggggctagggacgggtggnggacttaattacgtataccgatagtgaacgtaggaacgnagtattatacttagagtacgtactcggaagtacggactattcatcactcacaagactacaacgtcgaanacctgtcttagacatagaactaaagcgtatcgagtacgaaggacgtgtaccgagaaacgtcgaacgtttactttatacgtaacgttagaacgtaacgtaaccttaacggacggtaaaccggaaccggg

SEQ ID NO: 405088 - DNA, 821 bp, Homo sapiens
  misc_feature: GZ8MTXP02GI3J3.52.19.B08.1.454.CMB.2.raw
  modified_base (186)..(186): a, c, t, g, unknown or other
  modified_base (217)..(217): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaacctatctacgttcggccgggngagtcgagactagttagctatgtatcgtagtaattggtatcgaagacgaaaaaggtcggaacaaccgtaccccctaaatcctacgtaactcccgtacgatcgtactactttacccgtagtttacgggaacggaaccggtaaccggggtaccctaagttacccccggtaaagggtttaccgaaggggttaacggggtaaacggttccggggtacccttggggttaacgggggtaaaccttaaacggttttaacgtttttttaaaccccgttactaaacccgtaaactttacgaaacggttaccggaaacggtcccggttagaaccgtaacggtacccgttaagggaaaacgttcgttaggttaacaaacccgttaaaagttaaactttaaacgtttataaaccggttaaacctaaaacgttaacgttaaaccgttaacttcccggttacccgtaccccgttacggttaacccgtttaaccggggttttcccggggggaacgggggttaaaccggtagggggtaaacggtacggtaaactacggaaaccgtacgggttaacgttcggggaacgtccgttacggacctaaaccgggtttctttaccg

SEQ ID NO: 405089 - DNA, 684 bp, Homo sapiens
  misc_feature: GZ8MTXP02GPHED.52.19.B08.1.454.CMB.2.raw
  modified_base (186)..(186): a, c, t, g, unknown or other
  modified_base (211)..(211): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcacatcacttggccgggngagtcgagacattagctatgtatctgattggtatcagacaaaaggtggacacgacccctaaactcctagactcctcgaatcgctactccctacgtttacgggacgtaccggtacggggtacccctagtaccgtaacgggttaccgaagggttacgggtaaaggtcgggtacgttcgggtacggggtactaacggtttaatttttaccttacgacctagtacagtacgtaggtactcgtacgacgtccgtaaggtaagtagttacggtacgtaaacctaaacttacgttaactttaaccgttaggtaaaccaaaccgttaaggttaaactttaaacgttcccggttaaccgtccccgttacgttacccggttacgggtttccgggggaacgggggtacgtaaacggggttggaacgttacgacgaacgggttacgaacggttacggtcggtacgtcgacctaacgtcgtttccg

SEQ ID NO: 405090 - DNA, 640 bp, Homo sapiens
  misc_feature: GZ8MTXP02JHUU7.52.19.B08.1.454.CMB.2.raw
  modified_base (249)..(249): a, c, t, g, unknown or other
  modified_base (257)..(257): a, c, t, g, unknown or other
  modified_base (282)..(282): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctggggttttcctcgttgctcttttaagaggtgtccagtgtcaggtgcaactggtggagtctgggggagcgtggtccaggcctgggagtccctgagactctcttgngctgcctntggattccacttcaggtctagtganatgcacgtgggtccgcaggcctccgaggcgaaggggcctggggaggtgggtggctatttagtatcctatagtgaattagggaaagtcaagtataataacttagtagtacgaccgttccgaggtaaacggggccctattcaatctaactcctccgaagtacgaaaccgaaccgttaccggaacgtaaaccgacccggtctaccggttaattcccgtaaagtaacgtaaagtagtaacgtacggtacggtacgtacggaaacggacgtaacggtaacggtaaacgtaccggtaaccgttactttaacgttaacgttaacgtagttacgaacgttaaacttaacggtacgaacggtaacgg

SEQ ID NO: 405091 - DNA, 644 bp, Homo sapiens
  misc_feature: GZ8MTXP02FI62I.52.19.B08.1.454.CMB.2.raw
  modified_base (250)..(250): a, c, t, g, unknown or other
  modified_base (299)..(299): a, c, t, g, unknown or other
  modified_base (379)..(379): a, c, t, g, unknown or other
  modified_base (457)..(457): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccaggcctggggacgtccctgagctctcttgnctgcctctggattcaccttcagggtctatgacatgcacgtggggtcccnccgacgggtcctccgaggccgaaagggggcctaggggacggtggggtggactatttactatccattatggataggggaanacagataaatctaatgtacgacgtccgtagaacgggccgtattcatctactctaccgagacgaacacctaccggaaanaaccgacgtctagttactactacgacaaaagtgacttaccggaaggccgttagggaacgtaggtaaccgtaggaaaaccgtaaccgtacggggtttaaccttttaaaggtttaacttaaaaccgttgggttaaccggtaaaccgtaaacgtttaaaactacccgggtaaacgggtaaaaccccgggg

SEQ ID NO: 405092 - DNA, 662 bp, Homo sapiens
  misc_feature: GZ8MTXP02FK070.52.19.B08.1.454.CMB.2.raw
  modified_base (187)..(187): a, c, t, g, unknown or other
  modified_base (214)..(214): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaactcaccatcacttggccgggnagtcgagacattagctatgtatctgaattggtatcagacaaaagtaggacacgaccctaaactctgactcctcgatcgcactccctacgtttggagacgacggggtaccctatacccgtaggttcgaggtggaagtcggctcgtaggggactagttattttacgttacacgtactaccgagacgacggtctcgacgacgccgtaagtaagtattaggttacgaactaaactaatttagttaagttacgtaacctaaagtaagttaacttaaacgttccgttcccgttacccgtacgtttacccggttaaacccggttttaccgggggaacccggggggtaaaccgtaaacgggggttagggaaaccgtaaggttaacccggaaaggtaaccggttaaaccgtggtttaaacgggaccgttcggaaccctaaccggtttctttaaccgg

SEQ ID NO: 405093 - DNA, 682 bp, Homo sapiens
  misc_feature: GZ8MTXP02HHCD3.52.19.B08.1.454.CMB.2.raw
  modified_base (205)..(205): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctcctgtctgcatctataggagacagatcacatcatgcggnagtcgagctattagcatgtatctagtaattggtaatcaagaacgaaaaaggtagggaaccacgtacccctaaactcctgtaacgtcctacgtatcgactacttaccctacgtttacggaacgaccggtacggggtacccctaagtaccccgtaaacggttcgacgggtaggtaagtcggtcgtcgtaggggaactaggttattttaaccgttcaaacctataccaaggtcgtaacggtctacggtaccgacgtaccgttaagtaacggtattcgggtactaaacgtaaactaacgttaactttaaaccgtcgggttaaaccctaaacttacggtaaactttaaacctcccggttaccctacccgtaccgttacgggttaaccccgggtttcgggggaacccgggggtacgtaacggggtagacgtactaccgaaggtacccgtaagtcggtcgaccgtacgtaccgaccgtatcccg

SEQ ID NO: 405094 - DNA, 513 bp, Homo sapiens
  misc_feature: GZ8MTXP02FIM7Y.52.19.B08.1.454.CMB.2.raw
  modified_base (186)..(186): a, c, t, g, unknown or other
  modified_base (211)..(211): a, c, t, g, unknown or other
  modified_base (303)..(303): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcacttgccgggnagtcgagacattagcatgtatctgaattggtatcagcaaaaagtagggacagacccctaaactcctgatcctcgatgcatccactttggganacaggggtcccatccaaaggttcagtggaagtggctcgtgggacagtatttacttcacatcagtcaggctgcagcctagaagcttagttcgactaaacatattactagtaccaaacagttataaatcgtacctcccgctactacgtttcgggacgggggaccagggtgacgactacgaagacgaaaccgtgacggtcgtgacaccattcg

SEQ ID NO: 405095 - DNA, 707 bp, Homo sapiens
  misc_feature: GZ8MTXP02HE027.52.19.B08.1.454.CMB.2.raw
tcagcgcagtacgacacgaccggtgctcgatttagtgagtcagtaaggggcagtcccaaccaggacacagcatggacatgagggtccctgctcagctccgtggggctcctgctgctctggctctcaggtgtcagatgtgtcatccagatcgacccagttcctccttcctcctgtctgctatctagtaggagacaagaactccaacctatccgtacgttcgggaccgggtctaggtcgaagactattagctatgtatcgtagtaagttggtatacaagaacgaaaaaggtacggaccaaccgtaaccccctaaagtcctgactccgtacgatcgactactcccgtaggttggaacgtaccgtacggggtaccctagtaccgtaaggtaccgtaggtacggtaggtcgacgttggtacgggtaacttagtttaaccttttccttaaccaccttagaccgcgaacgtcggctacgggaccacgggttacgaggtaagttcgtttacggagtaaacctaaacttaattaccgttttaacggactaaacggtaaacttaacgttaacaccgtttcccgtacccggtacccgttaccgttacgggttaacccgggggtttcgggggaacccgggggtaaacgtaggggtacgaacgtacgtacgaacgggtaccgtaacggttgacgtcgaactccctaacggtttacttccg

SEQ ID NO: 405096 - DNA, 708 bp, Homo sapiens
  misc_feature: GZ8MTXP02HTO0R.52.19.B08.1.454.CMB.2.raw
  modified_base (190)..(190): a, c, t, g, unknown or other
  modified_base (265)..(265): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgaccctagtcctccttccctcctgtctgcatctagtagganacagaatcaacctatccacgttcggccgggacgaggtcgagactattagctatgtatcgtagtaagttcggtaanacgaagaaacgtaaaaggtacggacctaaccgtaacccctaactcctacgtacctccgtagtactacgtactaccgttacgttacggtacggacggtaccggtaccggtacctagtaaccgtaaggttacgtaggttaggtacggttcggtcgtacgggtacggtacttaacgtttacctttacctacactactacgtacgtcgtacgtctcgacgtacgtacgtaagtacgtagttacgtacgtactaaacttagttacttacgtaacgtaactaacgttaacgttaacttaccttaccgttacccgtaccgttaccgttaccggttaccggggttaacgggggtaaccggggtaacggtaacgggtaacggtaacgtaacgtaacggtaacggtaacgtaacggtcggtacggtacgtaccgtaccgtaccgttacgttcg

SEQ ID NO: 405097 - DNA, 693 bp, Homo sapiens
  misc_feature: GZ8MTXP02FIDO9.52.19.B08.1.454.CMB.2.raw
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctataggagacagaatcaccatcacgttgccgggcgagtcgagacattagctatgtatctagtaagttggtaatcgaagaacaaaaaggtacgggaacaccgtacccctaaactcctagacctcctcgatcgctactcccgaacgtttagggacgtaccggacggggttcccctaatacccgtaacggttccgaggtagggtaggtcggtcgttcgtaggggacttagttacttttacctttacgacctagttacaaggcgtaacggtctaggcccgaagccgttaaggaaacgttgttacggtcgaactaaactagttaactttacgtaagttaaccaaagttaacgttaactaacgtttccccgtaccgtaccccgtaaccgtttccgggtaccgggtttacccgggggaccgggggtaaaccggttaaagggacggtaaacgtacgtaaaccggaacggtaaccggtaacggtcggtacggtacgtaccgaaccgtaccgtaacgtttcccg

SEQ ID NO: 405098 - DNA, 614 bp, Homo sapiens
  misc_feature: GZ8MTXP02G311M.52.19.B08.1.454.CMB.2.raw
  modified_base (211)..(211): a, c, t, g, unknown or other
  modified_base (430)..(430): a, c, t, g, unknown or other
  modified_base (524)..(524): a, c, t, g, unknown or other
  modified_base (598)..(598): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaactcaccatcacgttgccggngagtcgagactattagctatgtatcgtagattgtatcaagaacgaaaagtacggaccacgtaaccccctaatccctagtacttacccgtcgaatcgactacttcccgttacgtttaggacgtaaccggtacggggtccctagtacccgtaaaggttccgaaggtacggtaaggtcggacgttcggtagggaactagttacttttacgttacactatcgngactagtcgatcgacgtcgtagtaacgtgtacgttacgaactactaagttacttactagtacctaaagtactaatacgttcgtcctaccggtcncgttaaccggttggggaccggggtacgcgggtaggacgtaacgacgtaacggtacgtaacgtggtacggacctnacccgtagcgtttacg

SEQ ID NO: 405099 - DNA, 571 bp, Homo sapiens
  misc_feature: GZ8MTXP02IXD5Z.52.19.B08.1.454.CMB.2.raw
  modified_base (212)..(212): a, c, t, g, unknown or other
  modified_base (277)..(277): a, c, t, g, unknown or other
  modified_base (392)..(392): a, c, t, g, unknown or other
  modified_base (414)..(414): a, c, t, g, unknown or other
tcagcgcagtacgacacgaccggtgctcgatttagtgagtcagtaaggggcagtcccaaccaggacacagcatggacatgagggtccctgctcagctctggggctcctgctgctctggctctcaggtgtcagatgtgtcatccagatgacccagtctccttcctcctgtctgcatctataggagacagaatcaacctatcacttggccgggnagtcgagacattagctatgtatctgaattggtatcagacaaaagtaggacacgacccctaatccngatcctgatgacactccctacgtttggactacgacggggtcccagtccgaaggttcaaggtggaagtcggctcgtagggactaggtactttttaccgtacactatcaagcaggcngtcagcctaggaatatcggtanactaatattacttacgtacgtactaacgtattactacgttccgtacctccgtacgtacgttaccgggttaccggggacggggtaacctagggtacgtacgtacgtacgtaacggtacgtaagttcggtacggtacctacggacctaccgtactttcg

SEQ ID NO: 405100 - DNA, 607 bp, Homo sapiens
  misc_feature: GZ8MTXP02HAXX3.52.19.B08.1.454.CMB.2.raw
  modified_base (283)..(283): a, c, t, g, unknown or other
  modified_base (467)..(467): a, c, t, g, unknown or other
  modified_base (526)..(526): a, c, t, g, unknown or other
  modified_base (587)..(587): a, c, t, g, unknown or other
  modified_base (601)..(601): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatcgaccctagtcctccttcctcctgtctgcatctagtaggagacagaatcaccatcacttggccgggcgagtcgagactattacgctatgtatctgtaattggtatcagaacaaaagtaggacacacccctaaacncctagactcctagatgactacttcccgtagtttagggacgtaacggtacggggtacccctagtaccgtaaacggttcgaaggtagggtacggtcggtctcgggtacggggtaactaaggtttactttttaacttccgaaactcttaacgagtaccgaggcttggaccacggttcgaagaacgtntacgtcgaaacacttagtattacgtataaccgaatattaaactctaccgtctacccgtntacgtcgggtttacgggaccggggtaagacggtgaacgtcacgaacgtacgcgttaggacnctaacgctaacgtntttccg

SEQ ID NO: 405101 - DNA, 572 bp, Homo sapiens
  misc_feature: GZ8MTXP02JJKY9.52.19.B08.1.454.CMB.2.raw
  modified_base (155)..(155): a, c, t, g, unknown or other
  modified_base (248)..(248): a, c, t, g, unknown or other
  modified_base (296)..(296): a, c, t, g, unknown or other
  modified_base (360)..(360): a, c, t, g, unknown or other
  modified_base (431)..(431): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttccncgttgctcttttaagaggtgtccagtgtcaggtgcaactggtggagtcgtgggggagcgtggtccagcctgggagtccctgagactctcttgngctgcctctggattcaccttgaggtctatgacatgcacgtgggtcccnccaggcctccgaggcgaaggggctgggaggtggggtgctatttagtatccatatgactaggaancagatatactagtgtagacctccggtagacgggccgtattcgatcatcctacgagagaccaactaccgaanaacgacgtctagtactctagactaaagtgaatcgaaggtcaggaacgagaccgtaggaaacgaccgtacggtactttaacgtagtttaacgtggttaaccggtaacttaaacgtttaacgtaccggtaacgggtaaaccgg

SEQ ID NO: 405102 - DNA, 682 bp, Homo sapiens
  misc_feature: GZ8MTXP02FJ2DB.52.19.B08.1.454.CMB.2.raw
  modified_base (186)..(186): a, c, t, g, unknown or other
  modified_base (213)..(213): a, c, t, g, unknown or other
  modified_base (222)..(222): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctatagganacagaatcaccatcgacttggccgggngagtcgganacattagcatgtatctgaattcggtatcagaacaaaaaggtaggacacgtacccctaaactcctagtactccctacgaatcgctatccctacgtttagggagtaccgaggggtacccctaataccgtaaaggttcgaaggtagggtaaggtcggtcgtcgtaggggtaactagttacttttacttcaacctagtcacgtcgagtctagcgacgaccgtaggtaaaatgtacggttaagaaacctaaacttaaactttaacttaaccgttagtaaacctaaaacgttaacgttaaacttaaccgttcccgtaccgttacccgtaccgttaacggttaccccggggtttaccgggggaaccgggggttaaccgtaaacgggggtaaggtaacgtaaacgtaaccggaacggtaacgttaacggtcggtacggtccgtacggtaccctaaccgttacgttccg

SEQ ID NO: 405103 - DNA, 583 bp, Homo sapiens
  misc_feature: GZ8MTXP02JKD70.52.19.B08.1.454.CMB.2.raw
  modified_base (250)..(250): a, c, t, g, unknown or other
  modified_base (295)..(295): a, c, t, g, unknown or other
  modified_base (362)..(362): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaactggtggagtcgtgggggagcgtggtccagccgtgggagtccctgagactctcttgtnctgcctctggattcaccttgaggtctatgacatgcacgtgggccncgaggcctccgaggcgaaggggctgggaggtgggtggactatttatatcctatagtagagtggaaancaagataatactatagtagactcggtagaacgggtccctagtcatcgatccgtaccgaagacgaaccaacctaccggaaactaacgtaccggtctaagttagtcctagaactaagtgacttacgaggtctaggagacgtaccgaggaaacgtacgaccgttaactttagtaacgttaacgtaggtacgtaccgtaaagttacgtacggaacgggaaaccgg

SEQ ID NO: 405104 - DNA, 703 bp, Homo sapiens
  misc_feature: GZ8MTXP02H9EQZ.52.19.B08.1.454.CMB.2.raw
  modified_base (122)..(122): a, c, t, g, unknown or other
  modified_base (185)..(185): a, c, t, g, unknown or other
  modified_base (234)..(234): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctntcaggtgtcagatgtgtcatccagatgacccagtctccttcctcctgtctgcatctatagganacagaatcaccatcattcggccgggcagtcgagactattagcatgtatntgaatggtatcaagacaaaaggtaggacacgtacccctaaatcctagactcctacgaatcgactactaccctagtttaggagaaccgtacggggtccctaagtacccgtaaaggtttaccgaaggtagggtaaggtcggtacgtccggtagggggtaaattacgggtttaaactttttaccttaccaaacccttaattaccaaagccgtaaaggcttcggacgaacgtccgttaagaaacgtgtttaccggtttaaacaactaaacttaaactttaactttaacgttaacgtaacgtaaacgtaacgttaaacgttaacgttaccgttaccgttacccgtaccgttaccggttaccgggttaccgggggtaccgggggtaaccgggtaacggggtaacgggtaacggtaacgtaacgtaacggtacggtaacggtacggtacggtacgtacgtaccgtaccgtacgtcg

SEQ ID NO: 405105 - DNA, 688 bp, Homo sapiens
  misc_feature: GZ8MTXP02F3WLF.52.19.B08.1.454.CMB.2.raw
  modified_base (213)..(213): a, c, t, g, unknown or other
tcagcgcagtacgacacgaccggtgctcgatttagtgagtcagtaaggggcagtcccaaccaggaaacagcatggacatgagggtccctgctcagctcctggggctcctgctgctctggctctcaggtgtcagatgtgtcatccagatgaccctagtctccttcctcctgtctgcatctataggagacagaatcaccatcacgttggccgggngagtcgagactattagctatgtatctgtaattggtatacagactaaaaagtggacagtcccctaaatcctgattccctgaatcgctactccgtagtttcggaacggtaccgaacggggttcccaaacgtactaaacgggttcaaggtagggtaaacgttggggaccttcgttcgggggaactaaggttactttttaaacctttcaaccccgttaatacgacgtacgtaggtcgtagacgtacgtacgtacgtaagtagttacgttacgtactaactaacttaacttaacttacgttaactaaacgtaaagttaacgttaacgttaccgttacccgttacccgttaccgttaccgttaccgggttaccggggtaccgggggtaacgggtaaacgggtaacggtaacggtaacggtacgtaacggtaacggtaacggtaacggtcggtacgtacgtacgtaccgtacgtacgttccg

SEQ ID NO: 405106 - DNA, 597 bp, Homo sapiens
  misc_feature: GZ8MTXP02FF6JW.52.19.B08.1.454.CMB.2.raw
  modified_base (187)..(187): a, c, t, g, unknown or other
  modified_base (212)..(212): a, c, t, g, unknown or other
  modified_base (456)..(456): a, c, t, g, unknown or other
  modified_base (481)..(481): a, c, t, g, unknown or other
  modified_base (591)..(591): a, c, t, g, unknown or other
tcagcgcagtacgacacgaccggtgctcgatttagtgagtcagtaaggggcagtcccaaccaggacacagcatggacatgagggtccctgctcagctcctggggctcctgctgcctctggctctcaggtgtcagatgtgtcatccagatgacccagtctccttcctccctgtctgcatctatagganacagactcaccatcacttgccgggngagtcgagactattagctatgtatctagaattggactcgagaacaaaaggtcggactacgcccctaaactcctagactcctgatcgcactccctacgtttagggacgtaccgacggggtacccctagtaccccgtaagggtttccgaaggtagggaaacgttcgggacttcggtacggggaactagttaacttttaccttcgaaccctattcgagcgaggtctcgcgtacgccgttagaaacgnttacgtgacaactaacttacttacncgttaacaacgtattaatacgttccgtacctccgtactcgtaccggttccgggacggggtactaaggaggaactacgacaagacgtaacgtggtacgctagaccgaaccngtttcc

SEQ ID NO: 405107 - DNA, 609 bp, Homo sapiens
  misc_feature: GZ8MTXP02JPUDZ.52.19.B08.1.454.CMB.2.raw
  modified_base (246)..(246): a, c, t, g, unknown or other
  modified_base (294)..(294): a, c, t, g, unknown or other
  modified_base (301)..(301): a, c, t, g, unknown or other
tcagcgcagtacgacacgaccggtgctcgatttagtgagtcagtaaggggtctgggagaggagcccagcactagaagtcggcggtgcttccattcggtgatcagcactgaacacagaggactcaccatggagtttgggctgagctgggttttcctcgttgctcttttaagaggtgtccagtgtcaggtgcaacgtggtggagtcgtgggggagcgtggtccagcctgggagtcctgagctctctgnctgcctctggattcacttcgaggtctatgacatgcacgtggggtcccncgacgcncgaggacgaggggctgggaggtggtgactatttatatctatagtagtagtaggaaactacgaagtattaaatactagtacggtaacgtaccgttacggtagggtaacggtacgtaactcactactactaccgtacgaagacgaccgtaaccgtaccgaacgaaccgtacgtactacgttactacgtacgaacgtaaagtacgtactacgtacgacgtaggacgtacgtacgtaacgaaacgtacgtacgttacttaacgtacgttaacgtacgtacgtaacgtaacgttacgtacggaacggtaacgg

SEQ ID NO: 405108 - DNA, 622 bp, Homo sapiens
  misc_feature: GZ8MTXP02GAV0H.52.19.B08.1.454.CMB.2.raw
  modified_base (217)..(217): a, c, t, g, unknown or other
  modified_base (295)..(295): a, c, t, g, unknown or other
  modified_base (297)..(297): a, c, t, g, unknown or other
  modified_base (441)..(441): a, c, t, g, unknown or other
tcagcgcagtacgacacgaccggtgctcgatttagtgagtcagtaagggggcagtcccaaccaggacacagcatggacatgagggtccctgctcagctcctggggctcctgctgctctggctctcaggtgtcagatgtgtcatccagatgacccagtctcccttcctcctgtctgcatctagtaggagactagaatccaccatcacgttggccgggnagtcgagactattagctatgtatctagaagttggatagagaacaaaaggtggacacgacccctaatcctgactccagntnacacttaccgtacgttgacgacgacgggtaccagtaccgtaaggttcaaggtgggtaacgtcgaccttgggtggggaactaaggtttattttaccttacgaacctatacgagctaaggcgagtctagaccgttagaaacggttntacgtacaactaaactattaacttacgtactaactaaacgtaacgttacgtactcccgtaccgtaccgtacgttaccgggttacggggttaccgggggacggggtaaacgtacgggtacgaacggtaacgtacgaacggtacgtaacggtcggtaacggtccgtagacctacgtacgttcg

SEQ ID NO: 405109 - DNA, 694 bp, Homo sapiens
  misc_feature: GZ8MTXP02JJ6S2.52.19.B08.1.454.CMB.2.raw
  modified_base (462)..(462): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctcctttctccctgtctgcatctataggagacagaatcaccatcacttggccgggcagtcgagacattagctatgtatctagaattggtatacagaacaaaaggtacggaacacgaccccctaaatccgtagtaactccgtacgatcgtacactacccgtagtttaggacgtacgtacggggtaccccagtaccgtaacggttcgaggtagggtacgtcggcttcgggtacgggtactaagtttacttttacgttacaacctagtaccagtacgagcgtcgaccgtaacgtccgtaagtaaaggtnttacgttaacgaactaaactaatttaacgttaacgtcgtaaacctaaaagttacgttaaagtaaccttccggtaccttaccccggtacttaccgggttaaccgggtttaccggggggacccgggggaaaccgtaaagggggtacgggtaaacgtaccgtaaaccggtaacggtaacccggtaaaggtccggttacggaccgttaccggaacctaacccggtactttaccccg

SEQ ID NO: 405110 - DNA, 565 bp, Homo sapiens
  misc_feature: GZ8MTXP02F0FAN.52.19.B08.1.454.CMB.2.raw
  modified_base (209)..(209): a, c, t, g, unknown or other
  modified_base (304)..(304): a, c, t, g, unknown or other
  modified_base (393)..(393): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctcctgtctgcatctataggagacagaatcaccatcacttgccggngagtcgagacattagcatgtatctgaattggatcagacaaaaagtagggacagacccctaaaactcctgaatcctacgatgcatccactttgganacgaggggtcccatccaaaggttcagtggaagtggctcgtgggactagtacttttacgttcactatcagcagctgcagcctagaaagtntagtagactaaactattacgttactagtaacaaataagtaattaacgtccgtacctcccgtacgttaccgtacggttaccgggggaccgggggtaaacgtaagggtacggtaacgtacgtaacgaaacgtacgtaacgttggtacggtacgtacgacctaaccgtacgttcg

SEQ ID NO: 405111 - DNA, 587 bp, Homo sapiens
  misc_feature: GZ8MTXP02I2032.52.19.B08.1.454.CMB.2.raw
  modified_base (206)..(206): a, c, t, g, unknown or other
  modified_base (224)..(224): a, c, t, g, unknown or other
  modified_base (228)..(228): a, c, t, g, unknown or other
  modified_base (483)..(483): a, c, t, g, unknown or other
  modified_base (498)..(498): a, c, t, g, unknown or other
  modified_base (505)..(505): a, c, t, g, unknown or other
  modified_base (524)..(524): a, c, t, g, unknown or other
  modified_base (579)..(579): a, c, t, g, unknown or other
tcagcgcagtacgacacgaccggtgctcgatttagtgagtcagtaagggcagtcccaaccaggacacagcatggacatgagggtccctgctcagctcctggggctcctgctgctctggctctcaggtgtcagatgtgtcatccagatgacccagtctccttcctcctgtctgcatctataggagacagatcacatcacttgccggngagtcagacattagctangtanctgaattggtatcagacaaaaggtacggacacgccccctaaaatccgtgtatcccgtagtactgactactacccgtaccgtttaggacgtacggaacggggttaccccaagtccccgtaaaggtttccgaaggtttaggggaaacgtttcggacgtttcgtagggggaactacggtttacgtttttactttacccactaacgttcaaacggtccgttaagggcctggtacccgacgcgtaagtaacgtgtacgtntacatactatacgtnaactagntatactcgactccgactcncggttcgggcggaccgaaggtgggctatacgacaccgtaagcgttggctggaccnccaattcc

SEQ ID NO: 405112 - DNA, 640 bp, Homo sapiens
  misc_feature: GZ8MTXP02FT8V3.52.19.B08.1.454.CMB.2.raw
  modified_base (187)..(187): a, c, t, g, unknown or other
  modified_base (210)..(210): a, c, t, g, unknown or other
  modified_base (287)..(287): a, c, t, g, unknown or other
  modified_base (291)..(291): a, c, t, g, unknown or other
tcagcgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtcctccttcctccctgtctgcatctatagganacagaatcacatcacttgccggngagtcagacatagctatgtatcagtaattggtatcagaacgaaaaagtaggaacacgaccccgtaaactcagatccncgangcactcctacgttaggactacgtacggggtaccctagtacccgtaggttacaaggtacggtaaaggtcggccgttggtacgggtaacgtaaggtttaacctttttaccttttaccgaacctagttaccaacgttcgaacgggtctggaccgtcgtaccgtaagtacgttaatgttacgaactaaacgtatttaacgttaacgtacgttaactaaaccgtaagttaacttaacgtcccggtacctacccgtacgtaccgttaccggttcggggaccgggggtataacgggcggtaaagacgtacgaacgtacgtaacgtcggtacgtacgtcgaacctccgactttaccg

SEQ ID NO: 405113 - DNA, 526 bp, Homo sapiens
  misc_feature: GZ8MTXP02HCC47.52.19.B08.1.454.CMB.2.raw
  modified_base (405)..(405): a, c, t, g, unknown or other
  modified_base (413)..(413): a, c, t, g, unknown or other
tcagcgcagtacgacacgaccggtgctcgatttagtgagtcagtaaggggcagtcctaaccaggacacagcatggacatgagggtccctgctcagctcctggggctcctgctgctctggctctcaggtgtcagatgtgtcatccagatgacccagtctccttcctcctgtctgcatctataggagacagaatcaaccatcacttgccgggcgagtcgagacattagcatgtatctgaattggatcagacaaaagtaggacagcccctaaatcctgatcctacgatgcatccactttggagacacggggtccatccaaggttcagtaggaagtggactcgtgggacagtactttacttcacatcagcaggctgcagcctgaagatgttagcaaactataatttacngtaccaanaagtataaacgtctacgtcccactacgacgtttacgggacgggggtacctaaagggtcgggaaagcgtaacgaggtacgaacgtcggtacggcttacggaccacgtaactccg

SEQ ID NO: 405114 - DNA, 627 bp, Homo sapiens
  misc_feature: GZ8MTXP01D353O.10.26.C04.1.454.CMB.2.raw
  modified_base (238)..(238): a, c, t, g, unknown or other
  modified_base (251)..(251): a, c, t, g, unknown or other
  modified_base (264)..(264): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagngtccgtgggcctnagtgaagattccngcaaggcgcgatacaggtcaccgcgtctatattaatggctgcgacacggcccctaggaccgaagggcctggagtggagtgggggaacgaacgtacgaaacccggaggtggggaagggttgggtggcgaaggaacggtaccgacccgtaagggtacgggtttcgaggggacaggtacgtctccgagtacgaccagtcgacgaccgtccgacgacgcgacgttgttacctaagtagtaggaagtagtaggaaggacgtccgttaggaacggtaacgttaggaaccgaccgttaccgggtaccgttaagttacgttacgttggtaagacggtaaggaacgtacgggaaaggtaagggttcgtaacg

SEQ ID NO: 405115 - DNA, 630 bp, Homo sapiens
  misc_feature: GZ8MTXP01BFDZE.10.26.C04.1.454.CMB.2.raw
  modified_base (241)..(241): a, c, t, g, unknown or other
  modified_base (267)..(267): a, c, t, g, unknown or other
  modified_base (283)..(283): a, c, t, g, unknown or other
  modified_base (308)..(308): a, c, t, g, unknown or other
  modified_base (313)..(313): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagcgtggtgcagtcgtggggctggagatggaagngtccgtggggcctgagtgaatcttcngcaaggcgcgatacgngtcacgctctatagtatgctgcacncgccnggacgaggctgagtggagtagggacagtacgaaccgtgtggaaggtggcgacgaggtacgtaccgaccgtagtacggttcgagggcgtacggtacgtccgtaccgagttaccggaccgtaggtccgaacggtcccgtacggacgtacgtcgtaacgttcggtacctaaggttagcgggtaagtcggttaacggacggtaccgtaccgtaggtaaccggtaacgttacggaacggtaccgttaaacggttcgtaaacgtttcgttacgttggttaacggacgaagtaacgtacgggaaaggtaacggttcggtaaacc

SEQ ID NO: 405116 - DNA, 594 bp, Homo sapiens
  misc_feature: GZ8MTXP01DAXA4.10.26.C04.1.454.CMB.2.raw
  modified_base (236)..(236): a, c, t, g, unknown or other
  modified_base (249)..(249): a, c, t, g, unknown or other
  modified_base (588)..(588): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagngtccgtgggcctnagtgaagtatttcctgcgaaggcgtaccggatacgagttcaccgcgtactatattaatggctgacgacacggcccctggacaaggcctgagtggagtaggggacaatacgaacccgaggtggaagggttggtcgacgaaggaacgtaccggacccgaggtacgggttacgaggggtcaggtacgtccaccgagtacgaccgtagtacgaccgaccggcccgacgtacggactaccgttggttacctaagtagtaggagtagtaggagagtccagagtaacgtgaacgacgacgggtacctaattacgttgttgtgacgaagtaagtacggaagtaaggngtaacg

SEQ ID NO: 405117 - DNA, 560 bp, Homo sapiens
  misc_feature: GZ8MTXP01BDLB1.10.26.C04.1.454.CMB.2.raw
  modified_base (191)..(191): a, c, t, g, unknown or other
  modified_base (239)..(239): a, c, t, g, unknown or other
  modified_base (253)..(253): a, c, t, g, unknown or other
  modified_base (268)..(268): a, c, t, g, unknown or other
  modified_base (287)..(287): a, c, t, g, unknown or other
  modified_base (316)..(316): a, c, t, g, unknown or other
  modified_base (358)..(358): a, c, t, g, unknown or other
  modified_base (370)..(370): a, c, t, g, unknown or other
  modified_base (454)..(454): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtnctcactcccaggtgcagctggtgcaggtcgtggggctgagatagaagngtccgtggggcctnagtgaagattttccngacaaggcgccggatacgnggttcaccgctctatataatggctgcacngcccctgacaggctgagtggatggggacatcgaaacccgggngtggaaggtggngacgagacgacgacgaggtacgttcgaggacgagcgtcacagacgacagacgacgcgacgacgacgcgtacgtgtactagtagngagagtaggacgtcgacgtagacgtaacgtacgacgaccgacggtacgttattaacgttgttagtaaggacgtaagaacgtacggaaggtaacggttaacgtaacg

SEQ ID NO: 405118 - DNA, 618 bp, Homo sapiens
  misc_feature: GZ8MTXP01AQ028.10.26.C04.1.454.CMB.2.raw
  modified_base (252)..(252): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagagtccgtggggcctnagtgaagatttcctgcaaggcgtccggatacgagtcaccgcgtctatattaatggctgcgacacggcccctggacaaggcctggagtggagtggggacaacgtcgaacccgaggtggaaggtcgggtgccgaagacggtaccgcccgaggtacgggtttacgagggcaggacggtctcccgagtacggaccgtagtcgacgacggtcccgacgacggccacgttgtactagtagtggagtagtggagggacgtccgtagaggaacgttcggaacggtaaccgacgggtaccgtaattaacgttacgttcgggtaaggtacggaaggtaaaaggtccggttaaaacgggtaagggttcggtaaaccg

SEQ ID NO: 405119 - DNA, 614 bp, Homo sapiens
  misc_feature: GZ8MTXP01EXBJ6.10.26.C04.1.454.CMB.2.raw
  modified_base (241)..(241): a, c, t, g, unknown or other
  modified_base (255)..(255): a, c, t, g, unknown or other
  modified_base (317)..(317): a, c, t, g, unknown or other
  modified_base (391)..(391): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcaggtcgtggggctggagatagaagngtccgtggggcctnagtgaagtattcctgcgaaggcgtccggatacgaggtccaccgtcgtctattattaagtcgntgcgacgacggcccctggacagggcctggagtggacgtggggacaacgtcgaacccgaggtcggaagggtgggngtacgaggacgtaccgaccgtaggtacgggtttacgagggactaaggacgtacgtacagtacgaccgtaaggtccgaacgaccggtccggacgacgacgtaacgttcgtacctagtagtaggtagtagtacggaaggacgtccgaggtagaacgttacgacgtacggacgtaccgtattacgttcgttgtgagaagaagtacggaagtaacggttcggaaccg

SEQ ID NO: 405120 - DNA, 587 bp, Homo sapiens
  misc_feature: GZ8MTXP01ANKB4.10.26.C04.1.454.CMB.2.raw
  modified_base (236)..(236): a, c, t, g, unknown or other
  modified_base (249)..(249): a, c, t, g, unknown or other
  modified_base (257)..(257): a, c, t, g, unknown or other
  modified_base (547)..(547): a, c, t, g, unknown or other
tcagcatagtagtgcacgaccggtgctcgatttagtctagcgactttgggtttgggggaaaaggaagactgacggtcccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagngtccgtgggcctnagtgaagntttcctgcaaggcgcgatacagtcacgcgtctatattaatggctgcgacacggcccctggacgaagggcctgacgtgggagtaggggaacagtacgaacccggaggtggaagggtggtgacgaggacgtaccgcccgagggtacggtttcgagggtcaggacgtcctaccgagtacgaccgagtcgaaccgtccgacccgcgacgccgtacgtcgttactaagtagtggaagagtggagacgcgcggtacgaagttacggacgacgaccgggtccgtaagttacgttcgngtaacgacggaagtaacgacggaagtaagggttgtaaccg

SEQ ID NO: 405121 - DNA, 599 bp, Homo sapiens
  misc_feature: GZ8MTXP01BFB87.10.26.C04.1.454.CMB.2.raw
  modified_base (238)..(238): a, c, t, g, unknown or other
  modified_base (252)..(252): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagngtccgtggggcctnagtgaagatttcctgcaaggcgtccggatacaggttcaccgtccgtctatattaatggctgcgacacggcccctggacaaggcctgagtggagtggggacagtacaacccggaggtcggaagggtggtgcgaggacgaccgcccgtagggtacggtttacgagggacaggacgtctacgatacggaccgtagtcgaccaccgtccgacggacgcacgttgttacctagttagtagggagtagtaggaggtagccgtggacgtaacgttcggaccgacggaccggtaccgtaagttacgttacgttggaaggacgaagaacgtacgggaaagtaacgggttggaaccg

SEQ ID NO: 405122 - DNA, 605 bp, Homo sapiens
  misc_feature: GZ8MTXP01C098C.10.26.C04.1.454.CMB.2.raw
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagagtccgtggggcctcagtgaagtatttcctgcgaaggcgtccggatacgaggttccaccgtcgtctattattaagtggctgcgacgacggcccctggacaagggcctggagtggagtggggaacactacgaaccggaggtgggtaagggtggtgacgaggacgtaccggccgaggtacgggttcgagggctaaggacgtcctaccgagtacggaaccctaggtacgaacccgtccgtaccgacgacgcctaacgtggtactagtagtggaagtgtaggacggtacgcgtagagtaacttacggacgtacgccgggtactagttaacgttcgttagtgacgaagagtacggaaggtaaggttcgtaacg

SEQ ID NO: 405123 - DNA, 660 bp, Homo sapiens
  misc_feature: GZ8MTXP01EON6J.10.26.C04.1.454.CMB.2.raw
  modified_base (257)..(257): a, c, t, g, unknown or other
  modified_base (276)..(276): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcacctcccaggtgcagcgtggtgcaggtcgtggggctgagatagaagcgtccgtggggcctanaggtagaagtactttccgngacgaacggcgtaccgatacgtacggttcccaccggtccttactaattattaagtggctggcaacgcggccccgtaggaccgaagggtcctaggagtgggagtagggggaacaacgtacgaaccggaggtcgggaagggttggcgacgaaggaccggtacgcccgtaagggtaggttcgacggcagtacgtcacgatacgacgagtacgaaccgcgtccgacgacgcgtacgttgtacgtagtagagtagagtaggacgacgtcgtacggacgtaacgtacggacccggtaacggttaccggtaaccgttaagttaacgttccggttaggttaacggacggtaaagtaacggaagggttaaacgggtaaggttaacgtaaaccg

SEQ ID NO: 405124 - DNA, 651 bp, Homo sapiens
  misc_feature: GZ8MTXP01BIXNM.10.26.C04.1.454.CMB.2.raw
  modified_base (272)..(272): a, c, t, g, unknown or other
  modified_base (300)..(300): a, c, t, g, unknown or other
  modified_base (357)..(357): a, c, t, g, unknown or other
tcagcatagtagtgcacgaccggtgctcgatttagtctagcgactttgggtttggggggaaaaaggaagactgacggtcccccaggagttcaggtgctgggcacggtgggcatgtgtgagtttttgtcacaagatttgggctcaactctcttgtccaccttggtcttctgcttgctggctgtagttccaggtgctcacctcccaggtgcagctggtgcagtcgtggggctgagagtagaagtagtccgtggggcctcgagtagaatatttcngcgaaggcgcgatacgagtcaccgcgtntatatatcgctgcgacgacgcccgtaggacgaggcctggagtggagcggggaacaanacgaaccgaggtcgggaagggtggtcgagaaggtacggtaccgacccgaagggtacgggtttacgaggggtcgaaggtacgtccgtacagtacggaaccgagtacgaccgtacccgtccggacgtaacgcgtacgtcggtaacttagtagtaggacggtagtacgggaagtcggtacgtagggtaacgaacgttacggaccggtaacgttaccgggtacgttaacgtttacgttcgttcggaaggaccgtaaagaacggttaaccggaaagggtaacgggttaaggtaaacccg

SEQ ID NO: 405125 - DNA, 519 bp, Homo sapiens
  misc_feature: GZ8MTXP01E4T1N.10.26.C04.1.454.CMB.2.raw
  modified_base (249)..(249): a, c, t, g, unknown or other
  modified_base (496)..(496): a, c, t, g, unknown or other
  modified_base (503)..(503): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtcctggggcctnagtgaagatttcctgcaaggcgtccggatacaggttcaccgcgtctatattaatggctgcacaggcccctggacaagggcctgagtggatggggacaatcaacccgagtggaaggtgtgacagagtacgcccagaggttcaggcagagtctccatcgaccagtgacacgtcgcgaggcaacgtgtctatagtggagagtagaggtagcctgagaacttgacgacgacggccgtaattagttcagtgngtaaganacgaagaaggttgaac

SEQ ID NO: 405126 - DNA, 611 bp, Homo sapiens
  misc_feature: GZ8MTXP01DOYOZ.10.26.C04.1.454.CMB.2.raw
  modified_base (239)..(239): a, c, t, g, unknown or other
  modified_base (251)..(251): a, c, t, g, unknown or other
  modified_base (265)..(265): a, c, t, g, unknown or other
  modified_base (292)..(292): a, c, t, g, unknown or other
  modified_base (364)..(364): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagcgtggtgcagtcgtggggctgagatgaagngtcgtgggcctnagtagaatattcgngcgaggcgcggatacgagtcacgcgtntatattatgctgcgacgacggccccgtaggacgaacggcctaggaggtggagtggggacaacgtcgaaccgnggtagggaaggtggtaacgaggaacgtaccgacccgtagggtacggttacgagggcagtacgtctacgaatcggaacgtaggtacgaccgaccggtccgacgagtccacgttgtacgttaagtagaggagagtaggaacgacgtccgtagagacgttaaggaccgacggtaccgttacgtaattacgttcgttggttacgtaacggaagtaagtaacggaaggttaacgggtgttaacgtaaaccgg

SEQ ID NO: 405127 - DNA, 621 bp, Homo sapiens
  misc_feature: GZ8MTXP01BK70Q.10.26.C04.1.454.CMB.2.raw
  modified_base (352)..(352): a, c, t, g, unknown or other
tcagcatagtagtgcacgaccggtgctcgatttagtctagcgactttgggtttggggggaaaaggaagactgacggtcccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtccgtggggcctcagtgaagatttcctgcaaggcgtcggatacaggtcaccgcgtctatatatggctgcacaggccctggacaaggcctgagtggagtggggagatcgaacccgngtcggaaggtggtgcgaggacgtacgcccgagggtaggtttcgagggtcaggacgtctcccgagttcgaacccgtaggtacgaccgtacgggtcccgacggacgcgtaccgttgttaccgtagttagtgggaagaggtacgggaaggccgtaccgtaggtaacggtaacgtttacgggaaccggtaccgaaccgggtacgttaacgttacgtttccgttggtaagaccggtaaggaaccgttacgggaaggtaagggttaacggtaacg

SEQ ID NO: 405128 - DNA, 805 bp, Homo sapiens
  misc_feature: GZ8MTXP01B6L0D.10.26.C04.1.454.CMB.2.raw
  modified_base (308)..(308): a, c, t, g, unknown or other
  modified_base (453)..(453): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgtagttttgtcacaagatttgggctcaactctcttgtccaccttggtcttctgcttgcctggctgtacgttccgagtcgctccacctcccgaggtcgcgagtcgtggtcgactaggtcggtggggtactaggaagtagtaggaacggtacgtccgggtcgggtaccctagtaggtagtaagtacgtttcgnggacgaacggtccgtaccgaagtaccgtacggtacccgaccgtcgtactaattaagttacgtggctgaccgacgaccggcccgtaggaacgtacgggtcgtagacgggagtagggtacgggaaaccgtaacgtaccgtaacgggnggtacggggtaagggtcggtcggaacgtaagggtaccggtaccggaccggtaagggttacgggttacgacggtcgaaagtcgtaccgtacgtacggtaaccgtacggacgtaccgaccgtaccggtaccggacgtacgtacggtacgttcggtacgtaagggtaagtagggaaggttaccggtaagggtaccgtaaccgggtaccggtaagggtaacgtaaccggttaaccgggaacccgtaacccgggttaacggtttaaacgtaacggtttaccgttagggttccggttaagaaacccggttaaggaaaccgggtaacgggttaaaggtaacccggttaagggtaaaccg

SEQ ID NO: 405129 - DNA, 900 bp, Homo sapiens
  misc_feature: GZ8MTXP01CPOA2.10.26.C04.1.454.CMB.2.raw
  modified_base (214)..(214): a, c, t, g, unknown or other
  modified_base (238)..(238): a, c, t, g, unknown or other
  modified_base (271)..(271): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggngcagtcgtgggctgagatagaagngtccgtggggtcctgagtagaagtactttccgngacgaacggcgtaccggatacgtacggtccaccgtccgttactaattaatttaagttggcgtgaccgaacgacggcccccgtaggaaccgtaagggtccgtagggaacggtagggtagggtacgggggtaaaccgtaaaccggttaaccgaaacccggggtagggtagggggtaaaggggtttacgggaacgggaccgtaaacggggtaacccggggtaaccccgtaccccgggtaaagggttacgggtttacccgggaaaggggtccgtaaagggtaccgttcccgtaaccccgaaggttcgaaaccccggttagtaccggaaccgttacccgggtaccggaccggtaacgggaccttaaaccggttaggttaaaccgttaaggttaagggttaccgggggaaagtaggggttaaacggggaaaaccggggtccgttacccgggttaagggaaacgggtttaaaccgggtttaaacccgggaaacccgggttaaacccggggaaccgggtttaaacccgttaagtttaacccgtttaaccggttggggttaaaccggaacggttaaaaccggtaaagggtttaaacccggggaaaagggttaaacgggggttcccgggtttaaaaccg

SEQ ID NO: 405130 - DNA, 660 bp, Homo sapiens
  misc_feature: GZ8MTXP01A41TO.10.26.C04.1.454.CMB.2.raw
  modified_base (216)..(216): a, c, t, g, unknown or other
  modified_base (267)..(267): a, c, t, g, unknown or other
  modified_base (403)..(403): a, c, t, g, unknown or other
  modified_base (644)..(644): a, c, t, g, unknown or other
tcagcatagtagtgcacgaccggtgctcgatttagtctagcgactttggggtttgggggaaaaaggaagactgacggtcccccaggagttcaggtgctgggcacggtgggcatgtgtgagttttgtcacaagatttgggctcaactctcttgtccaccttggtcttctgcttgctggctgtagttccaggtgctcacctcccaggtgcagctggtncaggtcgtggggctgagatggaagtgtccgtgggcctagagtagtaaagtntttccgagaccgtaaggccgtccgaataccgtaggttccaccggtccgtataactatttagtcggctgcgacgacggcccctaggaacgaacggcctaggacgtggagtagggggaactaacgtaccgaaaccggnggtaggggtaaagtggtaacgacgtaacgggtacgtacccgaccgtagggtacgggtttacggacgggtactaggtacgttacgccgaagttacgaaccgtagtacgacgaaccgtccggacgacggtacctaacgtcggtacctagttacgtggaacgagttacggaaggtactaccgttagacgtaacgttacggaccgacggttcgtacgtattacgttgttgtaacaggaagtacgngaagtcggttgaaccg

SEQ ID NO: 405131 - DNA, 517 bp, Homo sapiens
  misc_feature: GZ8MTXP02JYTZJ.10.26.C04.1.454.CMB.2.raw
  modified_base (346)..(346): a, c, t, g, unknown or other
  modified_base (356)..(356): a, c, t, g, unknown or other
  modified_base (394)..(394): a, c, t, g, unknown or other
tcagcatagtagtgcacgaccggtgctcgatttagtctagcgactttgggtttgggggaaaaggaagactgacggtcccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaatggctgcgacaggcccctggacaagggcctgagtggatgggganaatcaaccgngtggaggtggtgcagagtacgccagaggttcaggcagngtctcatgaccagtgacacgtccgcgagcactgtctatatggagatggaggagccgtgacgtacttggacgacgaccggaccgtatacgttactgtgcgagacgtacggaagaaggtacggac

SEQ ID NO: 405132 - DNA, 527 bp, Homo sapiens
  misc_feature: GZ8MTXP02IT56L.10.26.C04.1.454.CMB.2.raw
  modified_base (249)..(249): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtccgtgggcctnagtgaagattcctgcaaggcgtccggatacagttcaccgccgtctatattaatggctgcgacacggcccctggacaagggcctgagtggagtggggagaatcgaaccgagtggaggtggtgcagagtacgccagaggttcgagggcagagtctccatgaccagtgacacgtccgacgacgcacgtgtctagtagtggagagtggaggacgccgtgagtacgtgacgacgacggacgtactattacgtgtgacgagaactacgaaggaacggtagaacg

SEQ ID NO: 405133 - DNA, 531 bp, Homo sapiens
  misc_feature: GZ8MTXP02HI5TJ.10.26.C04.1.454.CMB.2.raw
  modified_base (248)..(248): a, c, t, g, unknown or other
  modified_base (345)..(345): a, c, t, g, unknown or other
tcagcatagtagtgcacgaccggtgctcgatttagtctagcgactttgggtttgggggaaaaggaagactgacggtcccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtcctggggcctnagtgaagatttcctgcaaggcgtccggatacaggttcaccgccgtctatattaatggctgcgacaggcccctggacagggcctgagtggatgggganatcaaccgagtggaggtggtgcagagtaccgcccgaaggtaggtttcgagggcgagacgtcgtccagtacgaccagtcgacgacgtccgcgagcactgtctagtatggagagtggaggagccgtgagacgtggaccgacgacggaccgtatacgttacgtgtgacgagatacgaagaaggtggacg

SEQ ID NO: 405134 - DNA, 589 bp, Homo sapiens
  misc_feature: GZ8MTXP02GZD67.10.26.C04.1.454.CMB.2.raw
  modified_base (237)..(237): a, c, t, g, unknown or other
  modified_base (314)..(314): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagngtccgtgggcctgagtgaagtatttcctgcgaaggcgtcggatacgtaggtcaccgcgtctatattatgctgcgacncggccctaggacgaggcctgagtggagtggggagataccgaaccgagtgggaggtggtgcgaggagtaccgcccgaaggtacggttacgagggcaggtacgtcgtccaagtcgaccgagtacgacgaccgtccgacgacggacacgttgtactagtagtaggaagtagtaggaaggaggaccgtagaacggtacgttacggaacggaccgtaccggtaccgttattacgttacgtgtaagacgaaagtagtacggaaacggtaggtacggaaccg

SEQ ID NO: 405135 - DNA, 599 bp, Homo sapiens
  misc_feature: GZ8MTXP02GEHVW.10.26.C04.1.454.CMB.2.raw
  modified_base (349)..(349): a, c, t, g, unknown or other
tcagcatagtagtgcacgaccggtgctcgatttagtctagcgactttgggtttgggggaaaaggaagactgacggtccccccaggagttcaggtgcttgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtccgtggggcctcagtgaagatttcctgcaaggcgtccggatacaggttcaccgccgtctatattaatggctgcgacaggcccctggacaagggcctgagtggatgggganaatcgaaccgagtggagtggtgcagagtacgcccagaggttcgagggcagagtctccatcgaccagtcgacgacgtccgacgacgacactgtactaagtagtaggagagtaggaaggacgaccgttggaacgtaacgtttacggaaaccggaaccgtaaaccgggtacccgttaagttaacgtttaaccgtaggttaagtaccggaaaggtaaacgttacggaaaacggtaaaggggtacggttaaaccg

SEQ ID NO: 405136 - DNA, 525 bp, Homo sapiens
  misc_feature: GZ8MTXP02JP9BO.10.26.C04.1.454.CMB.2.raw
  modified_base (262)..(262): a, c, t, g, unknown or other
  modified_base (291)..(291): a, c, t, g, unknown or other
  modified_base (343)..(343): a, c, t, g, unknown or other
  modified_base (364)..(364): a, c, t, g, unknown or other
  modified_base (520)..(520): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtcctggggcctcagtgaagattccngcaaggcgtccggatacaggtcacgcgtntatattatggctgcgacaggcccctggacaagggcctgagtggagtgggganaatcaaccgagtggaggtggngcagagtacgccagaggttcaggcagagtctccatgaccagtcgacacgtccgcgagtcacgtgtctatatggagagtgaggagcctagagtactgacgacgaccggtaccgtataacttactaggtcgacgaaggaactacgaaaggtaaacggnggaac

SEQ ID NO: 405137 - DNA, 536 bp, Homo sapiens
  misc_feature: GZ8MTXP02JF2EG.10.26.C04.1.454.CMB.2.raw
  modified_base (346)..(346): a, c, t, g, unknown or other
  modified_base (406)..(406): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtcctggggcctcagtgaagattcctgcaaggcgtccggatacaggttcaccgccgtctatattaatggctgcgacaggcccctggacaagggcctgagtggatgggganaatcaacccgagtggaggtgtgcagagtacgcccaggtacggttcaggggtcaggagtcnccatgaccagtgacacgtccgcgagcactgtactatatgggagagtagaggacgccgtagagacgttgacgtaccgacggaccgtataacgttctagtgacgaacgagtacgaaaggaaggtacggaacc

SEQ ID NO: 405138 - DNA, 563 bp, Homo sapiens
  misc_feature: GZ8MTXP02JWP19.10.26.C04.1.454.CMB.2.raw
  modified_base (314)..(314): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtccgtggggcctcagtgaagatttcctgcaaggcgtccggatacaggttcaccgccgtctatattatggctgcgacnggcccctggacagggcctgagtggagtggggacaagtcgaacccgaggtggaggtggtgcgaggacgtaccgcccgaggtagggtttcgagggcagagtctccatgaccagtcgacacgtccgacgagcactgtctatagtggagagtggaggagccgtagagtacgttagaccggacgaccggtaccgtagttacttacgtaggtcgtacggaaggaacgtacggaaacggtaaggggtacgtaaccg

SEQ ID NO: 405139 - DNA, 580 bp, Homo sapiens
  misc_feature: GZ8MTXP02HDV3A.10.26.C04.1.454.CMB.2.raw
  modified_base (237)..(237): a, c, t, g, unknown or other
  modified_base (263)..(263): a, c, t, g, unknown or other
  modified_base (312)..(312): a, c, t, g, unknown or other
  modified_base (367)..(367): a, c, t, g, unknown or other
  modified_base (371)..(371): a, c, t, g, unknown or other
  modified_base (455)..(455): a, c, t, g, unknown or other
  modified_base (459)..(459): a, c, t, g, unknown or other
  modified_base (469)..(469): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagngtccgtgggcctgagtgaagattccngcaaggcgtccgatacgagttcaccgcgtctatattaatggctgcgacncggcccctggacgaagggcctggagtggagtgggacgatcgaaccgagtggaggngtgnaggacgtacgcccaggacggtttcgagggcagagtctaccagtcgacagtacgaccacgtccgacgacgcacgttgtctatagngganaggtgaaggngtccgtagacgtacgtacgaccggtaacgacggtacccgttaagtaccgtttagtaggttcggacgtaaacggtaaagttaccggaaaggtaacggggttacgtaaaccgg

SEQ ID NO: 405140 - DNA, 585 bp, Homo sapiens
  misc_feature: GZ8MTXP02F8J4K.10.26.C04.1.454.CMB.2.raw
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtccgtggggcctgagtgaagtattcctgcgaaggcgtcggatacgaggtcaccgccgtctatattaatggctgcgacacggcccctggacgaagggcctgagtggagtggggacaacgtccgaaccggaggtcggaggtggtgcgagacgtaccgccgaggtaggttcgagggcagacgtctacgagtacgaccagtacgaccgtaccggtccgacgacgctacgtgtactaagtagtggagagtggaggacgccgtagaacgtacgttaggaccgacgaccggtaccgttagttacgttacgtggtaacgacggaagtaacggtacggaaacggtaggtacgtaacg

SEQ ID NO: 405141 - DNA, 529 bp, Homo sapiens
  misc_feature: GZ8MTXP02F08VK.10.26.C04.1.454.CMB.2.raw
  modified_base (347)..(347): a, c, t, g, unknown or other
  modified_base (361)..(361): a, c, t, g, unknown or other
  modified_base (366)..(366): a, c, t, g, unknown or other
  modified_base (395)..(395): a, c, t, g, unknown or other
  modified_base (398)..(398): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagagtccgtggggcctcagtgaagatttcctgcaaggcgtccggatacaggtcaccgcgtctatattaatggctgcgacacggcccctggacaggcctgagtggagtgggganatcgaacgagtggnggtgngcaggagtaccgccaggtggttcgagggnagngtcacatgaccagtcgacgacgtccgcgagcactgtactagtatggagagtaggagcgacgtgagacgtgacgacgacggtacgtactacgtacgtgtcgacgagaacgtacgaaacgtaggtacggaacg

SEQ ID NO: 405142 - DNA, 579 bp, Homo sapiens
  misc_feature: GZ8MTXP02GAHVM.10.26.C04.1.454.CMB.2.raw
  modified_base (409)..(409): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtccgtggggcctcagtgaagatttcctgcaaggcgtccggatacaggttcaccgcgtctatattaatggctgcgacaggcccctggacaagggcctgagtggagtggggacaatcgaaccgagtggaggtggtgcaggacgtacgcccaggaggtttcaggggcagacgtcnccagtcgaccagtgaccacgtccgacgacgcacgtgtactagtagtaggagagtggaaggacgaccgtggaacgtacgttacggaaccgacggacgggtacccgttaagttacttaccgtaggtcggacggaagtaaacgtacggaaaacggtaagggtcgggtaaaccg

SEQ ID NO: 405143 - DNA, 580 bp, Homo sapiens
  misc_feature: GZ8MTXP02IKI2A.10.26.C04.1.454.CMB.2.raw
  modified_base (238)..(238): a, c, t, g, unknown or other
  modified_base (351)..(351): a, c, t, g, unknown or other
  modified_base (410)..(410): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctggagatgaagngtccgtggggctcagtgaagtatttcctgcaaggcgtccggatacaggtcaccgccgtctatattaatggctgcgacacggccctggacgaagggcctgagtggagtgggganatacgaaccgagtggaggtggtgcagagtaccgccgagaggttcgagggcaggacgtcnccgatcgacagtacgacgaccgtccgcgaacgcacgttgtactagtagtggagagtggaggtagccgtagaacgtacgttaggaccgacgaccggggtacttaacgttacgtttaaccgtggttgaccggtaagtaaacggtacggaaacggaagggtttacggaaaccg

SEQ ID NO: 405144 - DNA, 605 bp, Homo sapiens
  misc_feature: GZ8MTXP02IOE0B.10.26.C04.1.454.CMB.2.raw
  modified_base (238)..(238): a, c, t, g, unknown or other
  modified_base (407)..(407): a, c, t, g, unknown or other
  modified_base (414)..(414): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagngtccgtggggcctgagtgaagtatttcctgacaaggcgtccggatacaggttcaccgcgtctatattatgctgcgacacggccccgtggacgaaggcctagagtggagtggggacaagtccgaaccgagaggaggtggtgcaggagtaccgccgaggtaggttcgaggnagagtcncagtcgaccagtcgacgacgccgacgacgctacgttgtacgtagtagtaggagtagtggaggacgaccgtaggtacgtaacggttacgaaccggtaaaccggtaaccggtaccgttaaacgtttaacgtttaaccgttcggttaaggacgtaaagaaaacgttacggtaaaacggaagggtacggtaaacg

SEQ ID NO: 405145 - DNA, 594 bp, Homo sapiens
  misc_feature: GZ8MTXP02JISHV.10.26.C04.1.454.CMB.2.raw
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtccgtggggcctgagtgaagatttccgtgcgaaggcgtccggatacgaggttcaccgccgtctatattaatgctgcgacacggccccgtggacgagggcctggaggtggagtggggacgaacgtaccgaacccgagtgggaggtgggtgacgaaggacgtaccgacccgtaggtacgggtttacgaggggacgagacgtctacagtcgaccgaggtcgaccgtaccgccgtacgacgcacgttcgtactagtagtaggagagtggaacggagccgtagacgtacgtacggacgaacgtacggtactacgttactacgtgtgacgtaaggtacgtacggaaaggtacggtaggtaacc

SEQ ID NO: 405146 - DNA, 585 bp, Homo sapiens
  misc_feature: GZ8MTXP02G4HRF.10.26.C04.1.454.CMB.2.raw
  modified_base (213)..(213): a, c, t, g, unknown or other
  modified_base (251)..(251): a, c, t, g, unknown or other
  modified_base (333)..(333): a, c, t, g, unknown or other
  modified_base (341)..(341): a, c, t, g, unknown or other
  modified_base (343)..(343): a, c, t, g, unknown or other
  modified_base (349)..(349): a, c, t, g, unknown or other
  modified_base (358)..(358): a, c, t, g, unknown or other
  modified_base (360)..(360): a, c, t, g, unknown or other
  modified_base (387)..(387): a, c, t, g, unknown or other
  modified_base (397)..(397): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactccaggtgcagctggtncagtcgtggggctgagatgaagtagtccgtggggcctnaggtgaagtattcctgacgaggcgtcggatacgaggtcaccgcgtctatataatgctgcgacacgccctgacgaggctgagngagtgganancgacgngtggagtgngnagagcgccagagttcaggcagacgtcncgatcgacgngtcgaaccgacgtcgacgacgtacacgttgacctagtagtaggtaagagtaggacggacggtacccgtaggaacgtaccggttacggaaaccggtaccgtaaccgggtaaccgttacgttaacgtttaccggtagttaacggaaccggtaagtaaaccgtaggtaaaacggtagggtacgttaaaccg

SEQ ID NO: 405147 - DNA, 566 bp, Homo sapiens
  misc_feature: GZ8MTXP02J1CC1.10.26.C04.1.454.CMB.2.raw
  modified_base (455)..(455): a, c, t, g, unknown or other
tcagcatagtagtgcacgaccggtgctcgatttagtctagcgactttgggtttggggggaaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtccgtggggcctcagtgaagatttcctgcaaggcgtccggatacaggttcaccgccgtctatattaattggctgcgacacggcccctggacgaaggcctgagtggagtggggagaatcaaccgagtggaggtggtgcgaagacgtaccgcccgagtagggtttcgagggtccgagtacgtcgtccgatcgacccgagtcgacgaccgtccgcgacncgactgtctatagtggagagtaggaggagtccgagacgtacgttaggacgacgtaacggccgttaatactttacgtgtcgacgtaagaacgtacggaagacggtagaaccg

SEQ ID NO: 405148 - DNA, 583 bp, Homo sapiens
  misc_feature: GZ8MTXP02FYE06.10.26.C04.1.454.CMB.2.raw
  modified_base (250)..(250): a, c, t, g, unknown or other
  modified_base (265)..(265): a, c, t, g, unknown or other
  modified_base (352)..(352): a, c, t, g, unknown or other
  modified_base (363)..(363): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtccgtgggcctnagtgaagtatttccngcaaggcgtcggatacgaggttcaccgccgtctatatttaatggctgcgacacggcccctggacgaaggcctgagtggagtgggganatccgaaccgnggtggaggtgtgcaggacgtaccgccaggtagttcgaggcagacgtctcatcgaccagtacgacgaccgtcgacgagactacgtgttactaagtagtggaagtagtagggaaggacgtaccgtaggaacgtacgttacgaaccggacgaaccggtaccgttaattaacgttcgtagtaacggacgaacgtaaagtacggaaaggtaacggtaggtaaccg

SEQ ID NO: 405149 - DNA, 579 bp, Homo sapiens
  misc_feature: GZ8MTXP02I6OHK.10.26.C04.1.454.CMB.2.raw
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtccgtggggcctcagtgaagatttcctgcaaggcgtccggatacaggtcaccgccgtctatattatggctgcgacacggcccctggacaacgggcctggagtggagtggggacgaatccgaaccgagtggaggtggtgcgaggacgtaccgccgaggtacggttcgagggcagagtctccgagtcgaccagtgacgacgtccgcgagcacgtgtactagtagtggagagtaggaggacgccgtagacgtacgttaggaaccgacggaaccgggtaccgttaacgttaacgttacgtaggtcggacggaaggtaacgtacggaaacggtaggtacggtaaac

SEQ ID NO: 405150 - DNA, 601 bp, Homo sapiens
  misc_feature: GZ8MTXP02F683W.10.26.C04.1.454.CMB.2.raw
tcagcatagtagtgcacgaccggtgctcgatttagtctagcgactttgggtttgggggaaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatagaagagtccgtggggcctcagtgaagtatttcctgacgaaggcgtcggatacgtcggttccaccgtccgtctataatttaagtggctgcgacgacggccccgtaggacgaagggcctaggaggtggaggtaggggacaagtaccgaacccggaggtcggaggtggtgacgaaggacgtaccgcccgagggtacgtttcgagggacaggtacgtctacgatcgaccagtcgacgaccgtccgcgacgcactagtactaagtagtaggagtagtcggaaggcgacgtagacgtacgtacggaccgacgaccggtacgttatacgttacgtggtaagacggaagtaacgtaggaaggacggtacgaaacg

SEQ ID NO: 405151 - DNA, 518 bp, Homo sapiens
  misc_feature: GZ8MTXP02FGVZE.10.26.C04.1.454.CMB.2.raw
  modified_base (296)..(296): a, c, t, g, unknown or other
  modified_base (352)..(352): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctgggggctgagatgaagagtcctggggcctcagtgaagatttcctgcaaggacgtccggatacaggtcaccgccgtntatattaattggctgcgacaggccccctggacaagggcctggagtggagtgggganatcaaccgagtggaggtggtgcagagtacgcccagaggtttcgagggcagagtctcatgaccagtgacacgtccgcgagcactgtctatagtggagagtggaggagccgtgagacttgacgacgacggccgtatactactgtgcgagacgtacgaaggaagtggac

SEQ ID NO: 405152 - DNA, 598 bp, Homo sapiens
  misc_feature: GZ8MTXP02I895D.10.26.C04.1.454.CMB.2.raw
  modified_base (214)..(214): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtncagtcgtggggctgagatgaagacgtccgtgggcctgagtgaagtattcctgcgaaggcgtaccggatacgaggttccaccgccgtctatattaatggctgcgacacggcccctaggacgaggcctagagtggagtgggacactcgaaccgagtggaggtggtgcgagacgtaccgccgaggtacgttcgaggcagacgtccactagtacgaccgagtacgaccgaccgtcgacgtacgactacgtagtactagttacgaggagtagaggagtacgaccgtagaacgtacgttacggaaaccggacgtaaccggtaccttaagttaacgttacgtacggtaagacgtaagtaacgtaacggaaaaggtacggtacggtaaaccg

SEQ ID NO: 405153 - DNA, 588 bp, Homo sapiens
  misc_feature: GZ8MTXP02HMGHI.10.26.C04.1.454.CMB.2.raw
  modified_base (271)..(271): a, c, t, g, unknown or other
  modified_base (301)..(301): a, c, t, g, unknown or other
  modified_base (486)..(486): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtgggggctggagatgaagagtccgtgggggcctcgagtgaagtatttccngcaaggcgtccggatacaggtcaccgcgtntatataatgctgcgacacggcccctggacaagggcctgagtggagtggggacaagtccaaccggaggtggaggtggtgcgaaggacgtaccgccctaggacggtttcgagggacaggagtcctacatcgaaccgagtacgacgaccggtccgacggagaccacgttgtactagtagtggaagtanaggaggcgaccgtaggaacgtacgttacggaccgaacgtaccgggtaccgttacgtaattaacgtgtaacgacgaagaacgtaggaaggtaaggtacgaacg

SEQ ID NO: 405154 - DNA, 579 bp, Homo sapiens
  misc_feature: GZ8MTXP02FQIAJ.10.26.C04.1.454.CMB.2.raw
  modified_base (251)..(251): a, c, t, g, unknown or other
  modified_base (318)..(318): a, c, t, g, unknown or other
  modified_base (365)..(365): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagagtccgtggggcctnagtgaagatttcctgcaaggcgtccggatacgaggttcaccgccgtctatatttaatggctgcgacncggcccctggacgaaggcctggagtggagtggggacaatccaaccgngtggaggtggtgcaggagtaccgcccgaggacggttcgagggcgagagtctacagtcgaccagtacgacgacgtccgcgacgcacgtgtactagtacgtaggagagtggaaggacgaccgtggaacgtacgttcggaaccgtacgaaccggtaccgttaattacgttaacgtgtaacgcggaagaaacgtaggaaaggtacggtcggtaaaccg

SEQ ID NO: 405155 - DNA, 575 bp, Homo sapiens
  misc_feature: GZ8MTXP02GEMN1.10.26.C04.1.454.CMB.2.raw
  modified_base (250)..(250): a, c, t, g, unknown or other
  modified_base (314)..(314): a, c, t, g, unknown or other
  modified_base (320)..(320): a, c, t, g, unknown or other
  modified_base (342)..(342): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagagtccgtgggcctnagtgaagtatttcctgcaaggcgtccggatacgagttccaccgcgtctatattatgctgcgacncgcccnggacaggctgagtgagtggganacgtacgaaccgaggtggaggtggtgcgaggagtaccgccgaaggtaggttcgaggcagacgtcacgaacgtgaccgtagtacgacgaccgtccgacgacgccgacgtgtacctaagtagtacggaagagtgaagggcgtacgtagacgtacgttacggacgaccgacggtacgttacgtacgttacgtgtaacggactaacggaacgtacggaaagtacggtacgtaaaccg

SEQ ID NO: 405156 - DNA, 655 bp, Homo sapiens
  misc_feature: GZ8MTXP02I6P5R.10.26.C04.1.454.CMB.2.raw
  modified_base (297)..(297): a, c, t, g, unknown or other
  modified_base (367)..(367): a, c, t, g, unknown or other
  modified_base (378)..(378): a, c, t, g, unknown or other
  modified_base (384)..(384): a, c, t, g, unknown or other
  modified_base (390)..(390): a, c, t, g, unknown or other
  modified_base (425)..(425): a, c, t, g, unknown or other
  modified_base (610)..(610): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgtagttttgtcacaagatttgggctcaactctcttgtccaccttggtcttctgcttgctggctgtagttccaggtgctcacctcccgaggtgcagctggtgcgaggtcggtgggggctaggaagtagtaggaaaggtacggttccggtcggggcctcgaaggttagaagttactttccgnggacgaacggccggtaccgactacgacggtccaccgtccgtatattattagtggctgcgacgcggcccgnggacgaggccnggtagnggaggngggaacaacgtaccgaacggaggtggaggtggcgngacggtacgtaccgaccgtaggtacggttcgaagggacaggtacgtcctacgtagacgacgaacgtacgaccgtaccgtcgacgtcgaccgtacgtcgtactaaaggtgtagggagaggtaggaacggtcgacgtaggtaacgtacgtacggaccgtacgtaaccggtacttaagtacgttacgnggtaacgacggtaagaaacgtaggaaaaggtacgggtataaaccg

SEQ ID NO: 405157 - DNA, 603 bp, Homo sapiens
  misc_feature: GZ8MTXP02JBX8N.10.26.C04.1.454.CMB.2.raw
  modified_base (266)..(266): a, c, t, g, unknown or other
  modified_base (318)..(318): a, c, t, g, unknown or other
  modified_base (350)..(350): a, c, t, g, unknown or other
  modified_base (352)..(352): a, c, t, g, unknown or other
  modified_base (359)..(359): a, c, t, g, unknown or other
  modified_base (369)..(369): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtacaccttggtcttctgcttgctggctgtagttccaggtgctcactcccaggtgcagctggtgcagtcgtggggctggagatgaagagtccgtgggcctgagtgaagatttccngacgaaggcgtccgatacaggttcaccgccgtctatattaatggctgcgacncggccctggacgaggcctgagtggagtggganancgaccgngtggaggtgngcaggacgtaccgccgaaggtacgggttcgacggggcaggacgtctacccgagttacgaccgtaggtacgaccgaccggtcgacgacgccgtacgttgtaccttaagtacgtaggagagtagggaggacgaccgtaggaacgtacgttacgacgaccggaacggtaccgttacgtaacgttcgttaggaaccgtaggaaacgtaacgtacggaaaaggtacggtacggtaaacg

SEQ ID NO: 405158 - DNA, 540 bp, Homo sapiens
  misc_feature: GZ8MTXP02IMK9N.10.26.C04.1.454.CMB.2.raw
  modified_base (220)..(220): a, c, t, g, unknown or other
  modified_base (247)..(247): a, c, t, g, unknown or other
  modified_base (261)..(261): a, c, t, g, unknown or other
  modified_base (338)..(338): a, c, t, g, unknown or other
  modified_base (348)..(348): a, c, t, g, unknown or other
  modified_base (438)..(438): a, c, t, g, unknown or other
  modified_base (452)..(452): a, c, t, g, unknown or other
  modified_base (494)..(494): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcnggggctgagatgagagtcctgggcctnagtgaagatttccngcaaggcgtccggatacaggttcaccgcgtctatattaatgctgcgacaggccctggacaggcctgagtgatggganaatcaaccgngtggaggtgtgcagacgtacgcccgagaggtttcgagggcagtagctccgatcgaccgagtcgaacgacgtccgagacgcacgtgtctanagtggagatgaggnccgagagacgtagacgacgtacggaccgttataacgttacgnggtaagacgaagtaacgttacggaaaacggtagggtacggaaaccg

SEQ ID NO: 405159 - DNA, 647 bp, Homo sapiens
  misc_feature: GZ8MTXP02HZK0G.10.26.C04.1.454.CMB.2.raw
  modified_base (315)..(315): a, c, t, g, unknown or other
  modified_base (322)..(322): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatgaagagtccgtgggcctcagtgaagtattcctgcaaggcgtccggatacgagtccaccgccgtctatataatggctgcgacnggccccnggacaaggcctagagtggagtggggacaagtccgaaccgaggtcggaggttggtggcaaggtacgtacccgacccgtaaggtacggtttacggacggggtacgaaggacgtacgtaccgaagtacgaaccgtacggtacgaccgaccgtacccgacgacggaccacgttagtccgtagtagtaggagagtaggaggagaccgtagacgtaacgttacggaaccgaaccgaccgggtaccgttaagtaacgttaacgttaggtaacgtacggtaaaggaaaacggttaaaccggtaaaaaagggttacggtaaaccgttaaaaccg

SEQ ID NO: 405160 - DNA, 636 bp, Homo sapiens
  misc_feature: GZ8MTXP02FTPIY.10.26.C04.1.454.CMB.2.raw
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtcgtggggctgagatagaagacgtccgtggggcctcgagtgaagatttcctgcgaagcgtacgatacgaggttcaccgcgtctatattaagttggctgcgacgacggcccctaggacgaacgggctaggaggtggaggtggggaacaacgtaccgaaaccgagggtacggtagggtggtcggacgaggaagtacccgaccgtaagggtacggttcggagggtaccaggtacgtctaccgagtacgactaggtacgacaccggtcggacgagacctacgtcgttactaagtagtaggagagtggaggcgtacctagggactaacggttagacggtaccgtacgggtaccgtttagtaacgttcgttaggaacgtcggaaacgtaacggttaacgggaaaggtaccggttaggtaaaccg

SEQ ID NO: 405161 - DNA, 677 bp, Homo sapiens
  misc_feature: GZ8MTXP02H13IU.10.26.C04.1.454.CMB.2.raw
  modified_base (228)..(228): a, c, t, g, unknown or other
tcagcatagtagtgcacgaccggtgctcgatttagtctagcgactttgggtttgggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccgaggtgcagcgtggtgcagtcgtggggntgagatagagagtccgtgggctacgagtagaagtacttctgacgaggccgtcggatacgtacggtcaccgtccgtactattattaagtcggctggacgacgccggtccccgtaggacgaacgggtcctaggacgtgggaggtggggaacgaactaccggaacggagggtggagggtgggtcgacgaagtacggtaccgacccgtaaggggtcggtttcggacgggtacgaaggtcgtacctacgagtacgaccgacgtacgacccgtacgacccggcggaacgccgtaacgttcgtacgttaagtaggtaggtaaagagtagggaacggacgtaccgtacgtaacggtcgttaaacggaccggtaccgtaccggtacgttactaacgttacgtacggtaacggaacggaaaggaacgttaagggaaacggtaacgggtacgaaaaccgg

SEQ ID NO: 405162 - DNA, 604 bp, Homo sapiens
  misc_feature: GZ8MTXP02FGCKK.10.26.C04.1.454.CMB.2.raw
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagagtcctggggcctcagtgaagatttcctgcaaggcgtccggatacaggttcaccgccgtctatattaatgctgcgacaggcccctaggacaagggcctggagtggagtggggacgaactccgaaacccgagtggaggtggtgacgaggagtaccgcccaggtacgggttcgaagggcaggagtctccagtcgaccgagtacgaccacgtccgacgacgcactgtctaagtagtggaagagtaggaacggacgtaccgtagaacgtacgttacggaacggtaaccgaaccgggtaccgttaacgttaacttaccgtagttaacggacggtaaacgaaagtaaccggtaaaaaggtcgggactaaaaccg

SEQ ID NO: 405163 - DNA, 596 bp, Homo sapiens
  misc_feature: GZ8MTXP02FWERA.10.26.C04.1.454.CMB.2.raw
  modified_base (237)..(237): a, c, t, g, unknown or other
  modified_base (250)..(250): a, c, t, g, unknown or other
  modified_base (352)..(352): a, c, t, g, unknown or other
  modified_base (361)..(361): a, c, t, g, unknown or other
  modified_base (401)..(401): a, c, t, g, unknown or other
tcagcatagtagtgcacgaccggtgctcgatttagtctagcgactttgggtttggggggaaaaggaagactgacggtccccccaggagttcaggtgctgggcacggtgggcatgtgtgagttttgtcacaagatttgggctcaactctcttgtccaccttggtcttctgcttgctggctgtagttccaggtgctcactcccaggtgcagctggtgcagtctggggctgagatgaagngtccgtgggcctnagtgaagatttcctgcaaggcgtaccggatacgaggtcaccgccgtctatattaatggctgcgacacggcccctggacaagggcctagagtggagtgggganatcaaccgngtggaggtgtgcagagtaccgccagtaggttcagggcagngtactaccagtacgacagtacgacgaccgtcgacgtacgctacgtgtcttaagtagtaggagagtaggaagggacgccgtaggaacgtacgttacgggaaaccgtaccggaaccgggtaccggttaattaacgtttaccgtaggttaacggacggtaaagtaaacgtacggaaaacgggtagggtacgtaaaccg

SEQ ID NO: 405164 - DNA, 566 bp, Homo sapiens
  misc_feature: GZ8MTXP01DY7LZ.45.66.F11.1.454.CMB.2.raw
  modified_base (285)..(285): a, c, t, g, unknown or other
tcagacgcgatcgacacgaccggtgctcgatttagtcacgcgagaagggggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaacgcccccaaatcatgatttangaggcagtaagcggccctgagggtttctaatcgcttctctggctccaagtctaggcaacacggccctccctgacaatctctgggctcagctgaggacgaggctgaattattactgctgctacattagtgctaaggtagttagttacgtttgggtgttcgggacggtagggaacctaagtccgtaacggtaaccgttccgtaagggttccaacggtaccccgaagggttccttaccgcccccgtggtcctaccgtccttccgttcccccgaacccgttcccg

SEQ ID NO: 405165 - DNA, 541 bp, Homo sapiens
  misc_feature: GZ8MTXP01ENM1V.45.66.F11.1.454.CMB.2.raw
  modified_base (249)..(249): a, c, t, g, unknown or other
  modified_base (301)..(301): a, c, t, g, unknown or other
  modified_base (414)..(414): a, c, t, g, unknown or other
  modified_base (442)..(442): a, c, t, g, unknown or other
  modified_base (493)..(493): a, c, t, g, unknown or other
  modified_base (525)..(525): a, c, t, g, unknown or other
tcagacgcgatcgacacgaccggtgctcgatttagtcacgcgagaagggggcagcgctctcgggacgtctccaccatggcctgggctctggtgctcctcactctcctcactcaggacacagggtcctgggcccagtctgccctgactcagcctgcctccgtgtctgggtctcctggacagtcgatcaccatctcctgcactggagccggcactgacgttgggattttgaccttgtctctggtaccaacngcacccaggcaaacgcccccaaactcatgattatgaggcagtaaagcgcctntaggggtttctaatcgtcttctctggctcaagtctcggcaacgacgccctccctaagacaatctcgtgggctcgaggctggagcgagctgattatactgctgcttcatatcgngaggttagtagttacgtttgtgttcggnggtaacggaccgtaagctcggtaccgtcgtaggttcacgaccgaaggtccncgttccccttcgggtcaccgtcttcgtccccnccctccgttaactccg

SEQ ID NO: 405166 - DNA, 543 bp, Homo sapiens
  misc_feature: GZ8MTXP01AD2E8.45.66.F11.1.454.CMB.2.raw
  modified_base (250)..(250): a, c, t, g, unknown or other
  modified_base (286)..(286): a, c, t, g, unknown or other
  modified_base (526)..(526): a, c, t, g, unknown or other
tcagacgcgatcgacacgaccggtgctcgatttagtcacgcgagaagggggcagcgctctcgggacgtctccaccatggcctgggctctggtgctcctcactctcctcactcaggacacagggtcctgggcccagtctgccctgactcagcctgcctccgtgtctgggtctcctggacagtcgatcaccatctcctgcactggagccggcactgacgttgggagttttgaccttgtctcttggtaccaanagcaacacccaggcaaagccccaaactctgatttangagtcactaagcgcctcaggggtctctaatcgcttctctgcctccaagtcccgggcaacacggcccttccgtgacggtctctgggactccaggctgacggcgaggctgattattactgctgctcatatgcagggggaccagcacgttgggtgttcgggcggtagggacctgggttcgaccgtcgtaaggtcacggcccaagggcctcgcccccgttcggcctaacctctccgttcccccncccttcctcgttcgtcg

SEQ ID NO: 405167 - DNA, 570 bp, Homo sapiens
  misc_feature: GZ8MTXP01D57QJ.45.66.F11.1.454.CMB.2.raw
  modified_base (299)..(299): a, c, t, g, unknown or other
  modified_base (403)..(403): a, c, t, g, unknown or other
tcagacgcgatcgacacgaccggtgctcgatttagtcacgcgagaaggggcacaagaggcagcgctctcgggacgtctccaccatggcctgggctctggtgctcctcactctcctcactcaggacacagggtcctgggcccagtctgccctgactcagcctgcctccgtgtctgggtctcctggacagtcgatcacatctcctgcactggagccggcactgacgttgggtattttgaccttgtctcttggtaccaacagcaacacccaggacaaaacgcccccaaactcttagatttangaggtcactaagcgccctgagggttctctaatcgcttctctcgcctcaagtcggcaaaccgacggtccttccgtgaccggtctcgtgactcagctggaggacgnggctagtatttatactgtctagtctactattaagtgtactaagttggtcgactactcgtggttcggttacggcgggacgggaacctaaggttcggaccgttcgtacggtcacggcccaacgggtcctccgccccgtcggtccttacttccgttccgtttaacccccg

SEQ ID NO: 405168 - DNA, 819 bp, Homo sapiens
  misc_feature: GZ8MTXP01CJRW9.45.66.F11.1.454.CMB.2.raw
  modified_base (324)..(324): a, c, t, g, unknown or other
tcagacgcgatcgacacgaccggtgctcgatttagtcacgcgagaaggggcacaagaggcagcgctctcgggacgtctccaccatggcctgggctctggtgctcctcactctcctcactcaggacacagggtcctgggcccagtctgccctgactcagcctgcctccgtgtctgggtctcgtggacagtcgatcaccatcctctgcacgtggacgccggctacgtgacgttggggtattttgacctttgttctcgttacggtaccaacacgacaaacacccgaaggaccaaaacccgaccccaaactccgtttagaattttaancggtaacggtacaacgtaaacggtccggcccctacggtacggggtttcctaacgtaactccggtctttcctcgtccgaccctacgtaacggtccggacgtaaaacccgtacgggtcccttcggtacgtaccgggtttcctaccggtacgggtaaccctccggacggtccgtagggaacgggtacggacgtacgtaggtttaacttaacgtttaccgcgcgttagtaccttacgtaacgtttagttacggtaaccttaaaggtttcgggtaactaacccgtttacgttacggggtttccgggttcggggtttaccgggggaacgggggttaaacccgggtaaaccggtttaaacggttcccgggttaaacccggtttcggaaaccgggttccgttaaaccggttccccgggttaaacggttccccgtaccccgggtccccccgtttggggtaacccccttccgtttccccggttaaccccgggttttccccccccg

SEQ ID NO: 405169 - DNA, 570 bp, Homo sapiens
  misc_feature: GZ8MTXP01AKMYW.45.66.F11.1.454.CMB.2.raw
  modified_base (301)..(301): a, c, t, g, unknown or other
  modified_base (414)..(414): a, c, t, g, unknown or other
tcagacgcgatcgacacgaccggtgctcgatttagtcacgcgagaaggggcacaagaggcagcgctctcgggacgtctccaccatggcctgggctctggtgctcctcactctcctcactcaggacacagggtcctgggcccagtctgccctgactcagcctgcctccgtgtctgggtctccgtggacagtcatcaccatctcctgcacgtggacgccggcactgacgttgggtattttgaccttgtctcttggtaccaacagacaacaccaggaccaaacgaccccaaactctgtatttangtagtcacgtaacgcggccctcgagggtctctatcgtcttctctccgccctacgagtccggacaaaccgacggtccttcgcgacgtcctcgtcgactccgagctggagacggngctagtacttattacgtgctgtctacattatagacctaagttgttacgactgttcgtacggttcggtcggacggagggtaactaacggttcgccgttacgtcgtcgacggccgacggccctccgtcccgtacgtccgcttccgttccgttcccccg

SEQ ID NO: 405170 - DNA, 563 bp, Homo sapiens
  misc_feature: GZ8MTXP01BYI42.45.66.F11.1.454.CMB.2.raw
  modified_base (307)..(307): a, c, t, g, unknown or other
  modified_base (397)..(397): a, c, t, g, unknown or other
  modified_base (540)..(540): a, c, t, g, unknown or other
tcagacgcgatcgacacgaccggtgctcgatttagtcacgcgagaaggggcacaagaggcagcgctctcgggacgtctccaccatggcctgggctctggtgctcctcactctcctcactcaggacacagggtcctgggcccagtctgccctgactcagcctgcctccgtgtctgggtctcctggacagtcgatcaccatcctcctgcagtggacgccgctagtggtacggttgggtatttgaccttgtctcgttggtaccaacagacaaaccaccgaacggacaaacgaccccaaactctatattangacgtcactaagccgtcctagagggtctactaatcgtctctctcgcctacgtaagtccgactaaacgaccgtccttccgtagtacgtccngtacggactcgagcgtaggaacggacgagtacgtagtattagtactgctctatctaattatacgtatagtagtgactagtgtggtcgttcgggagtagggaacctaaggttcgtaccgttcagtcgacgccgagcctcgcccncgtccttactcgttccgtccccg

SEQ ID NO: 405171 - DNA, 545 bp, Homo sapiens
  misc_feature: GZ8MTXP02JBOQC.45.66.F11.1.454.CMB.2.raw
  modified_base (244)..(244): a, c, t, g, unknown or other
  modified_base (273)..(273): a, c, t, g, unknown or other
tcagacgcgatcgacacgaccggtgctcgatttagtcacgcgagaagggggcagcgctctcgggacgtctccaccatggcctgggctctggtgctcctcactctcctcactcaggacacagggtcctgggcccagtctgccctgactcagcctgcctccgtgtctgggtctcctggacagtcgatcaccatctcctgcactggaaccagcagtgatgttggattatacttgtctctggtaccangcaccagcaaagccccaaatcatgattangaggtcagtaagcggcctcgaggggtttctaatcgtcttctctggctcaagtcctggcaaacgccggcctcccgtgacaatctcgtgggcctcgaggctagacggacgaggtctgattattactgctgctcatatgcgtaggtagtagttacttggtgttcgggcggtaggaccaagtctacgtaccgtccgtagggtccacggacccgaagggccctaccggtcccccgtggtccaccgttccgtccgtttcccccgaccctttccgtccg

SEQ ID NO: 405172 - DNA, 591 bp, Homo sapiens
  misc_feature: GZ8MTXP02HX199.45.66.F11.1.454.CMB.2.raw
  modified_base (410)..(410): a, c, t, g, unknown or other
  modified_base (441)..(441): a, c, t, g, unknown or other
tcagacgcgatcgacacgaccggtgctcgatttagtcacgcgagaagggtcacaagaggcagcgctctcgggacgtctccaccatggcctgggctctggtgctcctcactctcctcactcaggacacagggtcctgggcccagtctgccctgactcagcctgcctccgtgtctgggtctcctggacagtcgatcaccatctcctgcactggagccggcacgtggacggtttggggtagtttttcgacctttgtccttcgtttggtaacccaacagaccaaaccaccccaggaccaaaacgacccccaaactcttagtaatttatgtaggtacaacgtaagccggtcccctcgacggggtctactaatccgtcttctctccgcctaccagtcggacaaccgcgtccttccngtccgtcctcgtggacctcgagctgagacgngctgatttatactgctgctacatatgactaagttggatactacgttcgtggtacgttcgggacggacggtactaaggttcgacccgtcgtacgtcgacgacccgaaggcctccggtccccctcggtaccaccgttccgttccgtcccccg

SEQ ID NO: 405173 - DNA, 601 bp, Homo sapiens
  misc_feature: GZ8MTXP02GJV4F.45.66.F11.1.454.CMB.2.raw
  modified_base (296)..(296): a, c, t, g, unknown or other
  modified_base (371)..(371): a, c, t, g, unknown or other
tcagacgcgatcgacacgaccggtgctcgatttagtcacgcgagaaggggcacaagaggcagcgctctcgggacgtctccaccatggcctgggctctggtgctcctcactctcctcactcaggacacagggtcctgggcccagtctgccctgactcagcctgcctccgtgtctgggtctcctggacagtcgatcaccatctcctgcactggagccggcactgacgttgggagttttgaccttgtctcttggtaccaacagcaacacccaggcaaagcccccaaactcttgatttangagtcactaagcgcctcaggggtctctaatcgcttctctcgcctccaagtcggacacacggtcctcctgacgtcnctgactcagctgagacgagctgattagtactgctgctcatatgctaagttggtagtaactacgttcgtacgggttgttaccggggacgggaacggggtaccttaaaagggttcggaaacccggttccgtaaacgggtcgaaccggtacccgtaaaacggggtccgttaacccggacccccccggtttcggggtacccttacccgttcccgtttaccgggttttccccccg

SEQ ID NO: 405174 - DNA, 764 bp, Homo sapiens
  misc_feature: GZ8MTXP02GH8FC.45.66.F11.1.454.CMB.2.raw
tcagacgcgatcgacacgaccggtgctcgatttagtcacgcgagaaggggcacaagaggcagcgctctcgggacgtctccaccatggcctgggctctggtgctcctcactctcctcactcaggacacagggtcctgggcccagtctgccctgactcagcctgcctccgtgtctgggtctcctggacagtcgatcaccatctcctgcactggacgccggcactgacggttgggtatttttgacctttgtctcgtttacggtaccaacagcaaaccacccaggaccaaaacgacccccctaaaactccttagtatttagtaggtacggtacactaaacggccggtaccccttacggaggggttctaccgttaaactccgtacttccgtctccgtacccctaccgaacggttccgggacaaaccgtaccgggtccctttacccgtcgggtaaccggttcccgttcgttaccggggtaacttcccccgaagggcccttaggagggaacccggtaggtaccgtaggtaatttacgttaaaccctggtaccttcgaccgtttaccaaattagttccggacttaaaagtttcgggggtaataaccgtacgtttccgtaaggggtttcggttcggggacgggtacgggtaaacctaacgggtttacgaacccgggttacctaaacgggggttccaacggtaccccgaaacgggtcttcccgaaccccccggtttcggaacccgttacccttcgttaccggtttcccccccgg

SEQ ID NO: 405175 - DNA, 697 bp, Homo sapiens
  misc_feature: GZ8MTXP02FZWMI.45.66.F11.1.454.CMB.2.raw
  modified_base (263)..(263): a, c, t, g, unknown or other
  modified_base (302)..(302): a, c, t, g, unknown or other
tcagacgcgatcgacacgaccggtgctcgatttagtcacgcgagaaggggcacaagaggcagcgctctcgggacgtctccaccatggcctgggctctggtgctcctcactctcctcactcaggacacagggtcctgggcccagtctgccctgactcagcctgcctccgtgtctgggtctcctggacagtcgatcaccatctctgcacgtggacgccggcacgtgtacggttgggtattttgaccttgtctcttcggtaccaanagcaacaccaggacaaacgccccaaactcttagatttangtaggtacaacgtaaggcctcccgtcgacgggtctctaagtcgtacttcgtctccgcctaccgaagtccggacaacgaccggtcccttccgcgtacggtcctcgttacggacctccgaaggtcctaggaacggaacgtacgggacgttagtaacgtttacttaacgtcgtacgtagtaccctataagttaacgtagtaccgttaaaggtttcggtaacgaccgttacgttcggtttaggggttcggttaccgggacggggtaacgggtaaacccgttaaggtttaccggtaaccggttaccgtacggttaccgaaccgggacccgtaaacgggtccccggtccccgtcccccggttacggtacccttaccgttccgtttacccgtttcccccccg

SEQ ID NO: 405176 - DNA, 484 bp, Homo sapiens
  misc_feature: GZ8MTXP01C93YR.41.7.A07.1.454.CMB.2.raw
  modified_base (243)..(243): a, c, t, g, unknown or other
  modified_base (320)..(320): a, c, t, g, unknown or other
  modified_base (340)..(340): a, c, t, g, unknown or other
  modified_base (359)..(359): a, c, t, g, unknown or other
  modified_base (456)..(456): a, c, t, g, unknown or other
  modified_base (461)..(461): a, c, t, g, unknown or other
tcagtctatactatcacgaccggtgctcgatttagcacgtgtcgcaggggaccaggacttctcagttcatcttctcaccatgaggctccctgctcagctcctggggctgctaatgctctggatccctggattgagtgcggatattgtggtgacccagactccactctctctgtctgtcacccctggacagtcggcctcatctcctgcacgtctgatcggagcctcttacatactaatgggaanacttattgattggtacctacagaggccaggccagtcgccgcagctcctagtccagcaaaggttccagccgcttttcnggactgtcagacaggaatcngtgctccggctcagaaacngatttcacactgacaatcagccgcgtgagctgcggatgctgcgtttatactgcttgctaagctttagccggtaactacgtttggccaggggacccgnttggngttcaatcgaatgtggctgcaac

SEQ ID NO: 405177 - DNA, 715 bp, Homo sapiens
  misc_feature: GZ8MTXP01A1APK.41.7.A07.1.454.CMB.2.raw
  modified_base (333)..(333): a, c, t, g, unknown or other
tcagtctatactatcacgaccggtgctcgatttagcacgtgtcgcagggggaccaggacttctcagttcatcttctcaccatgagactccctgctcagctcctggggctgctaatgctctggatccctggattgagtgcggatattgtggtgacccagactccactctctctgtctgtcaccctgacagtcgctcatctcctgcacgtctgatcggagcctacttacatactaagtagggaagtacttatttgtattcggtacctacgagaggccaggccagtccgccgcagctacctagtacagactaacggttccacgtccgtcttttcgnggtactggtcaaggacaggaactcgaaggtggcccgtccgggctacgaacgaaacagttactttacaactactacgaactaactaccgaacggtcccggacggtaggggacggtcgtcgggaccgggtagttcggtcggtttacggggtttagtttttaacgtttaaccgtcgggttacgttttacggaccgttaaaacgggtttaccgttttaaaccggggtaaccccggtttaaaccggtttaacccggtttttaccggggaccccggggttaaaccggggggtaccccggtacgggttacggggttacggttaccgtaaaacggttccggtaaaaccgttcggggtaaccggttccggttaacggccccgttaaacccg

SEQ ID NO: 405178 - DNA, 564 bp, Homo sapiens
  misc_feature: GZ8MTXP01CXD8L.41.7.A07.1.454.CMB.2.raw
  modified_base (328)..(328): a, c, t, g, unknown or other
  modified_base (381)..(381): a, c, t, g, unknown or other
  modified_base (395)..(395): a, c, t, g, unknown or other
  modified_base (401)..(401): a, c, t, g, unknown or other
  modified_base (413)..(413): a, c, t, g, unknown or other
  modified_base (421)..(421): a, c, t, g, unknown or other
  modified_base (423)..(423): a, c, t, g, unknown or other
tcagtctatactatcacgaccggtgctcgatttagcacgtgtcgcagggggaccaggacttctcagttcatcttctcaccatgagactccctgctcagctcctggggctgctaatgctctggatccctggattgagtgcggatattgtggtgacccagactccactctctctgtctgtcacccctggacagtcggcctcatctcctgcacgtctgatcggagcctcttaacataactaagtgggaagtacttatttgattggtacctacagaggccaggcagtcgccgcagctcctaagtacagacaaggttccagtccgtcttttcnggtagttgtacagacgaggaattcaaggtcgccgtccgggctacgaagaaacngtatttcacactanaacaanacgacgcgcggnggacgcgngngaggtgtcgttgttagttattacgtgtgtagtacgtagtacgttacgtacggtaacgttacgttacggtaccggacgggtaccggtcggttacggttcggttacgtaacgtacgtaacgtcggtcggttcgtcgcgtaacg

SEQ ID NO: 405179 - DNA, 569 bp, Homo sapiens
  misc_feature: GZ8MTXP01DODMW.41.7.A07.1.454.CMB.2.raw
  modified_base (225)..(225): a, c, t, g, unknown or other
  modified_base (266)..(266): a, c, t, g, unknown or other
  modified_base (287)..(287): a, c, t, g, unknown or other
  modified_base (322)..(322): a, c, t, g, unknown or other
  modified_base (329)..(329): a, c, t, g, unknown or other
  modified_base (352)..(352): a, c, t, g, unknown or other
tcagtctatactatcacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctggacagtcggcctcatctcctgcacgtctgatcggatcctnttacattactaagtgggaatacttattgtattggtacctanagaggccaggccagtcgccgnagcctcctagtccagcctaaggttccagtcccgtnttttcgnggtatcgtacagacaggattcgnggtggcctccggctacgaagaaactagtactttacactactagaacaatcgacgccgcggtggaggcgtggcggtagtggtacgttggttagtttacttacgtgtcgttagtacgtaagtcgtttaacgaccggttaacttacgtttcggccgttacggggtacccggtcgttagggttcgttacgtaagtacgaacgtggtcggctcgcgtaaccg

SEQ ID NO: 405180 - DNA, 630 bp, Homo sapiens
  misc_feature: GZ8MTXP01CJ5BB.41.7.A07.1.454.CMB.2.raw
  modified_base (337)..(337): a, c, t, g, unknown or other
tcagtctatactatcacgaccggtgctcgatttagcacgtgtcgcagggggaccaggacttctcagttcatcttctcaccatgagactccctgctcagctcctggggctgctaatgctctggatccctggattgagtgcggatattgtggtgacccagactccactctctctgtctgtccacccctggacagtccgcctccatctcctgcacgtctgatcggatccttcttacatactaagtgggaatacttatttgtattggtacctagagacggccacggccagtccgccgcagcctacctagtacagacctaacggtccagtccttcgtttcgnggtacgtcgtacagacgaggaactcgaaggtcggccgtccgggctacgaaacgaaactagttactttacgaactacttacgaactaacgtaccgaacgggccggtacgggtagggaacggtcgtgggtaccggtaagttcggttcggtttggtttacgttttacttaccgtgttacgttacgactaacgttactttaacggtaccggttaacgttacggtttcgggaccgggacggggtacccggtgttacgggttagttacgtaacgtacgaacgttggcgctcgctaaccg

SEQ ID NO: 405181 - DNA, 499 bp, Homo sapiens
  misc_feature: GZ8MTXP02I3R4B.41.7.A07.1.454.CMB.2.raw
  modified_base (265)..(265): a, c, t, g, unknown or other
  modified_base (320)..(320): a, c, t, g, unknown or other
  modified_base (339)..(339): a, c, t, g, unknown or other
  modified_base (349)..(349): a, c, t, g, unknown or other
  modified_base (358)..(358): a, c, t, g, unknown or other
  modified_base (363)..(363): a, c, t, g, unknown or other
tcagtctatactatcacgaccggtgctcgatttagcacgtgtcgcaggggaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggagcctcttacatactaatgggaatacttattgtattggtacctanagaggccaggccagtcgccgcagctctagtccagcaaggttccagccgtctttcnggagtgtcagacaggatcngtgctccggntcagaaacngattnacactgacaatacagccgcgtggagcgtgcggatgctggtcgtttatacgtgtctgctagcgtttagaccgttactacgtttggccgtacgggaccggcgtcggagtacgaagtcgaacgtgtggtctcgctaccg

SEQ ID NO: 405182 - DNA, 492 bp, Homo sapiens
  misc_feature: GZ8MTXP01AJ09M.21.55.E11.1.454.CMB.2.raw
  modified_base (339)..(339): a, c, t, g, unknown or other
  modified_base (489)..(489): a, c, t, g, unknown or other
tcagtcgtcgctcgcacgaccggtgctcgatttagcactcgcacgttgggtttgggagtcagtctcagtcaggacacagcatggacatgagggtcccgctcagctcctggggctcctgctactctggctccgaggtgccagatgtgacatccagatgacccagtctccatcatccctgtctgcatctgtcggagacagaatcaccattattgccggacaagtcacgacataaacaccttttaaatggtatcagcacaaaccagggaagccccaaagctcctgatcgatgctgcatccaatttagagagtgggtcccatccccaggttcagtgcaatggntctgggacaaatttcactctcacatcagcagtctagcaactgaagtatttgactaacttactattgtacaaacagtagttacagttacttccttcactttcgccctgggacccttagtcgatactcaaacgacttgtaagctgcacatcngtc

SEQ ID NO: 405183 - DNA, 532 bp, Homo sapiens
  misc_feature: GZ8MTXP01BSU1N.21.55.E11.1.454.CMB.2.raw
  modified_base (342)..(342): a, c, t, g, unknown or other
  modified_base (396)..(396): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaatgtatcagcacaaaccaggaagccccaaagctcctgatcgatgctgcatccaatttagagagtggggtcccatccccaggttcagtggcgaatggntcgtagggactaaatttcactctacaccatcagcagtctgacaacctgaaagtntttgactaaacttactattgtacaaactagtaagttacagttacttcctttcacttttccggcccttaaggggaacccttaggttccgataactacgaaaacgcttggtaaggctgtacaccttattcgttgttcc

SEQ ID NO: 405184 - DNA, 505 bp, Homo sapiens
  misc_feature: GZ8MTXP01BRAY7.21.55.E11.1.454.CMB.2.raw
  modified_base (221)..(221): a, c, t, g, unknown or other
  modified_base (345)..(345): a, c, t, g, unknown or other
  modified_base (393)..(393): a, c, t, g, unknown or other
  modified_base (420)..(420): a, c, t, g, unknown or other
  modified_base (494)..(494): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatcccagatgacccagtctccatcatccctgtctgcatctgtcggagacagaatcaccattattgccgganaagtcacgacataaactacttttaaatggtatcagcacaaaccagggaagccccaaagctcctgatcgatgctgcatccaatttagagagtggggtcccatccccaggttcagtgcgaatgggntcgtgggactaatttcactctacaccatcagcagtctgcaactgaatntttgactaactttactatttgaccaanagtattacagttacttcctttcactttcgggccctgggaccagttcgatactcaaaacgttcttaggtgctgcncactcttgttc

SEQ ID NO: 405185 - DNA, 553 bp, Homo sapiens
  misc_feature: GZ8MTXP01DOFDE.21.55.E11.1.454.CMB.2.raw
  modified_base (337)..(337): a, c, t, g, unknown or other
  modified_base (359)..(359): a, c, t, g, unknown or other
  modified_base (374)..(374): a, c, t, g, unknown or other
  modified_base (387)..(387): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgacaagtcacgacataaactacttttaaatgtatcagcacaaacaggaagccccaaagctctgatcgatgctgcatccaaatttgagtagtgggtccatccccaggttcagtgacgaatgntctagggactaaattcacttcncaccatcagcagtcngacaactgaagtntttagactaaactttacgtatttcgtacaaacgtagtaacgttacagtttacttccctttacaccgttttccggcccttggggaacccgttaagttccgaaagttaactaaccgaaaacgttaaccgttggtggaccttcggaccaccttattccctttgtttccc

SEQ ID NO: 405186 - DNA, 534 bp, Homo sapiens
  misc_feature: GZ8MTXP01AJW3P.21.55.E11.1.454.CMB.2.raw
  modified_base (221)..(221): a, c, t, g, unknown or other
  modified_base (373)..(373): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacataaactaccttttaaatggtatcagcaacaaaccaggaaggaccccaaagctcctgatcgatgctgcatccaaatttagagagtggggtcccatccccaggttcagtggcgaatgggaatcgtgggactaaatttcactcncaccatcagcagtctgacaactgaagtatttgactaaacttactattgtacaaactaggtattacagttactttccttttcaacctttccggccccgttaagggaacccgttagttccgattaatacaaacgttacttgtggctgcctacgatcttgttcc

SEQ ID NO: 405187 - DNA, 530 bp, Homo sapiens
  misc_feature: GZ8MTXP01AG0CI.21.55.E11.1.454.CMB.2.raw
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgacaagtcaagacataaacacttttaaatgtatcagcacaaacaggaacgccccaaagctctgatcgatgctgcatccaatttagagagtgggtccatcccaggttcagtgcgaatggaatctagggactaaatttcactctcacatcagcagtctagacaactgaagtatttgctaaacttactatttgtacaaactagtattaacagttaactttccctttctaaccttttccgggcccttaaggggaacccgttaagtccgaattaacgtcaaacggttacttggtaagcttgaccaccattccttgttcc

SEQ ID NO: 405188 - DNA, 552 bp, Homo sapiens
  misc_feature: GZ8MTXP01DB6XE.21.55.E11.1.454.CMB.2.raw
  modified_base (345)..(345): a, c, t, g, unknown or other
tcagtcgtcgctcgcacgaccggtgctcgatttagcactcgcacgttgggtttgggggagtcagtctcagtcaggacactagcatggacatgagggtccccgctcagctcctggggctcctgctactctggctccgaggtgccagatgtgacatccagatgacccagtctccatcatccctgtctgcatctgtcggagacagaatcaccattattgccggacaagtcaacgacaataaactacttttaaatgtatcagcacaaacaggaagccccaaagctctgatcgatgctgcatcctaatttagagtaggtgggtccatccccaggttcagtggcgaatggntctaggaaactaaatttcacttctacaccatcagcagtctgacaactgaagtatttgactaactttacgtattgacaaactagtagttactagttactttcctttctaccgttttccgggcccgttaagggaacccgttaagttccgaattaacgtacaaaacggttacttggtcggacttcggacctaccttattccttgtttccc

SEQ ID NO: 405189 - DNA, 565 bp, Homo sapiens
  misc_feature: GZ8MTXP01D2AL8.21.55.E11.1.454.CMB.2.raw
  modified_base (196)..(196): a, c, t, g, unknown or other
  modified_base (220)..(220): a, c, t, g, unknown or other
  modified_base (344)..(344): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcaccattattgccgganaagtcacgacaataaacacctttttaaaatggtatcagcacaaacaggaagccccaaaagctctgatcgatgctgcatccaaatttagagagtggggtcccatccccaggttcagtgcgaatgntctgggacaaatttactactctcaccaatacagacagtactagacaactagaagtatttagtactaacttaacttaattagtactaaacaagtaagttaacgtaagttaactttacctttccttaccgttccgtcccggtcgggtaccggaacggtacgttaacgtaactaacttaaacgttaaacgttacgtaagtcgtcgtcaccactaacgttcgttc

SEQ ID NO: 405190 - DNA, 538 bp, Homo sapiens
  misc_feature: GZ8MTXP01D7FY2.21.55.E11.1.454.CMB.2.raw
  modified_base (197)..(197): a, c, t, g, unknown or other
  modified_base (220)..(220): a, c, t, g, unknown or other
  modified_base (280)..(280): a, c, t, g, unknown or other
  modified_base (338)..(338): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgccganaagtcacgacaataaactaccttttaaatgtatcagcacaaacaggacgcccaaagctcngatcgatgctgcatccaatttagagagtgggtcccatcccaggttcagtgcgaatggntcgtggaacaaatttcactctcaccatcagcagtctagaccaactgaagtatttgactaactttacgttaatttgtactaaacagtaagttactagttaactttcctttctacgtttccggcccgtaagggtaaccgttaagtaccgattaacgtacaaaacgttcttaggtggactcgacaccttattcgttcgtttcc

SEQ ID NO: 405191 - DNA, 586 bp, Homo sapiens
  misc_feature: GZ8MTXP01EA61E.21.55.E11.1.454.CMB.2.raw
  modified_base (222)..(222): a, c, t, g, unknown or other
  modified_base (284)..(284): a, c, t, g, unknown or other
  modified_base (344)..(344): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccgganaagtcacgacaataaactacttttaaatgtatcagcacaaacaggaacgccccaaagctccngatcgatgctgcatccaaatttagagagtgggtcccatccccaggttcagtgcgaatggntcgtagggaactaaatttcactctacacatcagcagtctagacaactgaagtatttgacttaaactttacgttaatttgtacaaacgtagtacgttactagtttaactttccctttactaccgttttccgggccccgttaaggggtaacccgttaaaggttaccgttaattaaacgttaaccaaaaccggttacgttggtaacgggccttggaccctaacccgttatttccgttcgtttccc

SEQ ID NO: 405192 - DNA, 534 bp, Homo sapiens
  misc_feature: GZ8MTXP01AHTGK.21.55.E11.1.454.CMB.2.raw
  modified_base (219)..(219): a, c, t, g, unknown or other
  modified_base (396)..(396): a, c, t, g, unknown or other
tcagtcgtcgctcgcacgaccggtgctcgatttagcactcgcacgttgggtttgggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacataaactaccttttaaatggtatcagcacaaaccaggaagccccaaagctctgatcgatgctgcatccaatttagagagtcgggtcccatccccaggttcagtggcgaatggaatcgtagggactaaatttcactctcaccatcagcagtctgcaacctgaaacgtntttgactaaacttactattgtacaaacgtagtacgtttacagtttaacttccttttcaccgttttccgggcccttggggaacccttaaggtcgaactagtaccaaacgttacttggtgcttgcctaccatcttgttcc

SEQ ID NO: 405193 - DNA, 572 bp, Homo sapiens
  misc_feature: GZ8MTXP01CZQR6.21.55.E11.1.454.CMB.2.raw
  modified_base (219)..(219): a, c, t, g, unknown or other
  modified_base (230)..(230): a, c, t, g, unknown or other
  modified_base (363)..(363): a, c, t, g, unknown or other
  modified_base (454)..(454): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccgganaagtcaacganaataaactacttttaaatgtatacagacaacaaacgaggaacgaccccaaagctactagatcgatgctgacatacctaaagtttagagtagtcgggtcccagtccccgaggttcaggtcggacgaaagttggntcgtagggaactaaattcactctacacatcagcagtctgacaactgaacttatttgactaactttatatttgaactaacgagtacgttaanagtttacttcctttcgaccttttccggacccttggggaacccttaagtaccgaagttaaactaaccgaaaacgttcttaggtcggcttaacgcaacccttagttccgtttcgttaacc

SEQ ID NO: 405194 - DNA, 614 bp, Homo sapiens
  misc_feature: GZ8MTXP01B6IRA.21.55.E11.1.454.CMB.2.raw
  modified_base (219)..(219): a, c, t, g, unknown or other
  modified_base (281)..(281): a, c, t, g, unknown or other
  modified_base (356)..(356): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccganaagtcacgacaataaactacttttaaatgtatcagcaacaaacaggaacgccccaaagctcngatcgatgctgctatacctaaatttaggagtagtcggggtcccagtcccccgtaggttcaggtggcgtaagtggntcgtagggaactaaatttcacttctacacctatcagctagtctagactaactagtaacgtatttacgaacttaaactttacttaagtttacgtaacctaaacgtaagtaacgtttaaccgtaagtttaacctttccctttacgtaccgttttccggcccgttaaggggaacccttaaggttaccgaagttaaactaaccgttaaaacgttcttacggtaacggtacttcgacctaccttattccgtttcgtttaaccc

SEQ ID NO: 405195 - DNA, 644 bp, Homo sapiens
  misc_feature: GZ8MTXP01BQQQJ.21.55.E11.1.454.CMB.2.raw
  modified_base (219)..(219): a, c, t, g, unknown or other
  modified_base (337)..(337): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganagtcacgacataaactacttttaatgtatcagcacaaacaggaacgccccaaagctctgatcgatgctgcatccaatttagagagtcgggtccatcccaggttcagtggcgaatgggntcgtagggactaaagtttcactctacaccatcagcagtctagactaacctggaaacttattttacgactaaacctttacttaagtttcgtaacctaaacgtaggttaaacgtttaacctaaggtttaaacttttcccttttacgtaacccgtttttcccgggccccgttaacgggggtaacccgttaaacggtttacccggttaaagtttaaacttaacccgttaaaaaccggttaaaccgtttggggttaacgggtccctttaacggtacccgaacccgttaagtttcccctttggttttaacccc

SEQ ID NO: 405196 - DNA, 591 bp, Homo sapiens
  misc_feature: GZ8MTXP01CNE9Y.21.55.E11.1.454.CMB.2.raw
  modified_base (218)..(218): a, c, t, g, unknown or other
  modified_base (399)..(399): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccganaagtcacgacataaactacttttaaatgtatcagacaacaaacgaggaacgaccccaaagctacctgatcgatgctgcatcctaaatttagagagtcggggtcccagtccccgaggttcaggtggcgaagttgggaatcgtagggaactaaagtttccaacttctacaccatcagcagtcngaccaactgaagtatttgactaaactttatatttgacaacgtagtacgttacagtttactttcctttactaccgtttccggcccgttaaggggtaacccttaaggttaccgaaactttaaacgtaccgttaaaaacggttaccgttggttaagggcctttcggacctacccgttattccttaacggtttccc

SEQ ID NO: 405197 - DNA, 584 bp, Homo sapiens
  misc_feature: GZ8MTXP01D20IV.21.55.E11.1.454.CMB.2.raw
  modified_base (197)..(197): a, c, t, g, unknown or other
  modified_base (220)..(220): a, c, t, g, unknown or other
  modified_base (281)..(281): a, c, t, g, unknown or other
  modified_base (417)..(417): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgccganaagtcagacataaactacttttaaatgtatcagcaacaaacaggaacgccccaaagctccngatcgatgctgctataccaaatttagagtagtcggggtacccagtccccaggttcaaggtggcgtaaattgggaatcgtaaggaaactaaatttcaactctacactatcagctagtctagactaaactgaaagttntttagactaaactttacttaattagtacaaacgtagtaacgttacacgtttaactttccctttctaacgttttcccgggcccgtttaacgggaaccgttaaggttaccaagttaactacgaaaaacgttcgttaggtcgggcttaaggcctacacttcttgttaacc

SEQ ID NO: 405198 - DNA, 613 bp, Homo sapiens
  misc_feature: GZ8MTXP01CX968.21.55.E11.1.454.CMB.2.raw
  modified_base (222)..(222): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccgganaagtcaacgacaataaactacttttaaatgtatcagcaacaaacgaggaacgaccccaaagctcctgatcgatgctgacatacctaattagagagtcgggtccagtccccgaggttcaggtggacgtaagtggaatcgtaggggtaaactaaagtttccacttactacacctatccagcagtcagacctaactgaagttatttgacttaacttacttattacgtaacaaacgtagtaacgttactagtttaacctttcctttaccgtaccgtttcccgggcccgttaaggggtaacccttaggttaaccgaatttaaacgtaaccgttaaaaaccggttcttcgggttaacggtccttaacggaccctaacttacttcgttcgtttaaccc

SEQ ID NO: 405199 - DNA, 538 bp, Homo sapiens
  misc_feature: GZ8MTXP01AXCJS.21.55.E11.1.454.CMB.2.raw
  modified_base (218)..(218): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccganaagtcagacataaactacttttaaatggtatcagcacaaaccaggaagccccaaagctcctgatcgatgctgcatccaatttagagtagtggggtcccatccccaggttcaggtggcgaatgggaatcgtagggaactaaatttcactctacaccatcagcagtctagacaacctgaaagtattttgacctaaactttacgtatttagtacaactaagattacagttaactttcctttacacttttcggccccgtgggaacccttaaggtccttaagtatacaaaacgttacgttgtaacggctgctaccatccttgttc

SEQ ID NO: 405200 - DNA, 537 bp, Homo sapiens
  misc_feature: GZ8MTXP01BN2WO.21.55.E11.1.454.CMB.2.raw
  modified_base (197)..(197): a, c, t, g, unknown or other
  modified_base (514)..(514): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctattattgaccggacaagtcaacgacaataaactaccttttaaatggtatcagacacaaacgaggaacgaccccaaagctcctagatcgatgctgcataccaatttagagagtcgggtcccatccccgaggttcaggtggacgaagtggaagtcgtaggggaactaaatttcactctacacctatcagcagtctagacaactgaagtatttgactaacttactatttgaccaaagtagtattacagtttaacttcctttcacgtttccggccgtaagggaaccttaggtcagtaactcaaacgttnttgtgctgctacatcgttgttcc

SEQ ID NO: 405201 - DNA, 573 bp, Homo sapiens
  misc_feature: GZ8MTXP01AD9BH.21.55.E11.1.454.CMB.2.raw
  modified_base (199)..(199): a, c, t, g, unknown or other
  modified_base (225)..(225): a, c, t, g, unknown or other
  modified_base (448)..(448): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcctccatcatccctgtctgcatctgtcgganacagaatcacctattattcgaccganaagtcaacgactaattaaactacttttaatgtatcagacaacaaacgaggaacgacccaagctactagatcgatcgctagactatacctaaagtttaggaggtacggtacgggtacccagttccccgaggttcgaggtcggacgtaagtggtaactcgtagggtaaactaacgtttcacttcactacatcagctagtctacgacgtactagtaagttctttanacttaacttatattagtacaacgtagtagttactactttacttccttctacgttccgccgtgaaccgttagtccgttaatacgtacaacgttacgttgtggactcgactacttactcttcgttcc

SEQ ID NO: 405202 - DNA, 552 bp, Homo sapiens
  misc_feature: GZ8MTXP01D0GGQ.21.55.E11.1.454.CMB.2.raw
  modified_base (221)..(221): a, c, t, g, unknown or other
  modified_base (520)..(520): a, c, t, g, unknown or other
  modified_base (526)..(526): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgaccganaagtcacgacaataaactacttttaatgtatcagacaacaaacgaggaacgccccaaagctctgatcgatgctgacatacctaaatttagagtaggtcggggtacccagtccccgaggttcaggtcggacgtaaagttggaacgtcgtaggggaacttaaatttccaacttctacacctatcagctagtctagacctaaactgaagttatttgaacttaaacttattagttgtacaacagtacttacagttactttccttctactttcgccgtaaggacaagtcaatactacgaaacgnttggtnctcgacacgttattcgttcgttaacc

SEQ ID NO: 405203 - DNA, 652 bp, Homo sapiens
  misc_feature: GZ8MTXP01DSE9R.21.55.E11.1.454.CMB.2.raw
  modified_base (222)..(222): a, c, t, g, unknown or other
  modified_base (286)..(286): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtcctccatcatccctgtctgcatctgtcggagacagaatcacctattattgaccganaagtcaacgacaataaactacttttaaatgtatcagcaacaaacaggaacgacccaaagctccngatcgatgctgacatacctaaatttagagtaggtcgggtaccagttccccgaggtttacagggttggaccgtaaagttagggtaacgttcgtacggggtaaaccttaaaacgttttcccaacttcctacctacccaattccaagctaagttctacgactaaactagaaagttacttttagaacttaaacctttacgtaatttacggtaacaaacgtagtaacgtttaactagtttaaactttccctttaccgtaccgttttccggcccgttaacgggtaacccgttaagtaccgttaattaacgtaacttaaaacggttcgttcggtaacggtacttcggacctaccttattccttcgtttaaccc

SEQ ID NO: 405204 - DNA, 543 bp, Homo sapiens
  misc_feature: GZ8MTXP01BA1OS.21.55.E11.1.454.CMB.2.raw
  modified_base (220)..(220): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacataaactacttttaaatggtatcagcacaaaccaggaagccccaaagctcctgatcgatgctgcatccaatttagagagtcgggtccatccccaggttcagtggcgaatggaatcgtagggactaaagtttcactctcaccatcagcagtctagactaactgaacgttatttcgactaactttactattgtacaacagtagttacagttactttcccttactaccgtttccggccctaaggggtaacccttaaggtccgattaactaacgaaaacgttacttggtaacggtctgccaccttatccttgttccc

SEQ ID NO: 405205 - DNA, 532 bp, Homo sapiens
  misc_feature: GZ8MTXP01BX8R5.21.55.E11.1.454.CMB.2.raw
  modified_base (403)..(403): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccggacaagtcacgacataaactacttttaaatgtatcagcacaaacaggaagccccaaagctcctgatcgatgctgcatcccaatttagagtagtcggggtcccagtccccaggtttcaggtggcgaagtgggaatcgtagggactaaatttcactctacaccatcagcagtctagcaacctgaatntttagactaacttactattgtacaacaggtattacagttacttcctttctactttccggccctaagggaccgttaagtcgagtactacgaaacgttacttgtaacggctcgcacgttattcgttgttcc

SEQ ID NO: 405206 - DNA, 528 bp, Homo sapiens
  misc_feature: GZ8MTXP01AE9G0.21.55.E11.1.454.CMB.2.raw
  modified_base (397)..(397): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacacttttaaatggtatcagcacaaaccagggaacgccccaaagctcctgatcgatgctgcatccaaatttagagagtcgggtccatccccgaggtcagtggcaatggaatcgtagggactaaatttcactctacaccatcagcagtctagcaactgaacgtntttgactaaacttactattgtacaaactagtaagttacagtttaactttcctttcaaccgttttccgggcccttaaggggacccttaaagtccgaatacgtacaaacgcttgtggctgctcatccttgtcc

SEQ ID NO: 405207 - DNA, 527 bp, Homo sapiens
  misc_feature: GZ8MTXP01BTJPA.21.55.E11.1.454.CMB.2.raw
  modified_base (284)..(284): a, c, t, g, unknown or other
  modified_base (350)..(350): a, c, t, g, unknown or other
  modified_base (405)..(405): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccggacagtcacgacataaactacttttaaatgtatcagcaacaaaccgaggaacgccccaaagctccngatcgatgctgcatccaatttagagagtgggtcccagtccccgaggttcaggtggcgtaagtgggntcgtagggaactaaagtttcactctacacatcagcagtctagacaactgaagttntttgactaacttatattgtacaactagtacttactagttacttccttctacgtttccggccctaagggtacccaagtcgataacgtacaaacgttcttgtggctcgctacattccttgttcc

SEQ ID NO: 405208 - DNA, 554 bp, Homo sapiens
  misc_feature: GZ8MTXP01EP385.21.55.E11.1.454.CMB.2.raw
  modified_base (220)..(220): a, c, t, g, unknown or other
  modified_base (347)..(347): a, c, t, g, unknown or other
  modified_base (463)..(463): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganaagtcacgacataaactacttttaaatgtatcagcacaaacaggaacgcccaaagctctgatcgatgctgcatcctaaatttagagtagtcgggtccagtccccgaggttcaggtggacgaagtggntcgtagggaactaaatttcactctacaccatcagcagtctacgactaactgaagtatttagacctaaatttactattacgtacaaactagtaattactagtttactttcccgtttntaccgtttccggcccgtaagggtaacccgttaagtcgattaacgtaacgaaacgttcgttgtaaggctaacgctaccttatccgttgttcc

SEQ ID NO: 405209 - DNA, 559 bp, Homo sapiens
  misc_feature: GZ8MTXP01A5RWE.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacaataaactaccttttaaatgtatcagcacaaaccgaggaacgccccaaagctctgatcgatgctgcataccaatttagagtagtcggggtccagtccccgaggttcaggtggcgaaatgggaatcgtagggtaactaaagtttcacttctacacctatcagcagtctagctaactgaagttatttagacttaacttacgttattacgtacaacgtagtagttacagttacttccgtttctacgttttccggcccgttaagggaaccgttagtaccgagttaactaacaaacgttacgttgtggtcctcgacctacttatcgttgttcc

SEQ ID NO: 405210 - DNA, 610 bp, Homo sapiens
  misc_feature: GZ8MTXP01DQ74O.21.55.E11.1.454.CMB.2.raw
  modified_base (220)..(220): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccganaagtcacgacataaactacttttaaatgtatcagacaacaaaccaggaacgccccaaagctcctgatcgatgctgacataccaaatttagagtagtcggggtcccatccccgaggttcaggtgcgaagtggaatcgtagggaactaaatttcactctacacctatcaagcagtctagactaacctgaaacgtatttcgacttaaactttacttaatttcgtaacaaacgtagtaacgtttaactagtttaactttccctttacgtaaccgttttcccgggacccgttaagggtaacccgttaaaggttccgttaaagttaaactaaccgaaaaacggttaacttgggtaaggtccttaacggacccaaccttattcctttcgtttaaccc

SEQ ID NO: 405211 - DNA, 559 bp, Homo sapiens
  misc_feature: GZ8MTXP01D9VWC.21.55.E11.1.454.CMB.2.raw
  modified_base (220)..(220): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganaagtcacgacaataaactacttttaaatgtatcagcacaaacgaggaacgcccaaagctctgatcgatgctgactataccctaaagtttacggagtacggtggggtcccctagttcccccgaggttcaggtcggacgaagttgggaattacgtagggtaaacttaaactttcaactctacaccatcagctagtctagacctaactggaatatttcgactaaactttacgttattgtaacaacgtagtaattactagttaactttcttctacgttcggcctaagggaccttaaggtcaagtatacgaaacgacttggtgctgccacttattcgttgttcc

SEQ ID NO: 405212 - DNA, 673 bp, Homo sapiens
  misc_feature: GZ8MTXP01A3W27.21.55.E11.1.454.CMB.2.raw
  modified_base (220)..(220): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcatccctgtctgcatctgtcggagacagatcactattattgccganagtcacgacaataacttacttttaatgtatcagacaacaaaccgaggaacgaccccaaagctactagactcgatcgctagactactacctaagtttagagtacggtcgggtcccacgtcccgaggttcagggtcggacgtaagtgggtcgtacggtaagggtaaacttaaactttccaccttctaccctaccctataccgaacgtccgtagttaccgtacgtacctaaaccgtggtaaactttacgttttaacgaacctttaaactttaacggtttaaacgtttacggtaacctaaaaccgtaagttaacgtttaaccttaacgtttaaccttttccctttaccgttacccggtttcccggacccggtaacgggtaaccttacggttaccgaattaacgtaacgaaacgttcgttggtaacgtctaacgaccctacttactccgttcgtttcc

SEQ ID NO: 405213 - DNA, 578 bp, Homo sapiens
  misc_feature: GZ8MTXP01CCZF0.21.55.E11.1.454.CMB.2.raw
  modified_base (219)..(219): a, c, t, g, unknown or other
  modified_base (276)..(276): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccganaagtcacgacataactacttttaatgtatcagcacaacaggaacgccccaagctccngatcgatgctgacatacctaatttagagtagtcgggtcccagtccccgaggttcaggtcggacgaatggaatcgtagggactaattcactcacaccatcagcagtctacgactaacgtagaacgttatttcgacttaaactttacttaattacgtaacaaacgtagttaacgttactagtttactttcccgtttacgtaccgtttcccggcccgttaagggacccgttaagttccgaattaacgtacttaaaacggttacttgggtcggtcctaaggccctaaccgttattccgttcgttcc

SEQ ID NO: 405214 - DNA, 588 bp, Homo sapiens
  misc_feature: GZ8MTXP01AOW6G.21.55.E11.1.454.CMB.2.raw
  modified_base (290)..(290): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccggacaagtcacgacaataaactacctttttaaatgtatcagacaacaaacgagggaacgaccccaaagctcngatcgatgctgcatacctaatttagagtagtcgggtcccagtccccgaggttcagtggcgaagtggaatcgtagggtaactaaatttcactctcactatcagctagtctacgactaacctgaaacgttattttacgacttaactttactacgttagtaacaaacgtagtacgttaactagtttactttccctttactaccgtttccggcccgttaagggaaccttaaggtacgttaacttaaacgtaaccaaacgttacgttggtaacggctcgactacccttattccttaacgttcc

SEQ ID NO: 405215 - DNA, 576 bp, Homo sapiens
  misc_feature: GZ8MTXP01BCESD.21.55.E11.1.454.CMB.2.raw
  modified_base (217)..(217): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctcatcatccctgtctgcatctgtcggagacagaatcactattattgcganaagtcacgacataaactacttttaaatgtatcagcaacaaaccgagggaacgccccaaagctcctagatcgatgctgacataccaatttagagtagtcgggtaccagtccccgaggttcagtcggcgaagtggaatcgtagggacctaaatttcacttctacactatcagcagtctacgactaactgaattattgacttaactttactatttacgtacaaacgtagtaacgttactagtttacttcctttacgtacgttttcccgggccgttaagggaacccttaagttacgaattaacgacttaaaacggttacgttcggttaacggacctcgtacctacttattccgttgttaaccc

SEQ ID NO: 405216 - DNA, 607 bp, Homo sapiens
  misc_feature: GZ8MTXP01EPJLS.21.55.E11.1.454.CMB.2.raw
  modified_base (198)..(198): a, c, t, g, unknown or other
  modified_base (220)..(220): a, c, t, g, unknown or other
  modified_base (437)..(437): a, c, t, g, unknown or other
  modified_base (591)..(591): a, c, t, g, unknown or other
tcagtcgtcgctcgcacgaccggtgctcgatttagcactcgcacgttggggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgcganagtcacgacaataaactacttttaatgatcagacaacaaacgaggaacgacccaaagctacctgatcgatgctgactatacctaaagtttagagtacggttcgggtacccagtccccgtaggttacgaggtggcgtaaagtcggtaagttcgtaggggaactaaaatttccacttctacaccatacaagcaagtctacgactaacgtagaaacgttntttacgaacttaaccttagttaatttacgaacaaacgtagtacttaactacttaactttcctttactaccgtttccggcccgtaagggtaaccgttaacggtacttaaacgttaacaacgttaaacgaacgttggtaacggtcttcgactaccnttaacgttgttaaccc

SEQ ID NO: 405217 - DNA, 562 bp, Homo sapiens
  misc_feature: GZ8MTXP01B12YM.21.55.E11.1.454.CMB.2.raw
  modified_base (288)..(288): a, c, t, g, unknown or other
  modified_base (354)..(354): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgtagacagaatcacctattattgccggacaagtcacgacaataaactacctttttaaatgtatcagcaacaaaccagggaacgccccaaagctccngatcgatgctgcatcctaatttagagtagtcgggtcccatccccgaggttcaggtggcgaagtggntcgtagggaactaaatttcactctcaccatcagcagtctacgacaaccttagaagttactttgacttaacgttacttattgtacaacgtagtacttacagtttactttcctttactaccggtttccggcccgtaacgggaacccttaaggttcgaattaactacgaaaacgttcttggtaacggctcgaccacttagttccttgttcc

SEQ ID NO: 405218 - DNA, 634 bp, Homo sapiens
  misc_feature: GZ8MTXP01C8MFE.21.55.E11.1.454.CMB.2.raw
  modified_base (198)..(198): a, c, t, g, unknown or other
  modified_base (222)..(222): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcatccctgtctgcatctgtcgganacagaatcactattattgaccganaagtcaacataataaactacttttaatgtatcagacaacaaacgaggaacgacccaaagctcagatcgatgctgcaattacctaaagttagaggtacggtcggggtacccagttcccccgtagggtttcgaggtcggacgtaagttagggaatacggtagggtaaactaaacgtttccaacttacaccacctatcacgtacacgttcacgactaactaggtaattactttacgaacttaaacttacttaacgttacgtaacaaacgtaagtaacgttaactacgttttaaacttcctttacctaccgtttcccggtccgtaacgggtaacccttaggtaccttaaagttaactaaacgttaaacgttacgttcggtggtacttccggactaccttacttcgttcgtttaacc

SEQ ID NO: 405219 - DNA, 580 bp, Homo sapiens
  misc_feature: GZ8MTXP01DHYD2.21.55.E11.1.454.CMB.2.raw
  modified_base (197)..(197): a, c, t, g, unknown or other
  modified_base (219)..(219): a, c, t, g, unknown or other
  modified_base (255)..(255): a, c, t, g, unknown or other
  modified_base (422)..(422): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacattattgccganaagtcaacgacaataaactacttttaaatgtatcancaacaaacgagggaacgccccaaagctcctagatcgatcgctgctatacctaaatttaggagtacggtcgggtcccatccccgaggttcaggtgcgaagtggaatcgtagggaactaaatttcactctacacatacagcagtctacgactaaaccgtgtaaacgttntttacgaacttaaactttagttatttcgaaactaaagtagttaacgttactagtttaactttcctttactaccgttccggccgtaacgggtaccgaagttacaagttaactaacgaaaacgttcttaggtcgactcgtacacttacttcgttcgttcc

SEQ ID NO: 405220 - DNA, 574 bp, Homo sapiens
  misc_feature: GZ8MTXP01ATNVA.21.55.E11.1.454.CMB.2.raw
  modified_base (224)..(224): a, c, t, g, unknown or other
tcagtcgtcgctcgcacgaccggtgctcgatttagcactcgcacgttgggtttgggggagtcagtctcagtcaggacacagcatggacatggacgggtccccgctcagctccgtggggctcctgctactctggctccgaggtgccagatgtgacatccagatcgacccagtcctccatcatccctgtctgcatctgtcggagacagaatcactattattgcganagtcacgacataaactacttttaatgtatcagcacaaacgaggaacgaccccaaagctcctgatcgatgctgcataccaagtttagaggtaggtcggggtacccatccccgtaggttcgaggtggacgtaagtgggtaactcgtaggggtaactaaaattttccacttctacacctatacagcacgtctagacctaacctagaaagtattttagacttaaacttacttaattagtacaacgtaagtagttactagttacttccttctacgttccggccgtaacgggtaaccgagtccgatactaacaaacgttacttcggtaaggctcgccacttactaacttcgttccc

SEQ ID NO: 405221 - DNA, 563 bp, Homo sapiens
  misc_feature: GZ8MTXP01BCM50.21.55.E11.1.454.CMB.2.raw
  modified_base (197)..(197): a, c, t, g, unknown or other
  modified_base (220)..(220): a, c, t, g, unknown or other
  modified_base (351)..(351): a, c, t, g, unknown or other
  modified_base (405)..(405): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcaccattattgccganaagtcacgacaataaactacttttaatgtatcagacaacaaaccgagggaacgaccccaaagctctgatcgatgctgcatacctaatttagagtagtcgggtcccatccccaggttcagtggctaagtggntctgtagaactaatttcactctacacatcagcagtctgacctaaccgtgaagtnttttagaccttaaactttactattacgactaaactagtaattacctagtttactttccctttgtaacccgtttcggcccgttaggggaccctaaagttccgaattaacgttaaccgaaacgttactggtcggcctgacccttacctaagttcctttcg

SEQ ID NO: 405222 - DNA, 582 bp, Homo sapiens
  misc_feature: GZ8MTXP01CHCUF.21.55.E11.1.454.CMB.2.raw
  modified_base (223)..(223): a, c, t, g, unknown or other
  modified_base (257)..(257): a, c, t, g, unknown or other
  modified_base (287)..(287): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctatttattgccgganaagtcacgacaataaactacttttaatgtatcanacacaaacgagggaacgccccaaagctccngatcgatgctgctatacctaaatttagagtagtcgggtccagtccccgaggttcaggtcggacgaagtgtaatactaagggaaactaaagtttccaactctacaccatacacgctaagtctacgacctaaccgtaggtaaattacttttacgacttaaactttacttaatttacgtacaaacgtaagtaacgttaacctatttactttccttaccgtaccgtttccggccgtaagggaaccgttagtacgaattacgtaacaaacgttcttggtaagctcgcacttatcgttgtc

SEQ ID NO: 405223 - DNA, 577 bp, Homo sapiens
  misc_feature: GZ8MTXP01C34SL.21.55.E11.1.454.CMB.2.raw
  modified_base (225)..(225): a, c, t, g, unknown or other
  modified_base (571)..(571): a, c, t, g, unknown or other
tcagtcgtcgctcgcacgaccggtgctcgatttagcactcgcacgttgggtttggggagtcagtctcagtcaggacacagcatggacatgagggtccccgctcagctccgtggggctcctgctactctggctccgaggtgccagatgtgacatccagatcgacccagtcctccatcatccctgtctgcatctgtcggagacagaatcactattattgaccggaanagtcaacgactaattaaactacttttaaatgtatacagacaacaaacgaggaacgaccccaaagctcctagatcgatcgctgactatacctaaagttaggagtagtcgggtacccagtaccccgaggttcaggtggacgtaagtaggaatcgtaggtaaactaacttcacttcacacatcagtcagttcagactaacagtaattattacgaacttaattacggttatttacgaactaaactaggtaattactagtttaacttccttactaccgtttccgccgtaaggaccgttaagtacaataacgaacaaacgttattgtaacgctaacgcctaacttctcgttnttaacc

SEQ ID NO: 405224 - DNA, 647 bp, Homo sapiens
  misc_feature: GZ8MTXP01EMC6N.21.55.E11.1.454.CMB.2.raw
  modified_base (197)..(197): a, c, t, g, unknown or other
  modified_base (219)..(219): a, c, t, g, unknown or other
  modified_base (278)..(278): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgcganagtcacgacataaactacttttaatgtatcagcacaaaccaggaacgccccaaagctcngatcgatgctgctatcctaaatttagagtacggtcggggtcccagtccccgaggtttcaggtggacgtaagtgggaattcgtagggaaacctaaattttccaacttcttaccaaccctagtaccagtcaaggttctacggacctaaaccgtgtaaacgttacttttacgaaccttaaaccgttttacgttaatttacggttaacctaaacgtaaggtaacgtttaacttacggtttaacttttccctttactaaccgttttcccgggacccgttaaggggtaaccttaaaggtcgttaaattaacgtaaccgaaaacggttacgttggtaacggtctcggtacctacccttattccgttcgtttaaccc

SEQ ID NO: 405225 - DNA, 564 bp, Homo sapiens
  misc_feature: GZ8MTXP01D43A2.21.55.E11.1.454.CMB.2.raw
  modified_base (222)..(222): a, c, t, g, unknown or other
  modified_base (428)..(428): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgaccgganaagtcacgacaataaactacttttaaatgtatcagacaacaaacgaggaacgaccccaaagcctcagatcgatgctagcatacctaagttagagtaggtcgggtacctatccccgtaggttacaggtcggacgtaagtggtaatcgtaagggaaacttaacttcactctacacatcagctagtctacgactaacgtagtaaagttntttacacttaaactttactattacgtaacaactagtaacttacgtattactttcttcctacgttccgccgtaaggaacttaggtcaatactaacgaaacgttcgttgtgctcgacctacttactcgttcgttaacc

SEQ ID NO: 405226 - DNA, 567 bp, Homo sapiens
  misc_feature: GZ8MTXP01B8JLQ.21.55.E11.1.454.CMB.2.raw
  modified_base (220)..(220): a, c, t, g, unknown or other
  modified_base (282)..(282): a, c, t, g, unknown or other
  modified_base (559)..(559): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganaagtcacgacaataaactacttttaaatgtatcagcacaaacgaggaacgccccaaagctcngatcgatgctgactatacctaaagtttagagtacggtcgggtacccagtccccgtaggttcaggtggcgaaatggaatcgtagggaactaaattcactctacaccatcagcaagtctagactaactagaagttatttcataactttactatttacgaacaaacgtaagtattaacctaagttactttcctttacgtaccgtttccggcccgttaaggggaacccgttaagtcgaattaaacgtacaaaacgttacgttgtaaggcttgaccaacttntcgttgtc

SEQ ID NO: 405227 - DNA, 614 bp, Homo sapiens
  misc_feature: GZ8MTXP01BDQ34.21.55.E11.1.454.CMB.2.raw
  modified_base (221)..(221): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacataaactaccttttaaatggtatcagcaacaaacagggaacgccccaaagctcctgatcgatgctgcatccaatttagagtagtcgggtcccagtccccgaggtttcagtggacgtaagtgggaatcgtaggggtaactaaagttttccactctacacctatcagcagtctagacctaacctgtaaagttacttttgacttaaactttacttaagtttcgtactaaacgtagtaacgtttaactagtttaacttttcccgtttacgtacccgttttccgggccccttaacgggggtaacccgttaaaggtccgttaaattaacgtaacgaaaaccggttacttggtaacggtcttaaggccaccgttatccgttgtttaaccc

SEQ ID NO: 405228 - DNA, 658 bp, Homo sapiens
  misc_feature: GZ8MTXP01C6J02.21.55.E11.1.454.CMB.2.raw
  modified_base (197)..(197): a, c, t, g, unknown or other
  modified_base (223)..(223): a, c, t, g, unknown or other
  modified_base (290)..(290): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctattattgaccgganaagtcaacgacaataaactactttttaaatggtatcagacaacaaccgaggacgaccccaaagctcngatcgatgctgacatacctaattaggagtacggtcggggtaccacgttccccgagggttacaggtggacgtaagtgggtaacttcgtaggtaacgtaaactaaattttccaaccttcctaccaacctaataccgaaggtcctaacgtctacgaacctaaaccgtaggtaaacgttatttacgaacccttaaacgttttaacttagtttacgtaacctaaagtacgttaacgtttaacttaacgtttacctttcctttaccgtaccgttttccggaacccgttaaggggaacccgtaaggttcgtaaattcttaaaccgaaacgttaacgtttggacgggtcttcggaccttaacccttcgttcgttcg

SEQ ID NO: 405229 - DNA, 631 bp, Homo sapiens
  misc_feature: GZ8MTXP01B6IZ3.21.55.E11.1.454.CMB.2.raw
  modified_base (196)..(196): a, c, t, g, unknown or other
  modified_base (221)..(221): a, c, t, g, unknown or other
  modified_base (360)..(360): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcaccattattgaccgganaagtcaacgactaataaactaccttttaaatgtatcagcacaaaccagggaacgaccccaaagctcctgatcgatgctgacatacctaaatttagagtacgtcggggtaccagtccccgaggttcagtggcgaagtggntcgtagggactaaagttcactcacaccatcagcagtctacgactaactagaagtatttagactaactttatattagtacaaacgtagtaagtttaactagtttacctttcctttacgtaaccgttttccgggacccgttaacggggtaaacccgttaaacggttacgttaaacgttaaactaacccgaaaaacggttaaacccgttgggttaaccgggtccttaaccggacccgttaacccgttaactttcccgtttaacgttttaacccc

SEQ ID NO: 405230 - DNA, 632 bp, Homo sapiens
  misc_feature: GZ8MTXP01BIN5Z.21.55.E11.1.454.CMB.2.raw
  modified_base (219)..(219): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgcganagtcacacaataaactacttttaatgtatcagacaacaaaccgagggaaacggaccccaaagcctacctgatcgatcggctagactatacctaatttaggaggtacgtcggggtcccatccccgtaggttcaggtggacgtaagtacgggaattacgtaagggtaaacttaaatttccgactactaccaccctataccgagtctacgtctacgactaaccgtaggtaacttatttacgaacttaacttacttattacgtacaaacgtagtaacgttactacgtttaactttccctttacgtacccgtttccggccccggtaacgggtaaccgttaaggttccgttaaattaacgtaacttaaaacggttaccttaggtaacggtactcgacctaccttagtcttcgtttaacc

SEQ ID NO: 405231 - DNA, 614 bp, Homo sapiens
  misc_feature: GZ8MTXP01DL4W7.21.55.E11.1.454.CMB.2.raw
  modified_base (202)..(202): a, c, t, g, unknown or other
  modified_base (228)..(228): a, c, t, g, unknown or other
  modified_base (580)..(580): a, c, t, g, unknown or other
tcagtcgtcgctcgcacgaccggtgctcgatttagcactcgcacgttggggtttgggggagtcagtctcagtcaggacacagcatggacatgagggtccccgctcagctcctggggcctcctgctactctggctccgaggtgccagatgtgacatccagatcgacccagtctccatcactccctgtctgcatctggtcgganacaagaactcactatttattcgcganaagtcacgaacaataaactacttttaaatgtatcagacaacaaacgagggaacgaccccaaagtcctactagatcgatgctgactatactaaattagagtacggtcggaccctagtcccgaggttacaggtcggacgtaagtggtaactcgtagggaaactaaacgttccactctaccacctatacagctagttctagacctaacgtagtaaagttctttaacgacctttaaactttacgttaatttacgtaaccaaacgtagtaaacgttactaagtttacctttccttacgtaccgtttccgggcccgtaagggtaaaccgttatacgttaataactaacgaaaacgttnttggtaagtctaacgaccaacttctaacttgtcc

SEQ ID NO: 405232 - DNA, 643 bp, Homo sapiens
  misc_feature: GZ8MTXP01C66D2.21.55.E11.1.454.CMB.2.raw
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgaccggacaagtcaacgacaataaactacttttaaatgtatcagacaacaaacgaggaacgaccccaaagctccagatcgatcgctgacatacctaagtttagagtacggtcgggtcccagtccccgtaggttcgaggtcgggacgtaaagtgggtaattcgtaggggtaaacttaaaacgtttccaactttcaccacctataccagctagtcagactaacgtagaagttatttacgacttaactttactaatttacgtaacaaacgtagtaacgttactaagtttactttcctttacctaccgtttccggggtacccgtaacggggtaaccgttaaacggtaccgttaaattaaaccgtaacgaaaaccggttaacttcgggtaacggtaccttcggaccctaccgttacttccgttcgtttaacccg

SEQ ID NO: 405233 - DNA, 588 bp, Homo sapiens
  misc_feature: GZ8MTXP01B8KES.21.55.E11.1.454.CMB.2.raw
  modified_base (196)..(196): a, c, t, g, unknown or other
  modified_base (220)..(220): a, c, t, g, unknown or other
  modified_base (283)..(283): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctattattgccganaagtcacgacataaactacttttaaatgtatcagcaacaaacgaggaacgccccaaagctccngatcgatgctgcatacctaattagagtagtcgggtcccagtccccgaggttcaggtggcgaatggaatcgtagggaactaaatttcactctacacctatcagctagtcagacctaacgtagtaacgttatttacgacttaaactttactatttacgtacaaacgtagtaacgttaactagtttacctttccgtttacctaccgttttccggcccgttaacgggtaaccgttaaggtacaaattaacgtaaccgaaaccgttattcggtaacggcttaacgacctacttacttcgttcgttaaccc

SEQ ID NO: 405234 - DNA, 745 bp, Homo sapiens
  misc_feature: GZ8MTXP01D8QV8.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcctcatcactccctgtctgctatctgtcggagacagactcacctattattcgacgactagtcaacgactaaataacttacttttaagtgatcagacaacgaaaccgagggaaccgaccccaaagtctaccgtagactcgaagtcgactagtactaactaccgttaaagtttcggaaggttacgggtccggggtacccacgtttaccccggtaagggtttacgaagggttcggacccgtaaaggttacgggtaacgttacgggttaaacgggtaaaacccttaaacgttttcccaacttctaaccaacccttagtaccaggtactacgttcttaacgacccttaaacgtagtaattacgtttagaaactttaacctttagtttaactacgttaaacctaacgtaagttaaccgttaacgttacgttttaaccttttcccgttacgttacccgggtttacccgaccggttaacggggtaaacccttaggttacccgttaaagtaaaccttaaacggaaaaccgttcgtttggaaccgggtacttaacgaccctaacttacgtttccgttcgtttaaccc

SEQ ID NO: 405235 - DNA, 602 bp, Homo sapiens
  misc_feature: GZ8MTXP01BUBZP.21.55.E11.1.454.CMB.2.raw
  modified_base (218)..(218): a, c, t, g, unknown or other
  modified_base (585)..(585): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgcganaagtcacgacataaactacttttaatgtatcagacaacaaacgaggaacgaccccaaagctcctgatcgatgctgactatacctaaagtttagaggtacggttcggggtacccagttccccgtaggttcgaaggttggacgtaagtgggtaagtcgtaggggtaaactaaacgtttcacttctacacctatacagtcagtctagacctaactagaaagttatttacgacttaactttactagtttactacaaatagtaattactagtttactttccttacgtaccgtttcccgggaccccgggtaacgtaacgttacgtacttacgtaaccgaaacgttacgttggttcggtaactcgaactacctnttaccttgttcctttcg

SEQ ID NO: 405236 - DNA, 609 bp, Homo sapiens
  misc_feature: GZ8MTXP01BW60C.21.55.E11.1.454.CMB.2.raw
  modified_base (219)..(219): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgaccagtctccatcatcctgtctgcatctgtcgagacagaatcactattattgaccgganaagtcaacgactaataaactacttttaaatcgtaatcagacaacaaaccaagggaacggaccccaaagcctacctagactcgatgctgcataccaaagtttagagtagtggggtcccatccccaggttcagtggcgaaagttgaatcgtagtgaactaaatttcaactctacaacctaatacagctacgtactacgactaacgtagtaattacttacgaacttaacgttaacgttattacgtaacaaacgtaagtaacgttaacgtactttacctttcccgtttactaccgttcccggtaaccgtacgggaaccgtaagttacgtaaacttaacgttaacgttaaacgttacgttcggtacgtccgtcgtacttacctaacgttcgttcg

SEQ ID NO: 405237 - DNA, 569 bp, Homo sapiens
  misc_feature: GZ8MTXP01AFT0N.21.55.E11.1.454.CMB.2.raw
  modified_base (220)..(220): a, c, t, g, unknown or other
  modified_base (391)..(391): a, c, t, g, unknown or other
  modified_base (404)..(404): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganagtcacgacataaactacttttaaatgtatcagcacaaaccgagggaacgccccaaagctcctgatcgatgctgcatcaatttagagtagtcggggtcccagtccccgaggttcaggtggcgaagtgggaatcgtagggaactaaatttcactctacaccatcagcagtcngacaactgaagtntttcgactaactttactattgtacaaacgtagagttacagtttacttcctttacgtaccttttccgggcccttaaggggaacccgttaaggtccgttaattaaacgtacttaaaacgttacgttgggtcggtctaaggaccaccttatttccgttcgtttaaccc

SEQ ID NO: 405238 - DNA, 574 bp, Homo sapiens
  misc_feature: GZ8MTXP01DIX3M.21.55.E11.1.454.CMB.2.raw
  modified_base (258)..(258): a, c, t, g, unknown or other
  modified_base (364)..(364): a, c, t, g, unknown or other
  modified_base (546)..(546): a, c, t, g, unknown or other
  modified_base (564)..(564): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccggacaagtcacgacaataaactactttttaaatgtatcancaacaaaccgagggaacgccccaaagctacctgatcgatgctgcataccaatttagagtaggtcgggtcccagttccccgaggttacaggtcggacgaagttgggnttcgtagggtaaccttaaaagtttccaacttcaccacctatcagcagttctagctaactgaagttatttcgaacttaactttacgttatttacgtacaacgtagtagttactagtttacttcctttactacgtttccggcccgtaagggaaccttaggtacgattaactacgaaaacgttcnggttcgctgacaaccttnttcttcgttc

SEQ ID NO: 405239 - DNA, 702 bp, Homo sapiens
  misc_feature: GZ8MTXP01AH6TQ.21.55.E11.1.454.CMB.2.raw
  modified_base (196)..(196): a, c, t, g, unknown or other
  modified_base (218)..(218): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgcganaagtcacgacataaactacttttaatgtatcagacaacaaacgaggaacgaccccaaagctctgatcgatgctgactatacctaaagtttaggaggtacggtcggggtaccctagtaccccgtaggttcaaggtcggacgtaaagtcgggtaactcgtaagggtaacttaaactttccgaccttcgtaccaccgtataccgaagtactacgttaccgacgtacctaaaccgttaggtaaacgttactttttaacgaacctttaaaccttttaacgttaacgtttacgtaaccgtaaaaccgttaagttaaacggtttaactaacggttttaaccttttacccgtttaccggttaacccgttttcccgggaacccggttaacggggtaaaccgttaaggttacccgttaaagttaaacctaacgttaaaacgttacgttcggtcggtacttaacgacctaaccgttcttaaccgttcgttaaccc

SEQ ID NO: 405240 - DNA, 558 bp, Homo sapiens
  misc_feature: GZ8MTXP01EU77G.21.55.E11.1.454.CMB.2.raw
  modified_base (222)..(222): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccgganaagtcacgacataaactacttttaatgtatcagcaacaaacaggaacgccccaaagctcctgatcgatgctgcatacctaagtttagagtaggtcgggtacccatcccccgaggttcaggtggacgaagtggcttcgtagggaactaaatttccactctacacctatccagcagtctacgactaactagtaagttatttagacctaaactttactaatttgaacaacgtagtaagttactagttactttccttctaccgttccggccgtaaggtaccttagtcgttataactaacaacgttcttaggtggtctcgacctacttacttcttgtttcc

SEQ ID NO: 405241 - DNA, 641 bp, Homo sapiens
  misc_feature: GZ8MTXP01B1U26.21.55.E11.1.454.CMB.2.raw
  modified_base (196)..(196): a, c, t, g, unknown or other
  modified_base (220)..(220): a, c, t, g, unknown or other
  modified_base (289)..(289): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgccgganaagtcacgaactaataaacttacttttaaatgtatcagacaacaaacgaggaacgaccccaaagctcanatcgatcgctagactaataccctaaagtttaggaggtacggttcggggtacccctagttaccccgtagggttcagggtcggacgtaagttagggtaacttggtaacgggtaaactaaactttccaaccttctaccaactactacagtctaagtctacgaacctaaacgtagtaaacgttactttacgaacttaactttaacttaagtttacgtaactaaacgtagtaacgttaactagtttaccttttaccgttaccgtaaccgtttccgggacccgttaagggtaaccttaaggtcgttaattaactaacgaaagttcttggtcgactcgccacttacttcttcgttaacc

SEQ ID NO: 405242 - DNA, 701 bp, Homo sapiens
  misc_feature: GZ8MTXP01CNT1D.21.55.E11.1.454.CMB.2.raw
  modified_base (225)..(225): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaactcacctatttagttgaccgganaagtcacgaactaataaactacttttaaatgtatcagacaacaaacgaggaacgacccaaagctccagatcgatcgctgactactacctaaagtttaggaggtacggttacggggtaccctagttacccccgtaggttacgaggttacgggaccggtaaagttcgggtaacgttacggttaacggggtaaaccttaaaacgttttccaacttccttaaccaaccctatccgaagtcctaacgttacctacgaacctaaaccgtagtaaacgttactttacacttaaactttacttaacgttacgtaacaaacgtagttaacgttaacgttacgtttactttcccgttttactaccggtttaccggtcccggtaacgggtaaacccgttaagttacttaacgttaaaccgtaccgttaaaaccggttcgttcgggttaacgaccgttcactaccttacgtttcttaacgtttaaccc

SEQ ID NO: 405243 - DNA, 581 bp, Homo sapiens
  misc_feature: GZ8MTXP01BQB4V.21.55.E11.1.454.CMB.2.raw
  modified_base (219)..(219): a, c, t, g, unknown or other
  modified_base (250)..(250): a, c, t, g, unknown or other
  modified_base (334)..(334): a, c, t, g, unknown or other
  modified_base (385)..(385): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccganaagtcacgacataaacacttttaaatgtatnagcacaaacaggaagcccaaagctctgatcgatgctgcatcaaatttagagagtgggtccatccccaggttcagtgcgaatggntctgggaacaaatttcaactctacaccatcagcagtctagacaacctgaanattttgactaaacctttatatttagtaccaaatagtaagttacaaggtttaactttccctttcggaacctttttcgggcccctttaagggggaacccttaaaggttcgaaagtttaactaacaaaaaacccgggttaactttgggtaagggcccctttgggtaccgtacccgaaacgttaacccgttttcgttaac

SEQ ID NO: 405244 - DNA, 600 bp, Homo sapiens
  misc_feature: GZ8MTXP01C1N59.21.55.E11.1.454.CMB.2.raw
  modified_base (219)..(219): a, c, t, g, unknown or other
  modified_base (411)..(411): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganaagtcaacgacataaactacttttaatgtatcagcaacaaacgaggaacgaccccaagctcctgatcgatgctgcatctaagttagagtagtcgggtccagtccccaggttcaggtggacgtaagtgggtaatcgtagggtaactaaaatttcacttcactaccatacagcagtcagacaactagtaaagtntttacgacttaacttacgtatttagtactaaacgtagttaagttaactagtttactttaccctttacgtaccgtttaccggcccgttaaggggtaacccgttaagttacccgaattaacgtaacgttaaaacccgttagttcggtaacggtaccttaacggacctaacccttacttccgttcgttaacc

SEQ ID NO: 405245 - DNA, 595 bp, Homo sapiens
  misc_feature: GZ8MTXP01BMFF0.21.55.E11.1.454.CMB.2.raw
  modified_base (290)..(290): a, c, t, g, unknown or other
  modified_base (400)..(400): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattatttgccggacaagtcacgacaataaactacttttaaatgtatcagacaacaaacgagggaacgaccccaaagcctccngatcgatcgctgcaatcctaaagtttaggagtacggtcgggtacccagtccccgtaggttcaaggtggacgtaatgggtaatcgtagggaactaattcactctcacatcngacagtctacgactaactgaaattctttagacttaaactttacgtattacgtacaaacgtagtacgtactagttactttcctttactaccgtttccggacccgttaagggtaaccgttaaggtccaaagttaacgtaccttaaaacggttcttggttaacggcttaacgccctaaccttacgttccgttcgttcc

SEQ ID NO: 405246 - DNA, 844 bp, Homo sapiens
  misc_feature: GZ8MTXP01AQZMD.21.55.E11.1.454.CMB.2.raw
  modified_base (202)..(202): a, c, t, g, unknown or other
  modified_base (224)..(224): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcactccctgtctgctatcgtgtacgganacagactcactattattgcganagtcacgactaataacttactttaatgtatcagacaacaaacgaggaacgacccaagctctagactacagtcgctacgactactacgtaaagtttaggaggtaggttccgggtacccagttacccccggtaggttacgagggttacgggacgttaaagggttacgggtaacgttaccgggtaaaacggggtaaaccctttaaaaccgtttttcccgaaaccctttacccttaaaccccgtaaaccccttaatttacccgaacgtacgttaacccgggttaccttaaccgggtaaaccccttaaaccgttaagggttaaacgtttaactttaaaccggtaaactttaaaccccgttttaatttaaacgtttacggtaaaccttaaacgggttaaaggttaaaccgttttaaaccttaaaggttttttacccctttaaccgtttttaccccgtaccggtttttaccccgggacccccgggttttaaaggggaaaccccgttaaaggggttaacgttaaacctaaacgggttaacccgttaaaaacccgggttgtttacgggggttaaccaacccgtttgaaaccccggttacgttacctttaacggtttccgtttaaccccg

SEQ ID NO: 405247 - DNA, 644 bp, Homo sapiens
  misc_feature: GZ8MTXP01BKY0T.21.55.E11.1.454.CMB.2.raw
  modified_base (197)..(197): a, c, t, g, unknown or other
  modified_base (219)..(219): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcactccctgtctgcatctgtcgganacagaatcactattattgcganagtcacgacaataaactacttttaatgtatcagacaacaaacgaggaacgacccaaagctcctgatcgatcgctgactactacctaagtttaggagtaggtcggggtacccagtccccgtaggtcgaggtcggacgtaagtggtaagtcgtagggaaacttaaactttccgacttctaccacctataccagacgtattcgtacgtacctaacgtagtaacgttatttacacttaaacctttacggtatttacgtaacaaacgttagtaaacgtttactacgtttaacttttcccgtttaccttccgttttacccgggcccgttaacggggtaaccttaaacgggttacaaacttaacgtaaacgttaaacccggttagttcgggtcggacgttccacccgtacttctttccgtttcgtttaaccc

SEQ ID NO: 405248 - DNA, 574 bp, Homo sapiens
  misc_feature: GZ8MTXP01DK17J.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattatttgccggacaagtcacgacaataaactaccttttaaatggtaatcagcacaaaccgaggaacgccccaaagctcctgatcgatgctgcatcctaatttagagtagtcgggacccagtccccaggttcagtggcgaatggaatcgtagggaactaatttcactctacacatcagcagtctagactaacgtgaagttatttagactaactttagtattgtacaaacgtagtacgttactagttaactttccttactacgtttccggcccgtaagggtacccgttaagtcccgttaaattaacgtaccgaaaacgttacttcggtcggtactcgacctacccttagtttccttcgtttaaccc

SEQ ID NO: 405249 - DNA, 617 bp, Homo sapiens
  misc_feature: GZ8MTXP01BDOLT.21.55.E11.1.454.CMB.2.raw
  modified_base (221)..(221): a, c, t, g, unknown or other
  modified_base (412)..(412): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccgganaagtcacgacataaactaccttttaaatggtatcagcaacaaaccgagggaacgccccaaagctcctgatcgatgctgcatccaatttagagtagtgggtccagtccccaggttcaggtggcgaatgggaatcgtagggaactaaatttcactctacaccatcaagcagtctacgactaaccgtgaaagtntttacgacttaaactttacgtatttagtactaaactagtaacgtttactaagtttaactttcccttttactaacccgttttccgggccccttaagggggtaacccgttaaacggttccgttaaagttaacttaacccgaaaaccggttaacgttaggttaacgggaccttcggaccctaccgttaacttccgttcggtttaaccc

SEQ ID NO: 405250 - DNA, 763 bp, Homo sapiens
  misc_feature: GZ8MTXP01DM0DQ.21.55.E11.1.454.CMB.2.raw
  modified_base (221)..(221): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgacccagtctccatcactccctgtctgcatctgtcggagacagatcactattattcgacganagtcacgataataaactacttttaatgtatacagacaacgaaacgaggaacgacccaaagctactagatcgatcgctagactaactacctaaagtttacggaggtaacgggttcgggtaccctaacgtcccggtacggttataggtcggacgtaagttacgggtaacgtacgttaacgggtaaaccttaaactttcctaaccgttacctaaccctaaaccgtaacttaccaaacgggtactaacggttcgtaaacgtaacccgtaaaccgttaacgggttaaagtttacgtttaacgtaaacctttaaacgtttaaaccgttaagtttaacggttaaacctaaacgttaacggttaaaccgtttaactaacggttttaaccctttttaccgtttacccgtttaacccggtttaccccggtaccggttaaacggggtaaacccgttaaacggtacgttaaacttaaacgtaaaccgttaaaaccggttcgttacggtaacgggtcttaaccggacctacccgttatttccttcgtttaacccc

SEQ ID NO: 405251 - DNA, 587 bp, Homo sapiens
  misc_feature: GZ8MTXP01AG16V.21.55.E11.1.454.CMB.2.raw
  modified_base (221)..(221): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaaccattattgccgganaagtcacgacaataaactacttttaaatgtatcagacacaaacaggaacgaccccaaagctctgatcgatgctgcatcaaatttagagagtcgggtccatcccaggttcagtggcgaatgggaatcgtagggaaactaaagtttcactctacaacctagtcagcagtctagacaaacgtgaaacgttattttagaccttaaactttactaattacgtacaaacgtagtaacgtttacaagtttactttcccttttcctaaccgttttcccgggccccgttaaggggaaccccgttaaaggttaccgaaagttaaacttaacaaaacggttacttgggtcgactcgacctaccattccttgttaacc

SEQ ID NO: 405252 - DNA, 558 bp, Homo sapiens
  misc_feature: GZ8MTXP01A2RXP.21.55.E11.1.454.CMB.2.raw
  modified_base (221)..(221): a, c, t, g, unknown or other
  modified_base (288)..(288): a, c, t, g, unknown or other
  modified_base (365)..(365): a, c, t, g, unknown or other
  modified_base (423)..(423): a, c, t, g, unknown or other
  modified_base (529)..(529): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccgganaagtcacgacaataaactacttttaaatgtatcagacaacaaacgagggaacgaccccaaagctccngatcgatgctgactatacctaaagtttaggagtaggtcgggtcccagtccccgtaggttcaggtggacgtaagtggntcgtagggaactaaatttcactctacacatcagctagtctagacctaactgtaaattntttacgacttaactttacgtaattcgtaacaaacgtagtacgttatacgtttactttccttacgtaccgttcgccgtaagggacccttagtcatacacaaacgttnttgtaagctaagcctacttactcttgtcc

SEQ ID NO: 405253 - DNA, 614 bp, Homo sapiens
  misc_feature: GZ8MTXP01EKFIK.21.55.E11.1.454.CMB.2.raw
  modified_base (201)..(201): a, c, t, g, unknown or other
  modified_base (260)..(260): a, c, t, g, unknown or other
tcagtcgtcgctcgcacgaccggtgctcgatttagcactcgcacgttgggtttgggagagtcagtctcagtcaggacacagcatggacatgagggtccccgctcagctccgtggggctcctgctactctggctccgaggtgccagatgtgacatccagatcgacccagtctccatcactccctgtctgcatctggtcgganacagaatcaactattattcgaccggacaagtcacgacaataaactacttttaaatgtancagacaacaaacgagggaacgaccccaaagctacctgactcgatgctgacactactaagtttagagtaggtcgggtacccagtccgtaggttcaggtcggaacgagtggatcgtaggaactaaactttcactctacacctatcagctagtactcgactaacgtagtaagtattttacgaacttaaacgtttacttaagttcgtaacaaacgtaggtaaacgtttactaaagtttccttttaccctttacgtaacccgttttcccgggaacccgtttacgggggaaacctaaacgttcgtaaactaacttaacgaaaacgttcgtaagtcggtaactacgccaactcgttcgtcg

SEQ ID NO: 405254 - DNA, 617 bp, Homo sapiens
  misc_feature: GZ8MTXP01DP0RE.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccgacagtcacgacaataaactacttttaatgtatcagacaacaaacgaggaacgaccccaaagctctgatcgatgctgactatacctaaagtttagagtacggtcggggtacccagtccccgaggttcaggtggacgaagtggaagtcgtagggaactaaactttcactctacactatcagctagtctagacctaacgtagtaagttatttacgaaccttaaactttacttaatttacggtaactaaacgtaagttaagtttaactaagtttacctttaccttttaccgtaccgttttccgggcccgttaaggggtaacccgttaaaggtccttaaagttaaactaacgttaaaacgttacgttgggtcgtctcgacctacttacttcgttaacgttccc

SEQ ID NO: 405255 - DNA, 633 bp, Homo sapiens
  misc_feature: GZ8MTXP01ERUPP.21.55.E11.1.454.CMB.2.raw
  modified_base (197)..(197): a, c, t, g, unknown or other
  modified_base (222)..(222): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattcgaccganagtcacgactaataactactttaatgtatcagacaacgaaacgagggaacgacccaaagctccgtagatcgatcgctgactatacctaaagtttaggagtacggtcggggtaccctagtccccgtaaggttcgaaggtcggacgtaagtacggtgtacggtagggaaaccttaactttcctaaccttctaccaactacttacgacgtactacggtcttacgaccttaaactagggtaattactttacgaactttaaacctttagttacttacgtaacaactaagttacttaacttatttactttccttacgttaccgttccgccggtaacgggtaacttaggtaccttaatacgtaaacttaacgttacgttcggttaacggctaacgctaaccctttcttccgttcgtcc

SEQ ID NO: 405256 - DNA, 615 bp, Homo sapiens
  misc_feature: GZ8MTXP01EJ51H.21.55.E11.1.454.CMB.2.raw
  modified_base (199)..(199): a, c, t, g, unknown or other
  modified_base (225)..(225): a, c, t, g, unknown or other
  modified_base (589)..(589): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcactccctgtctgcatctgtcgganacagaactcactattattgaccgganaagtcaacgacaataaactacttttaaatgtatcagacaacaaacgaagggaacgaccccaaagctacctagactcgatgctgctatacctaaattagagtacggtcggggtaccctagtcccgaggttcaggtggacgtaagtggtaagtcgtagggtaaactaatttcaactctacaaccatacagctagtctacgtacctaacgtagtaaacgttatttactaacttaacttaacggttatttacggtaacctaaagtacgttattaacgttagttaactttcctttaccgttacgttccggtcccgtaagggtaaccgttaagtaccgttaataactaacaaacggttacttgggtaacncgtcgacctacttacttcttcgttcc

SEQ ID NO: 405257 - DNA, 762 bp, Homo sapiens
  misc_feature: GZ8MTXP01C5MGJ.21.55.E11.1.454.CMB.2.raw
  modified_base (196)..(196): a, c, t, g, unknown or other
  modified_base (224)..(224): a, c, t, g, unknown or other
  modified_base (297)..(297): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgaccagtctccatcatcctgtctgcatcgtggtacganacaagatcactatttattcgaccggaanaagtcaacgactaattaaaacttaccttttaaatggtatcagacaacaaacgaggaaccgacccaaagctacngactcgatgtactgactatacctaaagtttacggagtacggtccggggtacccaagttcccgagggtttacaggttgggacctaaggtaggtaacgtacgttaacggggtaaacttaaacgtttccgaacttcctaaacctaccctaagttccaaacggctacggttactaacggtaccctaaacgttagggtaaacgtttactttaacggtaaccttaaaaccgttttcggggtttaaaattttacggggtaaacctaaaccggttaaaggttaaaccgtttaaactacgggtttttaaacctttccctttaaccgttaacccggtttaccggggtacccgtttaacgggggtaaaccttaaacggggttacccttaaagttaaaccgtttaacgaaaccgttaacggttcggttaacgggtacctccggtacctaacccgtttacgtttaaccgttcgttccg

SEQ ID NO: 405258 - DNA, 543 bp, Homo sapiens
  misc_feature: GZ8MTXP01BLGJE.21.55.E11.1.454.CMB.2.raw
  modified_base (219)..(219): a, c, t, g, unknown or other
  modified_base (226)..(226): a, c, t, g, unknown or other
  modified_base (251)..(251): a, c, t, g, unknown or other
  modified_base (384)..(384): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctcatcatccctgtctgcatctgtcggagacagaatcactattattgccganaagtcanacaataaactacttttaatggtatnagcacaaacgaggaagccccaaagctcctgatcgatgctgacatcccaatttagagtagtcggggtcccatcccccgaggttcaggtcggcgaatgggaatcgtaggggaactaatttcgactctaccactancaagcagtctagactaactgaaagtatttgacttaaccttattaacttagttacaaacagtaacgttacagtttaccttcgtttacctacgtttccgccgtggtaccgttagtcgatacgtacaaagacttgtaaggactgacacactcttaagtttcc

SEQ ID NO: 405259 - DNA, 764 bp, Homo sapiens
  misc_feature: GZ8MTXP01B83CT.21.55.E11.1.454.CMB.2.raw
  modified_base (200)..(200): a, c, t, g, unknown or other
  modified_base (222)..(222): a, c, t, g, unknown or other
  modified_base (301)..(301): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgacccagtcctccatcactccctgtctgcatcgtgtcgganacagaatcactattattgcganagtcagactataaactacttttaatgtatcagacaacaaacgagggaacgtccccaaaggtcctacctagataccggtntacgtctaggacctaacttacccgttaaagtttagggaacggttacggtaccggggtttacccccagtttaccccgaacgggttttaccgagggttacgggaccggtaagttacgggtaacgttacgtaaacggggtaaaccttaaaacgttttcaacccgttcttaaccccggtaacccattaacccgacgtacgtacgtaccgtaacgtaaccgttaacgttaagttaacgtttaacgtttaccgtaaacctttaaacgtttaacgtttacgtttaacgtaactaaacggttaacgttaacgtttacttaacgtttacccttttaccgtttaaccgttaccggtttacccgggtcccggttaacgggtaaccgttaaggttacttaaacgttaaaccgtaaccgttaaacgttggttccgtaacggtactaaccgtccgtaccgttacttcgttcgttccg

SEQ ID NO: 405260 - DNA, 639 bp, Homo sapiens
  misc_feature: GZ8MTXP01APVU8.21.55.E11.1.454.CMB.2.raw
  modified_base (199)..(199): a, c, t, g, unknown or other
  modified_base (222)..(222): a, c, t, g, unknown or other
  modified_base (280)..(280): a, c, t, g, unknown or other
  modified_base (626)..(626): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcactccctgtctgcatctgtcgganacagaatcactattattgacganagtcacacaataaactacttttaatgtatcagacaacaaacgaggacgaccaagctcngatcgatgctagactactactaagtttaggagtacggtccgggtacctacgtcccccgtaggttacgtaggtcggacgtaaagttagggaacttcgtaacggggtaaacttaaacttttcaccttacctacaaccctagttaccaggtacctacgtcgtacgtaacctaacgttagtaacgttacgttttacgaacctttaaaccgtttattaacgttacgtaacctaaacgtaattaacgttactacgttttaccttccctttcgaaccgtttccgaccggtaagggaccttaaagtcgttaaataacgtaacgaaacgttcgttcggtgtcctcgactaccttntccgttcgtaacc

SEQ ID NO: 405261 - DNA, 792 bp, Homo sapiens
  misc_feature: GZ8MTXP01BFGUA.21.55.E11.1.454.CMB.2.raw
  modified_base (198)..(198): a, c, t, g, unknown or other
  modified_base (221)..(221): a, c, t, g, unknown or other
tcagtcgtcgctcgcacgaccggtgctcgatttagcactcgcacgttgggtttgggggagtcagtctcagtcaggacacagcatggacatgagggtccccgctcagctccgtggggctcctgctactctggctccgaggtgccagatgtgacatccagatgacccagtctccatcatccctgtctgcatctgtcgganacagaatcactattattgacganaagtcacgacaataaactacttttaaatgtatcagacaacaaaccgaggaacgaccccaaagctaccagatcgatcgactgactataccctaaatttaggagtacggtacggggtacccagtcccccgtagggtttacgaggtcgggtaccgtaaaagttcgggtaagttacggtaacggggtaaaccttaaaaacgttttccaaacctttcgttaacccaaaccctaaaggttacccaaagggacctaaacgggttcccttaacggacccgtaaaaccgttaggtaaaaggtttactttttaacggaacctttaaaacccgtttaaccgtttaaatttacggttaaacccaaaaacgttaaacgggtaaagtttaaaccttaaaggttttaaaccgtttttccccgtttttaaaccttaacccggttttttcccgggacccccgttaaggggggtaaaccccttaaagggttccgttaaaattaaacgtttaacccgaaaaacgggttaaccttgggttaacggccgttaacgtaaccgaacccgttatttcccgtttcgttttaacccc

SEQ ID NO: 405262 - DNA, 615 bp, Homo sapiens
  misc_feature: GZ8MTXP01BK5K5.21.55.E11.1.454.CMB.2.raw
  modified_base (328)..(328): a, c, t, g, unknown or other
  modified_base (340)..(340): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgaccaagtctccatcatccctgtctgcatctgtcggagacagaatcaccattatttgccggacaagtcacgacaataaactaccttttaaatgtatcagcacaaaccaggaacggccccaaagctctgatcgatgctgcatccaatttagagagtggccatcccaggttnagtgcgaatggntcgtgggacaaatttcactctcaccatcagctagtctacgacctaaacctgtaaagttattttcgacttaaacctttacgttaactttaggtacctaaacgtaagtaacgtttaaccgtagttttaacctttccctttactaacccgtttttccgggaccccgttaaggggtaacccggttaaagtaccgttaaacgttaacttaaccgttaaaaccgttaaaccgttggttaacggacgttaaccggcctaccgactttccgttgtttaacccc

SEQ ID NO: 405263 - DNA, 692 bp, Homo sapiens
  misc_feature: GZ8MTXP01CZHWC.21.55.E11.1.454.CMB.2.raw
  modified_base (200)..(200): a, c, t, g, unknown or other
  modified_base (280)..(280): a, c, t, g, unknown or other
  modified_base (305)..(305): a, c, t, g, unknown or other
  modified_base (312)..(312): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgacccagtcctccatcactccctgtctgcatcgtgtcgganacaagaactccaacctaatttagttcggaccggaactaacgtcaacgaactaaacttaaacttaacttttaatgtatcanacaacaacgaggacgaccaagctcngatcgancgctagacactactaagtacgagtacggtcggtacctagtaccccgtaggttacgaggtcggacgtaagtacggtcgtacgtagggtaaacttaacgttccactacctacaacctatacgacgctacgttccgacgtaacctaacgttagtaacgttacttacaacttaaacctttagttacgttacgtaaactaacgtaagttaacgttaacttacgtttaacctttccgtttaaccgttaccggttacccggtaaccggttaaccggggaaaccgttaaggttaccgttaaactttaaacgaaccgttaaaacccggttcgttacgggttaacggtcttaaccgaccctaccttacgttcccgttaacgttttaaccc

SEQ ID NO: 405264 - DNA, 562 bp, Homo sapiens
  misc_feature: GZ8MTXP01DP87B.21.55.E11.1.454.CMB.2.raw
  modified_base (218)..(218): a, c, t, g, unknown or other
  modified_base (228)..(228): a, c, t, g, unknown or other
  modified_base (278)..(278): a, c, t, g, unknown or other
tcagtcgtcgctcgcacgaccggtgctcgatttagcactcgcacgtttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagatcacattattgcganaagtcacganataaacacttttaaatgtatcagcacaaacaggaacgccccaaagctccngatcgatgctgcatcaaattacgagagtgggccataccccaggttcagtggcgaatggaatcgtgggaactaaattcactctacacatcagcagtctgcaactgaaagtatttcgaactaaactttacgtaatttcggttaaccaaataggtaactttaccaaggtttaaaccttttcctttacgtaaccgttttccgggccccgttaaggggaacccttaagtcgttaattaacgtacaaaacgttaccttggtaaggctcggacctacattcttaagtttcc

SEQ ID NO: 405265 - DNA, 588 bp, Homo sapiens
  misc_feature: GZ8MTXP01C5PA4.21.55.E11.1.454.CMB.2.raw
  modified_base (197)..(197): a, c, t, g, unknown or other
  modified_base (221)..(221): a, c, t, g, unknown or other
  modified_base (253)..(253): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctattattgccganagtcagacataaactactttaaatggtatcanacacaacgaggaacgccccaaagctcctgatcgatcgctgcatacctaatttaggagtacgtcggggaccctagtccccgaggttcaggtcggcgaagtggaagttcgtagggtaaaccttaagtttcactctacaccctatcaagtcacgttctacgactaacgtagtaaacgttctttacgaacttaactttactatttacgaactaacgtagtacgttacttagttactttccttcgtaccgtttccggcccgttaagggccgttaaagtcttaaatacgtacgttaaaacgttcttggtggtcctcgactaccttagttcttcgtttaacc

SEQ ID NO: 405266 - DNA, 582 bp, Homo sapiens
  misc_feature: GZ8MTXP01BPQ9W.21.55.E11.1.454.CMB.2.raw
  modified_base (170)..(170): a, c, t, g, unknown or other
  modified_base (199)..(199): a, c, t, g, unknown or other
  modified_base (220)..(220): a, c, t, g, unknown or other
  modified_base (295)..(295): a, c, t, g, unknown or other
  modified_base (360)..(360): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcnccatcatccctgtctgcatctgtacgganacagatcactattattgcganagtcacactaataactacttttaatgtatcagacaacaaacgagggaaccgacccaagctctagatcgatcgctnactatacctaagtttaggagtcggtcgggtaccagttcccgtaggttcgaggtgagtactaggtntccgtagggtaaactaaagtttccacgtaccaccactacgtacacggtctacgtctacgactaaacctgtaaacgttatttacgaacttaacttatactttacgaactaacgtagtacgttactattactttacttcctacgttccgacgtaagacgttagtacagttacaacgttaaccgttgttcggcgtactggtaccctacttgtaacgttcttaacc

SEQ ID NO: 405267 - DNA, 577 bp, Homo sapiens
  misc_feature: GZ8MTXP01D9MLP.21.55.E11.1.454.CMB.2.raw
  modified_base (220)..(220): a, c, t, g, unknown or other
  modified_base (252)..(252): a, c, t, g, unknown or other
  modified_base (281)..(281): a, c, t, g, unknown or other
  modified_base (573)..(573): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganagtcacactaataaactactttaatgtatcanacaacaaacgaggaacgaccccaagctcngatcgatcgctagctatacctaagttaggaggttacggtcgggtaccagttccccgaggttcgaggtcggacgtaagtacggtaacgtcggtaagggtaaacttaaacgtttccaacttctaccacctataccgagactacgtctaacgtacctaaacgttagaacgttactttacaacttaactttacgttaattacgtacaaacgtagtactaactagttactttcttacgtacgttcgcgtaagggacagtcatactacaacgttcttgtgctcgactattactcgttnttcc

SEQ ID NO: 405268 - DNA, 529 bp, Homo sapiens
  misc_feature: GZ8MTXP01BUP4R.21.55.E11.1.454.CMB.2.raw
  modified_base (247)..(247): a, c, t, g, unknown or other
  modified_base (405)..(405): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgcgacagtcagacataaactacttttaatgtatnagcaacaacgaggaacgcccaaagctctgatcgatgctgcatccaatttagagtaggtcgggtcccagtcccgaggttcaggtcggcgaagtgggaattcgtagggtaactaaagtttccaactctacactagtcagctagtctagacaactgaagtntttgacttaacttatattgtacaacgagtagttacagtttacttcttctacgtttccggcctgggaccgttagtcgttaatactacaaacgttcttaggtgctgccacttacttcttgttaacc

SEQ ID NO: 405269 - DNA, 615 bp, Homo sapiens
  misc_feature: GZ8MTXP01B8MWO.21.55.E11.1.454.CMB.2.raw
  modified_base (217)..(217): a, c, t, g, unknown or other
  modified_base (279)..(279): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgcganaagtcacgacataaactacttttaaatgtatcagcaacaaacgaggacgaccccaaagctcngatcgatgctgcatccaagtttagagtagtcggggtacccagtaccccgaggttcaaggtggcgtaaataggcttacgtagggtaaactaaagtttccaacgtctacaccctatccaagtctaacggttctacgacctaaactggtaaactattttacgaaccttaactttacgtaatttagtaccaaagtacgttaagttacctagtttaactttcccctttacgtaccgtttccgggcccgttaaggggtaaccccgttaagttaccgagtttaaactaacgttaaacggacttggtcggacttcggacctaccgttattcccgttaagtttcc

SEQ ID NO: 405270 - DNA, 780 bp, Homo sapiens
  misc_feature: GZ8MTXP01EXZMA.21.55.E11.1.454.CMB.2.raw
  modified_base (224)..(224): a, c, t, g, unknown or other
  modified_base (260)..(260): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtcctccatcactccctgtctgcatctgtcggagacagaactcactattattgaccganaagtcacgaacaataaactaacttttaatgtatcanacaacaaacgaggaacgacccaaagctactagactcgatcgctagacctaacttaccctaaagttttaacggaggtacggttccgggggtacccctaacgttcccccgtagggttacgtagggtcggacgtaagttagggtaacgttcggtaacgggtaaaccttaaacgttttaccaacccttacctaccctaacctacgttaccgtaacgaccgtaacgttccgttaacgtaacccgttaaaccgttagggttaaactttacgttttaacgtaaacctttaaaccttttaacggtttaacgtttaacggttaaacctaaacgttaaacggttaacgtttaaaccgtttaacgttttaaccttttaccccgttttccgttaaacccggttttcccgggtaaccccggttaacggggtaaacccgttaacgggtaaccttaaacgtaacgttaaaccgttaaacggttaacgttcggtaacgtaccgtctacctaccttactttcgtttcgtttaacccg

SEQ ID NO: 405271 - DNA, 602 bp, Homo sapiens
  misc_feature: GZ8MTXP01BPDCF.21.55.E11.1.454.CMB.2.raw
  modified_base (222)..(222): a, c, t, g, unknown or other
  modified_base (288)..(288): a, c, t, g, unknown or other
  modified_base (367)..(367): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctatttattgccganagtcacgacataaactacttttaatgtatcagcaacaaaccgagggaacggaccccaaagctaccngactcgatcgctgctatacctaatttagagtacggtcggggtcccatcccccgaggttcgaggtcggcgtaagtcgggnttcggtagggaactaaacgttttcacttctacaccatcagcagttctacgactaacctgtaatattttacgacttaactttactagtttcgtacaaacgtagtaacgttactagtttactttacctttctaccgtttccggcccggtaagggtaaccgttagtaccgttagtaactaccgttaaaacgttcgttacggtggtacgtcgactaccttagttccgttaacgtttccc

SEQ ID NO: 405272 - DNA, 751 bp, Homo sapiens
  misc_feature: GZ8MTXP01CFNV1.21.55.E11.1.454.CMB.2.raw
  modified_base (170)..(170): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcnccatcactccctgtctgcatcgtggtcggagacagaatccactatttattcgaccggaacaagtcaacgaactaaataaacttacttttaaagtgtatcagacaacaaacgacggaacgacccaaagcctctagactcgtatcgctgactactactaagttaggacggtacggtcgggtaccctagtacccccgtagggttacgagggtacgggtacgtaaagtacgggtaacgttaccgggttaaacgggtaaacctttaaaacgtttcccgtaaccttcccgtaaaccctaacccgtacttacgaacggtaccgtaagttacccgtacgtaaccctaaaccgttagttaaacgttactttacgtaaaccttaaaccgtttacgtttaacttaacggtaaacctaaaggtaacgttaacgtttaaccgttaactttaaccgttttccctttaaccgttacccggtttaccggtacccggttaacgggtaaccttacgttacgttaaataaacgtaaccgttaaaacggttcgttacggtggtacctcgtaacctacttacttaaccgttcgtttaacccg

SEQ ID NO: 405273 - DNA, 627 bp, Homo sapiens
  misc_feature: GZ8MTXP01AW2MO.21.55.E11.1.454.CMB.2.raw
  modified_base (226)..(226): a, c, t, g, unknown or other
  modified_base (293)..(293): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcactccctgtctgcatctggtcgagacagaactcactattagttcgaccganagtcaacgactaataaacttacttttaagtgtatcagacaacaaacgaggaaccgacccaagctccnatcgatgctagctataccgtaagttacgaggtacggtcgggtaccacgtacccgtaggtttacgaggtcggacgtaaagtgggtaacgtcggtaaacgggtaaaccttaaactttccgactacctacaacctagtacacgtctaagtcctacactaacgtagtaacttgttacacttaacgttataagttacgaactaacgtagtacgttactacgtttacctttccttacgtaccgtttcccggcgtaacgggtaaccaggtacttaacgtaacgtaacgaaacgttgttcgggtaacgacgttaaccgcctaacttctccgttcgttaaccc

SEQ ID NO: 405274 - DNA, 649 bp, Homo sapiens
  misc_feature: GZ8MTXP01DFHLM.21.55.E11.1.454.CMB.2.raw
  modified_base (200)..(200): a, c, t, g, unknown or other
  modified_base (262)..(262): a, c, t, g, unknown or other
  modified_base (356)..(356): a, c, t, g, unknown or other
  modified_base (372)..(372): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcctccatcactccctgtctgcatctgtcgganacagatcacctattattcgaccgacaagtcaacgactaataaactacttttaatgtatacanacaacaaacgaggaacgacccaaagctactagactacgatcgctagactatacctaaagttaggagtacggtacgggtccagtccccgtaggtnaggtgcgtaagtagtntcgtaggtaactaaattccaactctacactatcagactacgtcacgtacctaactaggtaacttagtttacgaaaccttaaactttaacgttaacgtttaacgtaaacctaaacgtaacgtaaacgttaacttaacgttttaacctttccgtttaccgtaccgtttcccgggtcccgtaaacgggtaaccgttaaacgttaccgaaattaaaccgtaacgttaaaacgttcgttacggtcggtactaacgtaccctacttacgttcttcgtttaacc

SEQ ID NO: 405275 - DNA, 614 bp, Homo sapiens
  misc_feature: GZ8MTXP01AXD8V.21.55.E11.1.454.CMB.2.raw
  modified_base (197)..(197): a, c, t, g, unknown or other
  modified_base (263)..(263): a, c, t, g, unknown or other
  modified_base (575)..(575): a, c, t, g, unknown or other
  modified_base (596)..(596): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctatttattgaccggaacaagtcaacgactaattaaactacctttttaaatggtanacagacaacaaaccgagggaaccgaccccaaagtctcgtagactcgatgctgactactactaagtttacggaggtaggtcgggtacccagttccccgtaggttcaggtggactaagtagggaatcggtagggaaacttaacgtttcacttcgacaccataccagctagtctacgactaactgtaattactttacgacttaacttactattacgacagtaagttagttactagtttacttccgttactaccgtttcggcccgttaagggaaccttagggtaccttaataacgtaacccaaaggttcttacggngtcctaacgtacctaccgttnttaaccttcgtttaaccc

SEQ ID NO: 405276 - DNA, 887 bp, Homo sapiens
  misc_feature: GZ8MTXP01A1DFW.21.55.E11.1.454.CMB.2.raw
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgacccagtctccatcactccctgtctgctatcgtggtcggaacgacaagaactaccaaccttagtttacgttcggaccgtaactaacgtaccaacgtaactaaacttaaaacctttaacctttttaaagtacggtaatacgaacgaaccaaaccgaaaaccggaacggggaaacccgaaccccaaacggtcctaccgtaggtaactacgattcggcctacgactaacttaacccgttaaagtttacgggaaggtacggggttacccggggtaccctacgtccccggtaacggttacgagggtcggacgtaagtacgggtaactacgggttaacgggtaaaccttaacgtttccactaccttacccgaactactacgacggtactacgttcgtacaaccgtaacgtaagttaacgttacgttaaccgaactttaaaccctttaggttaacgtttacgaaaaccgtaaacgttaaacgtttaacggtttaaacctttaacggtttttaacccttttacccgtttaacccggtttacccggtttaacccccgggggtaacccgggtttaaaccgggggtaaaccccgtttaaacgggggttaaacccttaaaacgggtttaaaccgttaaaacccccgttaaaaggggtttaccgttacggggttaacccgggtctttaaccccgggaaccgtacccttaaccggtttccgtttaaccgttttaacccccg

SEQ ID NO: 405277 - DNA, 644 bp, Homo sapiens
  misc_feature: GZ8MTXP01DQ90I.21.55.E11.1.454.CMB.2.raw
  modified_base (199)..(199): a, c, t, g, unknown or other
  modified_base (224)..(224): a, c, t, g, unknown or other
tcagtcgtcgctcgcacgaccggtgctcgatttagcactcgcacgttgggtttgggggagtcagtctcagtcaggacacagcatggacatgagggtccccgctcagctccgtggggctcctgctactctggctccgaggtgccagatgtgacatccagatcgacccagtcctcatcactccctgtctgcatctgcgganacagactcactattattcgacgaanagtcaacgactaaactaaacttactttaatgtatcagacaacaaacgaaggaacgcccaagctctgatcgatcgctgactatactaaagtttagagtacggtcggtacctacgtacccgtagggttacgaggtccggtagtaacgtagtaacgtacgtacgggtaaaccttaaactttcccgacttactacctaacctagtacacgacgtacgttacgaacgtaacctaccgtaagtaacgtttacttacgtaaacttaacctttattagtttaactaaccgtaaacgttaattaccgttaataccgtttacgttttaccttcgttaccgttcggtaccggtaacggtaacgttagtacgaagttactaacgttaacgttagttacggtcgtacgtgactaccttagtccttcgttaacc

SEQ ID NO: 405278 - DNA, 671 bp, Homo sapiens
  misc_feature: GZ8MTXP01BQE0O.21.55.E11.1.454.CMB.2.raw
  modified_base (282)..(282): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcactccctgtctgcatctgtcggagacagaatcacctattattgcggacaagtcacgacaataaactacttttaatgtatcagcacaaacgaggacgacccaagctacngatcgatcgctagctataccctaagtttagaggttaggtcgggtaccctacgtccccgtaggttcgaggtcggcgtaaagttggcgtacggtagggaaacttaaagtttccaacttctaaccaccctattccgagtaccaggttacctacggaacccttaacgtaggttaacttagtttacaacctaaactttacttaaggtttactaacctaaacgtaagttaagtttacctaaggtttaaccctttccgtttaacccgtaccgttttaccgggaccccggttaacgggtaaaccgttaagttccggttaaacttacgtaacccgttaaaaggttaccttcgggggttcacccgttgaccccgtacttacttcggttaactttaaccc

SEQ ID NO: 405279 - DNA, 710 bp, Homo sapiens
  misc_feature: GZ8MTXP01BAHKF.21.55.E11.1.454.CMB.2.raw
  modified_base (196)..(196): a, c, t, g, unknown or other
  modified_base (219)..(219): a, c, t, g, unknown or other
  modified_base (230)..(230): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgccganagtcaacgtanataaactacttttaaatggtatcagacaacaaaccgaggaacgtaccccaaagtctactgatcgatgctgactatacctaagtttaggagtacggtcgggtaccctagtaccccgtagggtttacgaagggtcggtacgtaagtacgggtaacttcggttaaacggggaaaccttaaacgttttcccgaacttaccgtaacctaacctaacgttacctaacggacctaacgttaccgtaacgtaacccggtaaactaccggtaaagttacgtttacgaaccttaaacgttttaaccttaagtttacggtaacctaaacgtaaggttaaaccttacggtagttttaacctttccgtttaccgtaccgttttacccgggacccgttaacgggtaaccgttaacggttacgttaacttaaacgtaccgttaaacgttcgttagcggtacgtaacgaccctaacgttacgttcttaacgtttcc

SEQ ID NO: 405280 - DNA, 721 bp, Homo sapiens
  misc_feature: GZ8MTXP01AKEKE.21.55.E11.1.454.CMB.2.raw
  modified_base (196)..(196): a, c, t, g, unknown or other
  modified_base (219)..(219): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgacccagtctccatcatccctgtctgcatctgtcganacagactcactattattgacganagtcacgactaataactacttttaatgtatcagcaacaaacgaggaacgcccaaagctcctgactcgatcgctagactatacctaagtttaggagtacgggtacgggtaccacgtcccgaaggttcgaggtgggaccgtaaagttcgggtaagtccgtaaggggtaaaccttaaacgtttccacgttacctacctacctagttacgacgtactacggtactaccgtaacctaacgtacggttaagttacgtttacgtaaactttaaaccttacggttaacgttacggttaacctaaacggtaaacgttacgttaacgttaacggtttaactttaccctttaccgttacccgtttacccgggtacccggttaacggggtaaacccgttaacggttaaccgttaaacgttaaaccgtaacccgttaaaacggttacggttaccggtaacgggtacttaacccgacgttaacccttacggtttaaccgtttccggtttaaccccg

SEQ ID NO: 405281 - DNA, 642 bp, Homo sapiens
  misc_feature: GZ8MTXP01ADXNL.21.55.E11.1.454.CMB.2.raw
  modified_base (198)..(198): a, c, t, g, unknown or other
  modified_base (256)..(256): a, c, t, g, unknown or other
  modified_base (261)..(261): a, c, t, g, unknown or other
  modified_base (294)..(294): a, c, t, g, unknown or other
  modified_base (585)..(585): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcactccctgtctgcatctgtcgganacagactcactattattcgcgaacagtcacactaataaacttacttttaatgtatcanacaanaaccgaggaacgacccaagctctgatcgatgcngactactactaagttaggagtacggtcgggtccacgttaccccgtggttacgtagggtggaccgtaagttacgggaacgttcgtaacgggttaaaccttaatttacctacctttacctacctaacctactacctacgggtactacggtacttacgaaccgtaaccgttagtaacgttactttacgtaaccttaacttacgttaattacgtaactaacgtaagttaagttacgtacgtttacctttccttacgttaccgtttccggaccggttaacgggaacttacggtacncgttaaactacgaacgagttcgtaaggcttcgacctacttcttccgttcgttaaccc

SEQ ID NO: 405282 - DNA, 639 bp, Homo sapiens
  misc_feature: GZ8MTXP01AO9K9.21.55.E11.1.454.CMB.2.raw
  modified_base (217)..(217): a, c, t, g, unknown or other
  modified_base (281)..(281): a, c, t, g, unknown or other
  modified_base (290)..(290): a, c, t, g, unknown or other
  modified_base (352)..(352): a, c, t, g, unknown or other
tcagtcgtcgctcgcacgaccggtgctcgatttagcactcgcacgttgggtttgggggagtcagtctcagtcaggacacagcatggacatgagggtcccgctcagctcctggggctcctgctactctggctccgaggtgccagatgtgacatccagatcgacccagtctcatcactcctgtctgcatctgtcgagacagactcactattatcgcganacgtcacactaataaacttacttttaagtgtatcagcaacaaacgaggaacgcccaaagctacngactgagcnctgactatactaagttagagtcggtcggtccacgtccgtaggttcaggtcgacgtagtcggngtcggaggtaaccttaaactttcactactacaacctattaccgaagctacgttacgacgaacctaacgtattaaacgttatttacgtaacttaaacgttacttagttacgtaaactaaacgtacggttaacgttaacgttacgtttaccttttaccgttacgtttaacccggttccggtaccccgggtaagggtaaacccgtttaaaggtcttaaacgttaacgtaaaccgttaaacgttacgttgggttccacggttaacaccctacgttcttcttaacgtttccc

SEQ ID NO: 405283 - DNA, 672 bp, Homo sapiens
  misc_feature: GZ8MTXP01CF4X0.21.55.E11.1.454.CMB.2.raw
  modified_base (220)..(220): a, c, t, g, unknown or other
  modified_base (225)..(225): a, c, t, g, unknown or other
  modified_base (230)..(230): a, c, t, g, unknown or other
  modified_base (252)..(252): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatccactattattgcganaagtnacganataaactactttaatgtatcancaacaacgaggaagaccccaagctcagatcgatgacttgctactactaagtttaggagtaggtacgggaccagtaccccccgtaggttacgaggtggcgtaaacgtgggtgttacgtacggggtaaactaaacgtttccaacctttcactaccagttacggactacgaacgtcgtacgtaaccgtaaccgttaagtaaaggttacttttaaacggactttaaaccggttaactttagtttacgtaaaccttaaacgtaaggtttaacccgttaaatagtttttaccttccttttaacggttacccgtttccggtaacccggtttaacgggaaacccgttaggtacccttaaggttaaacaccgttaaagttaaccgttgtaacgggtctaaggtcctaccggttattaaccgttgtaacc

SEQ ID NO: 405284 - DNA, 684 bp, Homo sapiens
  misc_feature: GZ8MTXP01BIC7T.21.55.E11.1.454.CMB.2.raw
  modified_base (654)..(654): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgaccagtctccatcactccctgtctgctatcgtggtacggaagacaagtaactcctaaccttaatttacgttcggaccggtaacaacggtaccaacgtaacttaaaacttaaaacctttaacctttttaaagttggtaactacgaacgacaaaccaaaccggaacgggaaaccggaccccaaagcctacgtagactcgatcgactgactaataccgtaaagttaggaggtacggtaccgggtacctaacgtcccgtaggttacgaggtcggacgtaagtcgtaagtcgtaagggtaaacttaacgttccactactacactatacacgctaagtctacgactaacgtagtaacgttacttagtaacttaacttagtacttagtaacctaagtagtaacgttacttacttaaccgtttccttacgttaccgttccgggaccgttaacggaaccgttaggtacttactaacgtaacgaacgttgttcgtaagtccgtnacccgtacttgttaaccgttcgttaacccg

SEQ ID NO: 405285 - DNA, 595 bp, Homo sapiens
  misc_feature: GZ8MTXP01DZ5TQ.21.55.E11.1.454.CMB.2.raw
  modified_base (199)..(199): a, c, t, g, unknown or other
  modified_base (221)..(221): a, c, t, g, unknown or other
  modified_base (227)..(227): a, c, t, g, unknown or other
  modified_base (248)..(248): a, c, t, g, unknown or other
  modified_base (250)..(250): a, c, t, g, unknown or other
  modified_base (268)..(268): a, c, t, g, unknown or other
  modified_base (272)..(272): a, c, t, g, unknown or other
  modified_base (277)..(278): a, c, t, g, unknown or other
  modified_base (581)..(581): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgacccagtcctccatcactccctgtctgcatctgtcgganacagaatcactattattgcganagtcanacataactacttttaatgatnancacaacaggacgcccaanctcnatgannctagctatacctaagtttagagtacggtcggtacccagtccccgaggttcgaaggtggacgtaagtggaacttacggtagggtaaaccttaaacgttttccaactcgttaccaccctatcgacgtcctagttctacgacctaactaggtaaattagtttacaacttaactttacttatttacgtaactaacgtaagttacgttaactacgtttaactttcccgtttactaccgtttcccggaccgtaaggaccgttaagtccgttaatacgtaacgaaacgttgttacgcggtactcgctacnttcgttcgttaacc

SEQ ID NO: 405286 - DNA, 834 bp, Homo sapiens
  misc_feature: GZ8MTXP01A9BLV.21.55.E11.1.454.CMB.2.raw
  modified_base (202)..(202): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgacccagtcctcatcactccctgtctgctatcgtggtacgganaacaagtaactacctaaccttagttttacgttcggaccggtaactaacgtacaacgtaacttaaacttaaaacctttaacctttttaaagtcggttaatacgaacgaaccaaaccgaaaccggaacgggaaccgaccccaaagtccttaccgagtacgtcgaatcgtaccgtcgtaactacgttaacccgttaaagtttacggaacggttaccgggttacccgggtacccctacgttaacccccggttacgggtttacgtaacggggtacgggtacggttaaacgttaacgggtaacgttaaccggggttaaacgggtaaaacctttaaacgtttcccgaaacccttacgtaaccctaacgtactaaccgtacgtaccgtacgtaacgtaccgtaacctaaaccggttagttaacgttacttaacgtactttaaacttacttaacgttagtaaaccctaagtaagttaacgttaacttaccgttttacctttccgttaaccgttacccgttacccggccgggttaacgggtaaaccttacgggttacttaaagtaacccgtaaaacgttaaccgttggttacgtaacggtcctaacgtaccctaacgttcctttaacgttccgtttaacccg

SEQ ID NO: 405287 - DNA, 705 bp, Homo sapiens
  misc_feature: GZ8MTXP01CNCH4.21.55.E11.1.454.CMB.2.raw
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatcgtgtcggaagacagaatccaccatttattcgaccggaacaagtcacgaactaattaaactacttttaaatgtatcacgcaacgaaacgaggaacgacccaaagctacctgactcgatcgctcgactactcctaaagtttaggaggtacggttacggggccctacgtacccccgtaggtttacaggtggaccgtaaagtcggtaactcgtaagggtaaacttaaacgttccaaccgttacctccgaaacccttataccgtaacgtacgtacgttccgtacgtaaccctaaacgtagtaaacgtttactttaacgtaaccttaactttaacgtttagttaacgttaaccgtaaagtaacgttaacgtttaacttacgttttacccgtttaccgtttccgtaacccggtttccggtacccggtaacgggtaaaccgttagttaccgttaagttaaaccgtaacgttaaaccggttcgttacggtaacgtcgttcaacctacttacgttcgttcgttaacc

SEQ ID NO: 405288 - DNA, 617 bp, Homo sapiens
  misc_feature: GZ8MTXP01DTZ3I.21.55.E11.1.454.CMB.2.raw
  modified_base (200)..(200): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgacccagtcctccatcactccctgtctgctatctgtcgganacagaactcactattattcgaccgacagtcaacgaactaataaactacttttaaatgtatacagacaacaaacgaaggaacgacccaaagtctactagacgtacgatcgactagactactaccgtaagttaggaggttacggtccgggtacctagtccccgtaaggttcgaggtcggacgtaagtggtaagtcggtaagggtaaaccttaaatttccacttctaccacatcagctagtcagtacaacgtagtaaattacgtttacaacttaactttactaagttacgtaaacctaaacggtataacgtttaactattttacttcctttactaccgttccggccgtaaggacttagtacttaataactacgttaaacgttcgttgtcggactaacgactacttattcttcgtttaacc

SEQ ID NO: 405289 - DNA, 722 bp, Homo sapiens
  misc_feature: GZ8MTXP01C9USW.21.55.E11.1.454.CMB.2.raw
  modified_base (200)..(200): a, c, t, g, unknown or other
  modified_base (334)..(334): a, c, t, g, unknown or other
tcagtcgtcgctcgcacgaccggtgctcgatttagcactcgcacgttgggtttggggagtcagtctcagtcaggacacagcatggacatgagggtccccgctcagctccgtggggctcctgctactctggctccgaggtgccagatgtgacatccagatgacccagtcctcatcactccctgtctgctatcgtgtcgganacagaactcacctattattcgaccggactaagtcaacgaactaacttaaacttacctttttaaatcggtatacagacctaacgaaaccgagggaaaccggaccccaaagtcctacctagattaccgagtgcgtntcgtaactacccgttaaagtttacgaaggttacggtacgggggttacccaccgttacccccgtaagggtttcgaacggttcggaccgtaagttacggtaagtccgtaaaggggtaaacctaaacgttttccgaccgttacctacctacctaactactaacgtacgtaacgttcgtacgtaccgtaaaccgtagtaacgtactttacgacttaaacttacttagttacgttaacaacgtagtaacgttactagtttaacttctttaccgttacgttcccggtaccttccgggtaaacgttacgtacgttaacgttaacgtaacttaaaaccgttattaccggtaagtaccgtaacggtaccgtacccttagttcccttcgggtttaacc

SEQ ID NO: 405290 - DNA, 753 bp, Homo sapiens
  misc_feature: GZ8MTXP01BP4P0.21.55.E11.1.454.CMB.2.raw
  modified_base (102)..(102): a, c, t, g, unknown or other
  modified_base (229)..(229): a, c, t, g, unknown or other
  modified_base (302)..(302): a, c, t, g, unknown or other
tcagtcgtcgctcgcacgaccggtgctcgatttagcactcgcacgttgggtttgggggagtcagtctcagtcaggacacagcatggacatgagggtccccgntcagctcctggggctcctgctactctggctccgaggtgccagatgtgacatccagatgacccagtctccatcactccctgtctgcatctgtacggagacagaactccacctattattcgaccggaanaacgtcacgaactaaataaacttacttttaagtgtatcagacaacaaaccgagggaacgacccaaagctccgngatcgatcgctagactactactaaagtttaggacggtagggtaggggtaccaacgtaccgtaccgtagggtttcgaaggtggtaaccggagttggggaacttcgggtaacggggtaaaccttaaacttttcgaaccttcccttaaccacctacgttacgacgtaccgtacgtacgttacgaacctaaccgttagaagtttacgttttacgaaccttaaacgggtttaactttaagttaccgtaactaaacgtaggttaaacgtttaccggttaaacttttacctttcccgttttaacccgtttaccggtttccccggggtaacccgttaagggggaaaccccggttaaacggtttccggtaaatttaaccgttaaaccgttaaaacggttacccgtttgggtaccggtaacgtttccgacgttaaaccccgttcttttaaccgtttcccgg

SEQ ID NO: 405291 - DNA, 483 bp, Homo sapiens
  misc_feature: GZ8MTXP02FD4KM.21.55.E11.1.454.CMB.2.raw
  modified_base (343)..(343): a, c, t, g, unknown or other
  modified_base (372)..(373): a, c, t, g, unknown or other
  modified_base (375)..(375): a, c, t, g, unknown or other
  modified_base (377)..(377): a, c, t, g, unknown or other
  modified_base (391)..(391): a, c, t, g, unknown or other
  modified_base (472)..(472): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaactaccttttaaatgtatcagcacaaaccaggaagccccaaagctcctgatcgatgctgcatccaatttagagagtggggtcccatccccaggttcagtggcgatggntctgggacaaatttcactctcaccatcanntntnacactagtatattntactactactatatacaacagtagtactattacttcttctactcgtcgtacggacgagtacatactacaacactgtgcgcncacactctctc

SEQ ID NO: 405292 - DNA, 519 bp, Homo sapiens
  misc_feature: GZ8MTXP02IS87Q.21.55.E11.1.454.CMB.2.raw
  modified_base (337)..(337): a, c, t, g, unknown or other
tcagtcgtcgctcgcacgaccggtgctcgatttagcactcgcacgttgggtttggggagtcagtctcagtcaggacacagcatggacatgagggtcccgctcagctcctggggctcctgctactctggctccgaggtgccagatgtgacatccagatgacccagtctccatcatccctgtctgcatctgtcggagacagaatcaccattattgccgacaagtcacgacataaacaccttttaatgtatcagcacaaccaggaagccccaaagctcctgatcgatgctgcatcccaaatttagagagtcggggtcccatcccaggtcagtgcgatggntctgggacaaatttcatctcaccatcagcagtctgccaactgaaagtatttgactaaactttactatttgtacaaactagaagtttacagttacttccttttcaacttttccggcccttggggaacctaaagtcgtaattactccaaaacgtaactgtggactcgacaccattctacgtttc

SEQ ID NO: 405293 - DNA, 494 bp, Homo sapiens
  misc_feature: GZ8MTXP02IA6EB.21.55.E11.1.454.CMB.2.raw
  modified_base (340)..(340): a, c, t, g, unknown or other
  modified_base (438)..(438): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaatgtatcagcacaaaccaggaagccccaaagctctgatcgatgctgcatccaaatttagagagtggggtcccatcccaggttcagtggcgatggntcgtgggacaaatttcactctcaccatcagcagtctgcaacctgaagtattttgactaaactttactattgtacaacagtattacagttattcctttnactttcgcccttggacctaagtcgatactacaaacgtactgtgctgcacatctgtc

SEQ ID NO: 405294 - DNA, 496 bp, Homo sapiens
  misc_feature: GZ8MTXP02J1DI0.21.55.E11.1.454.CMB.2.raw
  modified_base (342)..(342): a, c, t, g, unknown or other
  modified_base (440)..(440): a, c, t, g, unknown or other
  modified_base (470)..(470): a, c, t, g, unknown or other
  modified_base (481)..(481): a, c, t, g, unknown or other
tcagtcgtcgctcgcacgaccggtgctcgatttagcactcgcacgttgggtttgggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaatggtatcagcacaaaccaggaagccccaaagctcctgatcgatgctgcatccaatttagagagtggggtcccatccccaggttcagtggcgatggntcgtgggacaaatttcactctcaccatcagcagtctgcaactgaagtattttgactaaactttactattgtacaacagtagttacagttatttccttnactttcgcccttgggacctagtcgattacncaaacgactgngctgcaccatctgtc

SEQ ID NO: 405295 - DNA, 532 bp, Homo sapiens
  misc_feature: GZ8MTXP02G6AXB.21.55.E11.1.454.CMB.2.raw
  modified_base (219)..(219): a, c, t, g, unknown or other
  modified_base (229)..(229): a, c, t, g, unknown or other
  modified_base (341)..(341): a, c, t, g, unknown or other
  modified_base (372)..(372): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccganaagtcacganataaacacttttaatgtatcagcaacaaacaggaacgccccaaagctcctgatcgatgctgcatccaaatttagagtagtcgggtcccatccccgagttcagtggcgatggntcgtagggaactaaatttcaactctacaccntcagcagtctgacaacctgaagtatttagactaaactttacatttgacaagagtattaacagtttacttcctttataccgtttcggaccccttagggaaccctaagtccgaaatactacgaaaacgtacttgtaagcctagaccacctatcgttagtacc

SEQ ID NO: 405296 - DNA, 568 bp, Homo sapiens
  misc_feature: GZ8MTXP02HCSZ3.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactaccttttaaatgtatcagcacaaaccaggaacgccccaaagctcctgatcgatgctgcatccaattagagagtgggtccatcccagttcagtggcgatggatctaggactaaatttcactctacaccatcagcagtctagacaactgaagtatttgactaacttactattgtacaaacagtagttaacagtttaacttcctttactaaccgttttccggaccccgttaggggtaaaccccgtaaggttacctaaattaacttaaccgaaaaaccgtaacgttcggtaaggtaccttacggacctaaaccctattacccgtttacgttacc

SEQ ID NO: 405297 - DNA, 576 bp, Homo sapiens
  misc_feature: GZ8MTXP02I0OF0.21.55.E11.1.454.CMB.2.raw
  modified_base (276)..(276): a, c, t, g, unknown or other
tcagtcgtcgctcgcacgaccggtgctcgatttagcactcgcacgttgggtttgggagtcagtctcagtcaggacacagcatggacatgagggtcccgctcagctcctggggctcctgctactctggctccgaggtgccagatgtgacatccagatgacccagtctccatcatccctgtctgcatctgtcggagacagaatcaccattatttgccggacaagtcacgacataaacacttttaaatgatcagcacaaacaggaagccccaaagctcngatcgatgctgcatccaatttagagagtggggtcccatccccagttcagtggcgatggatcgtagggaactaaatttcactctcaccatcagcaagtctagcaactgaagtatttgactaaactttactatttcgacaaacgagtaacttacagttaactttccctttactaaccgttttccggaccccttagggggtaacccgtaaagttaccggaaattaaacgttaaccaaaaacggttaaccgttagggttcgggacccttacggacctaaccctaagtttcccttaggtttaccc

SEQ ID NO: 405298 - DNA, 549 bp, Homo sapiens
  misc_feature: GZ8MTXP02GEIGN.21.55.E11.1.454.CMB.2.raw
  modified_base (197)..(197): a, c, t, g, unknown or other
  modified_base (219)..(219): a, c, t, g, unknown or other
  modified_base (337)..(337): a, c, t, g, unknown or other
  modified_base (364)..(364): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacattattgccganaagtcacgacataaactacttttaaatgtatcagcaacaaaccaggaacgccccaaagctctgatcgatgctgcatccaatttagagagtgggcccatccccagttcagtgcgatggntcgtggacaatttcactctcacatcancagtctagaccaactgtaacgtatttcgaacttaacttacttattagtacaaactaggtaattactagttactttccctttacgtaccgtttccggaccccgttaggggaaacccgttaagtccgtaataacgtaccgaaaacgtacgttggaacggtctacggacctaacctacttctacgttc

SEQ ID NO: 405299 - DNA, 475 bp, Homo sapiens
  misc_feature: GZ8MTXP02F0HYK.21.55.E11.1.454.CMB.2.raw
  modified_base (342)..(342): a, c, t, g, unknown or other
  modified_base (385)..(385): a, c, t, g, unknown or other
  modified_base (408)..(408): a, c, t, g, unknown or other
  modified_base (460)..(460): a, c, t, g, unknown or other
  modified_base (463)..(464): a, c, t, g, unknown or other
  modified_base (473)..(473): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacacctttttaaatggtatcagcacaaaccagggaagccccaaagctcctgatcgatgctgcatccaatttagagagtgggtcccatccccaggttcagtgcatggntctgggacaaattccatctcaccatcagcagtctgcaactganatttgacaacttactatgtcaanagattacagtattcttgactttcggcctggaccagtcatatcaaacgactgngcnncacactctntc

SEQ ID NO: 405300 - DNA, 507 bp, Homo sapiens
  misc_feature: GZ8MTXP02H67H0.21.55.E11.1.454.CMB.2.raw
  modified_base (333)..(333): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaatgtatcagcacaaccaggaagccccaagctctgatcgatgctgcatccaatttgagagtgggtccatcccagttcagtggcgatggntcgtggactaaatttcactctcacccatcaagcagtctagccaacctgaagtattttagctaaactttactattgtacaaacagtattacagtttaacttcctttactacgtttccggccctgggaccgtagtcgatactacaaacgtaactgtaaggctacgcacactctctc

SEQ ID NO: 405301 - DNA, 522 bp, Homo sapiens
  misc_feature: GZ8MTXP02G2TV4.21.55.E11.1.454.CMB.2.raw
  modified_base (341)..(341): a, c, t, g, unknown or other
  modified_base (394)..(394): a, c, t, g, unknown or other
  modified_base (447)..(447): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgacaagtcacgacataaactacttttaaatgtatcagcacaaaccaggaacgccccaaagctctgatcgatgctgcatccaaatttagagagtcggggtcccatccccagttcagtggcgatggntcgtagggactaaatttcactctcaccatcagcagtctgaccaactgaaagtntttgacttaaacttactattgacaaacagtaagttacagtttacttcctttanacctttcggacccttagggacctaagtcgaatactacgaaaacgtactgtcggctacgactaccattctcgtttc

SEQ ID NO: 405302 - DNA, 509 bp, Homo sapiens
  misc_feature: GZ8MTXP02J2O1N.21.55.E11.1.454.CMB.2.raw
tcagtcgtcgctcgcacgaccggtgctcgatttagcactcgcacgttgggtttgggggagtcagtctcagtaaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacacttttaaatgtatcagcacaaacaggaacgcccaaagctcctgatcgatgctgcatccaatttgagagtgggtccagtccaggtcagtggcgagtggattcgagggaactaaattcactctacaccatccagctagtctagacaacctgaagtacttttgactaaactttactattagtacaacagtagttacagttacttcctttcactttcgccgtggaccgagtcgatactacaaacgacgtgtacgctagcacctatcctagtctac

SEQ ID NO: 405303 - DNA, 550 bp, Homo sapiens
  misc_feature: GZ8MTXP02HDFYQ.21.55.E11.1.454.CMB.2.raw
  modified_base (219)..(219): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccganaagtcacgacataaacacttttaatgtatcagcacaaaccaggaacgaccccaaagcctctgatcgatgctgcatccaattagagagtcgggtacccatccccaggttcagtggcgatggatcgtaggactaaattcactctacacatcagcagtctagaccaactgaaagttatttcgactaaactttactatttgacaaactagtaacgttacaagtttaactttcctttactaccgtttcgggaccccgttagggaacccgtaagttcgtaaattaactaacgaaaacgtacttggtcggtcacggacctaactcttcctagtttacc

SEQ ID NO: 405304 - DNA, 541 bp, Homo sapiens
  misc_feature: GZ8MTXP02IUJQY.21.55.E11.1.454.CMB.2.raw
  modified_base (379)..(379): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccggacaagtcacgacataaacacttttaaatgtatcagcacaaaccaggaagccccaaagctcctgatcgatgctgcatccaaatttagagagtgggtcccatcccaggttcagtggcgatggatctgggaacaaaatttcaactctcaaccatcagcatctanacaactagtaagtatttatactaaacttaacttaattagtactaaacaagtaagtaactaattacttactttacttacgttacgtacgtacggtacgaacgtacgtaataactaactaaaacgtaaacgtacgtaagtacgtacgacactactacttactcg

SEQ ID NO: 405305 - DNA, 548 bp, Homo sapiens
  misc_feature: GZ8MTXP02F1K21.21.55.E11.1.454.CMB.2.raw
  modified_base (345)..(345): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaatggtatcagcacaaaccaggaagccccaaagctcctgatcgatgctgcatccaaatttagagagtggggtcccatccccagttcagtggcgatggatcngggactaaatttcactctcaccatcagcagtctgccaacctgaagtatttgactaaactttactatttgacaaacagtacgttacagttactttcctttacactttcggaccctaggggaacccgtaaagtccgtaaattacgttaccaaaaacggaccttaggtcggtactacggacctaaccctaattccttagtttaccc

SEQ ID NO: 405306 - DNA, 577 bp, Homo sapiens
  misc_feature: GZ8MTXP02GJ98B.21.55.E11.1.454.CMB.2.raw
  modified_base (277)..(277): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgacaagtcacgacataaacaccttttaaatgtatcagcacaaacaggaagccccaaagcncctgatcgatgctgcatccaaatttagagagtggggtccatccccagttcagtggcatggatcagggacaaatttcaactctcaccatcagcagtctgcctaacctgaaagtatttgactaaacttactaatttgtacaaacagtaacgttacagttaactttccctttacaaccgtttttcgggccccttacggggaaaccccgtaaggtaccggtaaattaacttaccgaaaaaccgtaaaccgttggttaacgggactttacggtacccaaccctaagtttaccttcggttttaccc

SEQ ID NO: 405307 - DNA, 524 bp, Homo sapiens
  misc_feature: GZ8MTXP02H83T4.21.55.E11.1.454.CMB.2.raw
  modified_base (218)..(218): a, c, t, g, unknown or other
tcagtcgtcgctcgcacgaccggtgctcgatttagcactcgcacgttgggtttgggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccganaagtcacgacataaacacttttaaatgtatcagcacaaacaggaagccccaaagctctgatcgatgctgcatccaaatttagagagtggggtccatccccagttcagtggcgatggatctgggactaaatttcactctcaccatcagcagtctgacaacctgaaacgtattttagactaaactttactaatttgtactaaacagtaagttacagtaactttccttactaactttcggcccttgggaacccgtaagtccgaattactacgaaaaccgtaatgtggactcgacactactctagttccc

SEQ ID NO: 405308 - DNA, 617 bp, Homo sapiens
  misc_feature: GZ8MTXP02HFTVO.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgacaagtcacgacataaactaccttttaaatggtatcagcacaaaccaggaacgccccaaagctcctgatcgatgctgcatcctaaatttagagtaaggtcggggtaccccagtcccccgaaggtttccaaggttggacgtagttgggatccgtaggggaactaaagtttcaacttctcaaccatccagctagtctgaccaacctggaaatacttttgactaaactttacatttcgacaaacgaggtaacttacgagttaactttcctttacaccgttttccggaccccttagggggtaacccctaaggttacccgtaaattacgttaaaccgtaaaaaccggtacgtttagggaacgggtccttacggaccctaacccgtatttccgttacggtttccc

SEQ ID NO: 405309 - DNA, 629 bp, Homo sapiens
  misc_feature: GZ8MTXP02I0BXQ.21.55.E11.1.454.CMB.2.raw
  modified_base (220)..(220): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganaagtcacgacataaactacttttaaatgtatcagcacaaacgaggaacgccccaaagcctctagatcgatgctgcatacctaagtttagagtaggtcgggtaccagtccccgtaggtcaggtggacgagtggagtcgtaaggtaaactaaattcaactctacaacctatcaagctaagtctacgacctaaacgtagtaaacgttatttacgaaccttaaactttactatttagtaaccaaagtagtaacgtttaactagtttaacctttccctttacgtaacccgttttccgggaccccgttacgggggtaaacccgtaaggttaccgtaaattaaacgttaaccgaaaaaccgttacgttcggtaacgtaccgtacgaccctaaccttactttcgttacgtttacccg

SEQ ID NO: 405310 - DNA, 569 bp, Homo sapiens
  misc_feature: GZ8MTXP02HEDVZ.21.55.E11.1.454.CMB.2.raw
  modified_base (387)..(387): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccgacaagtcacgacataaacacttttaaatgtatcagcacaaaccaggaagccccaaagctctgatcgatgctgcatccaaatttagagagtggggtccatccccagttcagtggcgatggatcgtaggaactaaatttcactctacacatcagcagtctagcaactgaaatntttgactaaactttactatttgactaaacagtaagttacaagttaactttcctttacaaccgtttttccgggcccctttagggggaaaccccgtaaaggttccgtaaattaaacgttaccaaaaaacggtaaccttggttaaccggtacgtacgacctaaccgtacttacctttacgttacc

SEQ ID NO: 405311 - DNA, 563 bp, Homo sapiens
  misc_feature: GZ8MTXP02HT72G.21.55.E11.1.454.CMB.2.raw
  modified_base (222)..(222): a, c, t, g, unknown or other
  modified_base (352)..(352): a, c, t, g, unknown or other
tcagtcgtcgctcgcacgaccggtgctcgatttagcactcgcacgttgggtttgggggagtcagtctcagtcaggacacagcatggacatgagggtcccccgctcagctcctggggctcctgctactctggctccgaggtgccagatgtgacatccagatgacccagtctccatcatccctgtctgcatctgtcggagacagaatcacctattattgccganaagtcacgacataaactacttttaaatgtatcagcacaaacaggaacgaccccaaagctacctgatcgatgctgcatcctaaattagagagtcggggtcccagtccccgaggttcagtggcgtagtgggnttcgtagggactaaagtttccactctacactatcagcagtctagacctaactgaagtatttcgacttaaaccttattatttagtacaaacgtagtagttaacagtttactttcctttactacgtttccggacccgttacgggacccgttaaagtccgtaattactacgtaaaaccgtagtagtggtctacgaccacctactcttacgttcc

SEQ ID NO: 405312 - DNA, 587 bp, Homo sapiens
  misc_feature: GZ8MTXP02G7B6I.21.55.E11.1.454.CMB.2.raw
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaatgtatcagcacaaccaggaagccccaaagctctgatcgatgctgcatccaatttagagagtggggtcccatccccagttcagtggcgatggatcgtagggactaaagtttcaactctacaccatcagcagtctagacaactgaagtattttgactaaactttactatttagtacaaactagacgtttaacagtttaactttccctttactaaccgttttccgggcccccgtttagggggaaaccccgtaaaggttcccggtaaattaacttacccgaaaaaccggtaaccgttggtaacgggtccttacggactaacccgtaattccgttacgtttaccc

SEQ ID NO: 405313 - DNA, 549 bp, Homo sapiens
  misc_feature: GZ8MTXP02JSJ2L.21.55.E11.1.454.CMB.2.raw
  modified_base (339)..(339): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgacaagtcacgacataaactacttttaaatgtatcagcacaaaccaggaagccccaaagctcctgatcgatgctgcatccaattagagagtgggtcccatccccaggttcagtggcgatggntcgtgggaactaaagtttcactctacaccatcagcagtctagcaactgaaagtatttgactaacttactattcgactaacgagtaagttacaagttactttccgtttactaccgttttcggaccccgttaggggacccgtaaagtacgtaacttaaagtaccaaaacgtaacctggtcggcttacggaccaaccgtattccgtcgtttcc

SEQ ID NO: 405314 - DNA, 512 bp, Homo sapiens
  misc_feature: GZ8MTXP02FNAI2.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaatgtatcagcacaaaccaggaagccccaaagctcctgatcgatgctgcatccaatttagagagtgggtccatcccagttcagtgcgatggatctgggacaaatttcactctcaccatcagcagtctgcaactgaagtatttgactaaacttactattgtacaaacagtagttacagttaatttcccttatacttttcggacccttggggaaccctaaagttccgaaatactacaaaacgactagtggactgacaccatctgttcc

SEQ ID NO: 405315 - DNA, 593 bp, Homo sapiens
  misc_feature: GZ8MTXP02GFNGH.21.55.E11.1.454.CMB.2.raw
  modified_base (220)..(220): a, c, t, g, unknown or other
tcagtcgtcgctcgcacgaccggtgctcgatttagcactcgcacgttgggtttggggagtcagtctcagtaaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacataaacaccttttaaatgtatcagcacaaaccaggaacgccccaaagctcctgatcgatgctgcatccaatttagagagtgggtcccagtccaggttcagtggcgatggatcgtgggactaaatttcactctacaccatcagcagtctgacaaccttgaaagtatttacgactaaaactttactaatttcgtacaaactagtaagtttaacagttactttcccttttacaccgttttaccgggccccttaggggaacccgtaaaagtttccggaaactttaaacgtaccaaaaaccggtaacctttgggttacggaacctttcggacctacccgtaatttcctttacggttccttttaacccg

SEQ ID NO: 405316 - DNA, 574 bp, Homo sapiens
  misc_feature: GZ8MTXP02F2HPQ.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgacaagtcacgacataaactacttttaaatgtatcagcacaaacaggaagccccaaagctcctgatcgatgctgcatccaatttagagagtgggtccatccccaggttcagtggcgatcgggatcgtggggaactaaaatttcaactctcaccatcagcagtctagcaactgaagtactttgacctaacttactattcgtactaactagtacgttacaagttactttacctttctaccgttttccgggacccttacgggggtaaccctaaaggttccggtaaattactaaccgtaaaaacggtaaccgttaggtcgggtaccttacggaccctaaaccttacgttcttacgtttacc

SEQ ID NO: 405317 - DNA, 554 bp, Homo sapiens
  misc_feature: GZ8MTXP02FSK8N.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactacttttaaatgtatcagcacaaaccaggaacgccccaaagctcctgatcgatgctgcatccaattagagagtgggtcccatcccaggttcagtgcgatggatctaggaaactaaatttcactctcacatcagcagtctagacctaactgaaagtatttgactaaacttactattagtacaaactagtagttacagttactttccttactaccgtttcggccccgtaggggtaacccgaagttccgaaattaacgtaccgaaaacggtaaccttggtaacggtactacggacctaacccgtattcccgttagtttcc

SEQ ID NO: 405318 - DNA, 597 bp, Homo sapiens
  misc_feature: GZ8MTXP02H9W8C.21.55.E11.1.454.CMB.2.raw
  modified_base (219)..(219): a, c, t, g, unknown or other
  modified_base (229)..(229): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccganaagtcacganataaactacttttaaatgtatcagcaacaaacaggaacgaccccaaagctcctagatcgatgctgacatacctaaatttagagtagtcggggtacccagtccccgaggttcgagtggacgagtgggattcgtagggaaacttaaaacgtttccactactaccaaccctataccagctaacgtcctagacctaaaccgttagaaacgttattttacgaacctttaactttaacttaatttacgtacaaactaagtacgttaactagtttactttcctttactacgtttccggacccgttacgggaaccgtaggtacctataacttacgaaaacgtacgtgtaacggctacgactacctagtcttcgtcc

SEQ ID NO: 405319 - DNA, 580 bp, Homo sapiens
  misc_feature: GZ8MTXP02JSR1U.21.55.E11.1.454.CMB.2.raw
  modified_base (220)..(220): a, c, t, g, unknown or other
  modified_base (349)..(349): a, c, t, g, unknown or other
  modified_base (402)..(402): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganagtcacgacaataaactacttttaaatgtatcagcaacaaaccgagggaacgaccccaaagcctcctgactcgatgctgcataccaatttagagagtgggcccatccccgagttcaggtggcgagtggntcgtagggaactaaagttcactctacacatcagcagtctgaccaactgaagtntttcgaactaactttatattgtacaacgtagtacttaactacgtttactttacctttacgtaaccgtttccggaccccgttacggggtaaccgtaagtacgtaacttaacgtaaccgtaaaacggtaccgttaggtaacggtacttacggacctaaccgtactttcgttcgtttaccc

SEQ ID NO: 405320 - DNA, 559 bp, Homo sapiens
  misc_feature: GZ8MTXP02G561L.21.55.E11.1.454.CMB.2.raw
  modified_base (254)..(254): a, c, t, g, unknown or other
  modified_base (336)..(336): a, c, t, g, unknown or other
  modified_base (373)..(373): a, c, t, g, unknown or other
  modified_base (389)..(389): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccgacaagtcacgacataaactacttttaaatgtatcancacaaacaggaagccccaaagctctgatcgatgctgcatccaatttagagagtcgggccatccccaggttcagtgcgatggntcgtaggactaaattcactctacaccatcagcagtcngaccaacgtgaaagtntttagactaactttactagtttacgacaactaagtacgttaactagttactttaccctttctaaccgttttccgggaccccgttaggggtaacccgtaaaggttccgtaacttaactaccgaaaaccgtacgttaggcgtctacgacctaacctacttccgtagtttccc

SEQ ID NO: 405321 - DNA, 532 bp, Homo sapiens
  misc_feature: GZ8MTXP02IKRNL.21.55.E11.1.454.CMB.2.raw
  modified_base (335)..(335): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccgacaagtcacgacataaacacttttaaatgtatcagcacaacaggaacgccccaaagctctgatcgatgctgcatccaatttagagagtggggtccatccccaggttcagtggcgatggntctagggaactaaatttcactctcaccatcagcagtctgcaactgaagtatttgactaaacttactattgtacaacagtagttacagttactttcctttctacgtttcggcccgttacgggtaccgtaaggtccgtaaattactaccgtaaaaacggtacttggtaacggcttacgacctaacctattctcgtttcc

SEQ ID NO: 405322 - DNA, 598 bp, Homo sapiens
  misc_feature: GZ8MTXP02HIQWS.21.55.E11.1.454.CMB.2.raw
  modified_base (289)..(289): a, c, t, g, unknown or other
  modified_base (408)..(408): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactaccttttaaatggtatcagcaacaaaccgagggaacgccccaaagcctccngatcgatgctgcatccaaatttagagtagtggggtcccagtccccaggttcagtggcgatgggatcgtaggaactaaatttcactcacacatcagcagtctagcaaaccgtgaaacgtntttacgacctaaactttactatttagactaaacgtagtagttaaccgtaagtttactttcctttaccgtaccgtttttcccggggacccccgtttagggggaacccctaaacgggttaccgtaaattaacgtaaccgaaaacgtaaccttggtaacggcttcgaactaacccctgttaccgttcgtttcc

SEQ ID NO: 405323 - DNA, 515 bp, Homo sapiens
  misc_feature: GZ8MTXP02FLFXZ.21.55.E11.1.454.CMB.2.raw
  modified_base (340)..(340): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacacttttaaatggtatcagcacaaaccaggaagccccaaagctcctgatcgatgctgcatccaatttagagagtgggtcccatccccaggttcagtggcgatggntcgtagggactaaatttcactctcaccatcagcagtctgcaactgaagtatttgactaaacttactattgtacaaactagagttacagttactttcctttcacgtttcggccctagggacccgagtcgaatactacgaaaacgtactgtaacggctacgacacctatctcgttcc

SEQ ID NO: 405324 - DNA, 566 bp, Homo sapiens
  misc_feature: GZ8MTXP02F1W0E.21.55.E11.1.454.CMB.2.raw
  modified_base (334)..(334): a, c, t, g, unknown or other
  modified_base (558)..(558): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactacttttaatgtatcagcacaaaccaggaacgccccaaagctcctgatcgatgctgcatccaattagagagtgggtccatcccagttcagtgcgatgntcgtggaactaaattcaactctacaccatcagcagtctagaccaactgaagtatttgactaaactttactattacgtacaaacgtagtaacgtttaactagttaactttcctttacgtaaccgttttccggaccccgttaggggaacccgtaaaggttccgtaaattaacgtaaccgaaaaacgtaacgttaggtaacggtcctacggtaccacctattccgtntttacccg

SEQ ID NO: 405325 - DNA, 690 bp, Homo sapiens
  misc_feature: GZ8MTXP02HDNV1.21.55.E11.1.454.CMB.2.raw
  modified_base (196)..(196): a, c, t, g, unknown or other
  modified_base (221)..(221): a, c, t, g, unknown or other
  modified_base (286)..(286): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctattattgccgganaagtcacgacataaactacttttaaatgtatcagcaacaaaccgaggaacgaccccaaagctccngatcgatgctgacatacctaatttagagtaggtcgggtccctagtcccccgtaggttcaggtggacgtagtggatcgtagggtaaactaaatttccaacttctaccaaccctatccgaagctaagtcctacgacctaaaccgtaggtaaacgttacttttcgaaaccttaaacctttacttagtttacgtaacctaaacgtaacgttaacgtttaaactaacggtttacctttacccgttttaccgttaacccggtttttccgggacccccgttaagggggtaaacccccgttaaaggttacccggttaaaattaacccgttaaaccgtaaaaacccgggtacgttacgggttaaccggtccttacggaccctaacccgttatttcccgttaacggttttaccc

SEQ ID NO: 405326 - DNA, 585 bp, Homo sapiens
  misc_feature: GZ8MTXP02FLRQE.21.55.E11.1.454.CMB.2.raw
  modified_base (218)..(218): a, c, t, g, unknown or other
  modified_base (371)..(371): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccganaagtcacgacataaactacttttaatgtatcagcacaaacaggaacgccccaaagctctgatcgatgctgcatccaaatttagagagtgggtccatccccagttcagtggcgatggatcgtagggaactaaatttcaactctacacctatcancagtcctagcctaaactgaaagtatttcgactaaactttactattacgttacaaacgtagtaacgttaactagttactttccgtttacctaacgttttcccgggacccttacggggaaacccgttaaagttcggtaaacttaaacgtacctaaaaaacgtacgttggtaacggtaccttacggaccctaaccgtattcccgttacggtttaccc

SEQ ID NO: 405327 - DNA, 548 bp, Homo sapiens
  misc_feature: GZ8MTXP02F04OX.21.55.E11.1.454.CMB.2.raw
  modified_base (197)..(197): a, c, t, g, unknown or other
  modified_base (426)..(426): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacattattgcgacagtcacgacataaactacttttaaatgtatcagcaacaaacaggaagccccaaagctcctgatcgatgctgcataccaaatttagagagtgggtcccatcccaggttcagtggcgatggatcgtaggggaactaaaatttcaacttctacaccatcagcagtctgctaaactgaaagtatttgactaaactttactaattgtacaaanagtaactttacattactttacctttctaacgtttccggacccttaggggaccctaaagtccgtaaattaacgttaccaaaaacggtacttaggtcgtactcgacctactacttcttacgttc

SEQ ID NO: 405328 - DNA, 570 bp, Homo sapiens
  misc_feature: GZ8MTXP02H50WN.21.55.E11.1.454.CMB.2.raw
  modified_base (393)..(393): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgacaagtcacgacataaactaccttttaaatggtatcagcacaaaccagggaacggccccaaagctcctgatcgatgctgcatccaatttagagagtggggtccatcccaggttcagtggcgatggatcgtgggactaaatttcactctcaccatcagcagtctgcaactgaaagntttgactaactttactatttagtcaaacgtagtaagttaacagttactttcccttttactaaccgtttttccgggcccctttacgggggaacccgtaaggttccggtaaattaacttaccgaaaaaccggtaaccttaggtcggtccttaggcctaaaccctacttcgttacgttcc

SEQ ID NO: 405329 - DNA, 517 bp, Homo sapiens
  misc_feature: GZ8MTXP02JQDHE.21.55.E11.1.454.CMB.2.raw
  modified_base (341)..(341): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacaccttttaaatggtatcagcacaaaccaggaagccccaaagctcctgatcgatgctgcatccaatttagagagtgggtcccatccccaggttcagtggcgatggntcgtgggactaaattcactctcacatcagcagtctgacaacctgaagtattttgactaaactttactattcgtacaaacagtagtttacagttaacttcctttacactttcggcccttaggggaccctaagtccgaattactaccaaaacgtactgtaagctgacaccatctgttc

SEQ ID NO: 405330 - DNA, 625 bp, Homo sapiens
  misc_feature: GZ8MTXP02HPYGH.21.55.E11.1.454.CMB.2.raw
  modified_base (223)..(223): a, c, t, g, unknown or other
  modified_base (257)..(257): a, c, t, g, unknown or other
tcagtcgtcgctcgcacgaccggtgctcgatttagcactcgcacgttgggtttgggggagtcagtctcagtcaggacacagcatggacatgagggtcccccgctcagctcctggggctcctgctactctggctccgaggtgccagatgtgacatccagatgacccagtcctccatcatccctgtctgcatctgtcggagacagaatcacctattattgccganaagtcacgacataaactacttttaaatgtatcanacacaaacaggaacgaccccaaagctactgatcgatgctgacatactaagtttagagtaggtcgggtacccagtccccgaggttcaggtcggacgtagttggatcgtaggaacttaaacgtttcacttctacaaccatcaagctagtctagactaaacgtgaagttactttacgacttaaactttacttatttagacctaaaagtagttaacgttaacctagtttaactttcccgtttacttaccgtttaccgggaccccgttaacggggtaaacccgtaagttaccgtaaattaaaccgtaaccgaaaacgttaaccgtggtaaggtaccgtacgtacccaacctacggttcctttacgtttaaccc

SEQ ID NO: 405331 - DNA, 561 bp, Homo sapiens
  misc_feature: GZ8MTXP02JZBD8.21.55.E11.1.454.CMB.2.raw
  modified_base (287)..(287): a, c, t, g, unknown or other
  modified_base (350)..(350): a, c, t, g, unknown or other
  modified_base (417)..(417): a, c, t, g, unknown or other
  modified_base (548)..(548): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattcgccggacaagtcacgacaataaactacttttaaatgtatcagcaacaaccgaggaacgccccaaagctccngatcgatgctgcatactaatttagagagtcggggaccagtccccaggttcagtggcgagtggngtcgtaggtaactaaattcactactcaacctatcagcagtctagacctaactaggtaattagtttanaaccttaaacttactagttgtaaccaataggtacttaactagttaactttcttacctacgtttccggacccgttaggggacctaaacgtcgaaattactaacgaaaacgtacttggaagcctagacctaancttacgtcttacc

SEQ ID NO: 405332 - DNA, 577 bp, Homo sapiens
  misc_feature: GZ8MTXP02H7GCL.21.55.E11.1.454.CMB.2.raw
  modified_base (220)..(220): a, c, t, g, unknown or other
  modified_base (276)..(276): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganaagtcacacaataaactactttaatgtatcagcaacaacaggacgacccaagctcngatcgatgctgctaatacctaaagtttagagtacggttacggggtaccccagtccccgaggttacgaggtggcgagtggatacgtagaaactaaatttacactctacacctatacagctagtctagacctaaactagtaagttatttacgacttaactttacttattacgtacaaacgtagtaattaactacgtttaactttcctttaccgttaccgtttccgggacccgttacgggaacccgtagtacgtaataactaacgaaacgtacgtagtcggactacgcacctactcttcgttcc

SEQ ID NO: 405333 - DNA, 521 bp, Homo sapiens
  misc_feature: GZ8MTXP02FKRA7.21.55.E11.1.454.CMB.2.raw
  modified_base (218)..(218): a, c, t, g, unknown or other
  modified_base (337)..(337): a, c, t, g, unknown or other
  modified_base (359)..(359): a, c, t, g, unknown or other
  modified_base (440)..(440): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgcganaagtcacgacataaactacttttaaatgtatcagcacaaacaggaagccccaaagctcctgatcgatgctgcataccaatttagagagtgggtcccatccccgagttcagtgcgatggntcgtggactaaatttcatctanaccatccagcagtctgccaactgaaagtatttgactaaacttactatcgtacaaactagagttaacagttactttccttanacctttcggacccttacgggaccaagttccgaattacacgaaaacgaacttgtaacggcttaggactaccatctacgttcc

SEQ ID NO: 405334 - DNA, 622 bp, Homo sapiens
  misc_feature: GZ8MTXP02F0KWD.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactacttttaaatgtatcagcacaaaccaggaacgccccaaagctcctgatcgatgctgcatccaatttagagagtgggtcccatccccagttcagtggcgatggatcgtagggactaaattcactctcacctatcagctagtctacgacctaaaccgttgaaacgttatttttcggaaccttaaaactttacttaactttggtaacctaaaacgtagtaacgtttaaccaagtttaccttttccctttactaaccgtttttccgggacccctttaagggggaaccctaaaggttaccgtaaattacgtaaacccgtaaaaaccgtaacgtttacgggttcggaccttacggaccctaaaacccgttacgtttacgttacgtttacc

SEQ ID NO: 405335 - DNA, 593 bp, Homo sapiens
  misc_feature: GZ8MTXP02F01RM.21.55.E11.1.454.CMB.2.raw
  modified_base (220)..(220): a, c, t, g, unknown or other
  modified_base (391)..(391): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganaagtcagacataaactacttttaatgtatcagcacaaaccaggaacgccccaaagctcctgatcgatgctgcatacctaaatttagagtagtcggggtaccctagtccccgtaggttcaaggtcggacgtagttgggatcgtaggggaactaaagtttcaactctacaacntcagctagtctagactaaacgtgtaagtatttgacctaaattacttattgtacaaagtaagtaacgtttacagtttaactttccttacgtaaccgtttccgggcccgttaggggaacccgttaaagttccgtaaattaacgttaaccgaaaacgtacgttcggtaacggtactacgaccctaccgtattccttcgtttaccc

SEQ ID NO: 405336 - DNA, 501 bp, Homo sapiens
  misc_feature: GZ8MTXP02HVKY4.21.55.E11.1.454.CMB.2.raw
  modified_base (196)..(196): a, c, t, g, unknown or other
  modified_base (218)..(218): a, c, t, g, unknown or other
  modified_base (227)..(227): a, c, t, g, unknown or other
  modified_base (356)..(356): a, c, t, g, unknown or other
  modified_base (409)..(409): a, c, t, g, unknown or other
  modified_base (412)..(412): a, c, t, g, unknown or other
  modified_base (424)..(424): a, c, t, g, unknown or other
  modified_base (426)..(426): a, c, t, g, unknown or other
  modified_base (428)..(428): a, c, t, g, unknown or other
  modified_base (469)..(469): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgcganagtcacganaataaactacttttaaatgtatcagcaacaaaccaggaacgaccccaaagcctactagatcgatgctgacatactaaatttagagtaaggtcggggtacccataccccgaggttcaggtggcgagtggntcgtagggaactaaatttcactctacaccatcagcagtctgaccactgaattnttnactattatatanananatatatatacttcttctactcgtcgtacgacgacgtactanactacaacacgagtgcgacgacacactctctc

SEQ ID NO: 405337 - DNA, 633 bp, Homo sapiens
  misc_feature: GZ8MTXP02GKO8W.21.55.E11.1.454.CMB.2.raw
  modified_base (219)..(219): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganaagtcacgacataaactacttttaatgatcagcaacaaacgaggaacgaccccaaagctacctagatcgatgctgcaatcctaaatttaggagtaggtcgggtacccagtccccgtaaggttcaaggtggacgtaagtgggatcgtagggtaaacctaaatttccaacttctacaaccctatccaagtccagttccgtacgacctaaacgtagtaaattatttacgaacttaaactttacttaatttacgtaactaaaacggtaagtaacgtttaacgtacgtttaacctttccctttaccgaacccgttttcccgggaccccgttaggggtaaccccgtaaaggttcctaaaagttactaaccgaaaaacgtcgtttaggaacgtcctacgacctacctagttcctgtttacc

SEQ ID NO: 405338 - DNA, 583 bp, Homo sapiens
  misc_feature: GZ8MTXP02FMJ0P.21.55.E11.1.454.CMB.2.raw
  modified_base (219)..(219): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccganaagtcacgacataaactacttttaaatgtatcagacaacaaacgaggaacgaccccaaagctcctagatcgatgctgcataccaaatttagagtagtggggtaccccagtccccgtaggttccaaggtcggacgtaagtgggtagttccgtaggggtaaacctaaaagtttccaacttcctacaacctataccagctagtctacgactaacgtagaagtatttacgactaaacttactattgactaaactagtaacttacattaactttccttactacgtttcggacccttagggaccctaaagtccgtaataacgtaacgaaaaccgtagtggtaagactcgacctaacctatcgtcttaacc

SEQ ID NO: 405339 - DNA, 560 bp, Homo sapiens
  misc_feature: GZ8MTXP02JFAWF.21.55.E11.1.454.CMB.2.raw
  modified_base (221)..(221): a, c, t, g, unknown or other
  modified_base (348)..(348): a, c, t, g, unknown or other
  modified_base (371)..(371): a, c, t, g, unknown or other
  modified_base (382)..(382): a, c, t, g, unknown or other
  modified_base (397)..(397): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccgganaagtcacgacataaactaccttttaaatggtatcagcacaaaccgaggaacgccccaaagctctgatcgatgctgcatccaatttagagagtcgggtccatcccgaggttcagtgcgtatggatcgngggaactaaatttcactctcacntccagcagtcngacaactgaaacgtntttgactaactttactaatttcgacaaacgtagtagttacctagtttaactttcctttacgaacgttttccggacccttaggggaaccctaagtcggaacttaactaccgaaaaacgtctggtaacggccttacggacctaaaccttacttccgttacgtttc

SEQ ID NO: 405340 - DNA, 566 bp, Homo sapiens
  misc_feature: GZ8MTXP02J1HQ6.21.55.E11.1.454.CMB.2.raw
  modified_base (224)..(224): a, c, t, g, unknown or other
  modified_base (300)..(300): a, c, t, g, unknown or other
  modified_base (405)..(405): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgacccagtctccatcatccctgtctgcatctggtcggagacagaatcaactatttattgccgganaagtcaacgactaattaaactacttttaaatgtatcagcaacaaaccgaggacgaccccaaagctcctgatcgatnctgacatacctaatttacgagagtcgggtccagttccccgtaggttcgagttcggacgagtggagtcgtacgggaaactaaatttcaacgttcctacactatcanactagtccagaccaacgttagtaagttactttacgacttaacttatattagtacaacgtagtatacttacgttactttccttacgtacgtttccggacctagggacctagtacgtatacgtacgaaaacgtctgtcgactcgacctactcttacgctttac

SEQ ID NO: 405341 - DNA, 695 bp, Homo sapiens
  misc_feature: GZ8MTXP02HGR17.21.55.E11.1.454.CMB.2.raw
  modified_base (198)..(198): a, c, t, g, unknown or other
tcagtcgtcgctcgcacgaccggtgctcgatttagcactcgcacgttgggtttgggggagtcagtctcagtcaggacacagcatggacatgagggtccccgctcagctccgtggggctcctgctactctggctccgaggtgccagatgtgacatccagatgacccagtctccatcatccctgtctgcatctgtcgganacagaatcactattattgaccgacaagtcacgacataaactacttttaaatgtatcagcaacaaacgaggaacgaccccaaagcctctagatcgatgctgactactacctaaagtttagaaggtacggttcggggtaccctagttccccgaaaggtttcaaggtacggacgtagttaggtacgtacgttagggaaacttaaaacgtttccaacctcttaaccaaccctattacgaaacgcgtaacgtcccgttaacgaaccgtaaacgttaagtaaacgttacgtttaacgtaaacttaaacttttaaacgttaacgtttacgaaactaaacgtaacgttaaagttaacgttacgtttaactttaccctttaccgttacccggtttaccggaacccggttaacgggaaaccgttaaacgtacgttaaacttaaacgtaaacctaaaacggtacgttacggaacgtacttacgacctactacgtttccgttacgttcc

SEQ ID NO: 405342 - DNA, 628 bp, Homo sapiens
  misc_feature: GZ8MTXP02IR7PG.21.55.E11.1.454.CMB.2.raw
  modified_base (249)..(249): a, c, t, g, unknown or other
  modified_base (274)..(274): a, c, t, g, unknown or other
  modified_base (347)..(347): a, c, t, g, unknown or other
  modified_base (399)..(399): a, c, t, g, unknown or other
  modified_base (414)..(414): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccgacagtcacgacataaactactttaatgtatcancacaacaggaacgcccaagctcctnatcgatgctgacactaccctaaatttagagtaggtcggggtacccatccccgaggttcaggtggcgtagtggntcgtagggtaaactaaagtttccacttcctacaacctatccagctagtctanaccaacgtgaaagtntttacgacttaaactttactagtttactacctaacgaagtacgtttacaagtttactttcccttttacgtaaccgttttccgggaccccgtttacgggggaaaccttaaacggtccggtaaacttaacttaaccgtaaaaaacccggtcgttacgggttaacgggtaccctttacggaccctaaaaccgtacgtttacccgtttcgtttaaccc

SEQ ID NO: 405343 - DNA, 604 bp, Homo sapiens
  misc_feature: GZ8MTXP02HAL8W.21.55.E11.1.454.CMB.2.raw
  modified_base (196)..(196): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctattattgaccgacaagtcacgacataaactacttttaaatgtatcagcaacaaaccgaggaacgaccccaaagcctactagatcgatgactgctactactaaatttagagtaggtcggggtaccctagtcccctaggttcaggtcggcgaagtggactcgtaggaactaaacgtttcactctacacactcagactatcagaccaactagaagttatttagaacttaatttactatttagacaaacgtagtaacgttaacagtttactttcctttacttaaccgtttccgggaccccgttaggggtacccgtaaagttccgtaaacttaactaaccgtaaaaccgtaacgttacggtaacgtcgtacgaccctaactacgtttccgttagtttaccc

SEQ ID NO: 405344 - DNA, 581 bp, Homo sapiens
  misc_feature: GZ8MTXP02FSUS8.21.55.E11.1.454.CMB.2.raw
  modified_base (221)..(221): a, c, t, g, unknown or other
  modified_base (344)..(344): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccgganaagtcacgacataaactacttttaaatgtatcagcacaaacaggaacgccccaaagctcctgatcgatgctgcatccaatttagagtagtggggtcccatccccgaggttcagtggcgatggntcgtagggaactaaagtttcactctacaccatccagcagtctagacctaactagaagttactttgactaaacttactattgtacaaactagtacgttactagttactttacccttactaccgttttccggacccgttacggggaacccgtaaaggttccgtaaacttaacttaaccgaaaaaccgtaacgttggtaacggtaccttacggaccctaacctacttcgtcgtttaaccc

SEQ ID NO: 405345 - DNA, 521 bp, Homo sapiens
  misc_feature: GZ8MTXP02G7COD.21.55.E11.1.454.CMB.2.raw
  modified_base (220)..(220): a, c, t, g, unknown or other
  modified_base (230)..(230): a, c, t, g, unknown or other
  modified_base (519)..(519): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacganataaacacttttaaatgatcagcacaaaccaggaacgccccaaagctcctgaatcgatgactgcatccaaatttagagagtgggcccatccccagttcagtgcgatggatctagggactaaaatttcatctcaccatcagcagtctgacaaactgaacattttgactaaaccttaatatttgtacaaacgagtaacttaacagttaacttcctttctaacctttcggcccttggggaaaccctagttacgaattactacaaaaccgaatgtaagcctgacactatcctntc

SEQ ID NO: 405346 - DNA, 614 bp, Homo sapiens
  misc_feature: GZ8MTXP02IB20Y.21.55.E11.1.454.CMB.2.raw
  modified_base (218)..(218): a, c, t, g, unknown or other
  modified_base (348)..(348): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacattattgccganagtcacgacataaacacttttaatgtatcagcacaaaccagggaacgccccaaagctcctgatcgatgctgcatcccaatttagagagtcggggtcccagtcccctaggttccaggttcggcgtatgggntctggggaactaaagtttcactctcacccatcagcagtctgccaactgtaagtactttgactaacttacttacttagtacctaacgtaagtacgttaactacggtttactttcccttttaccgtaaccgtttttcccgggccccgtttaagggggtaaccccgtaaaggttacccggtaaattaaacgtaccgtaaaaaacccggtacctaagggttcgggtaccttacggaccctaacccgtaactttccttacggttttaaccc

SEQ ID NO: 405347 - DNA, 719 bp, Homo sapiens
  misc_feature: GZ8MTXP02IED09.21.55.E11.1.454.CMB.2.raw
  modified_base (203)..(203): a, c, t, g, unknown or other
  modified_base (236)..(236): a, c, t, g, unknown or other
tcagtcgtcgctcgcacgaccggtgctcgatttagcactcgcacgttgggtttggggagtcagtctcagtcaggacacagcatggacatggagggtcccccgctcagctcctggggctcctgctactctggctccgaggtgccagatgtgacatccagatcgacccagtcctccatcactccctgtctgcatctggtacgganacaagaactcaactatttagttcggaccggaanaagtcaacgaactaattaaacctacttttaaatgatcagacaacaaacgaggaacgaccccaaagcctacagactcgatcgctgactaattacctaaagtttaggaggtacggttccggggtaccctagtccccgtaggttcgaggtcggacgtaggttcggtattacggtaacggtaaacttaaacgtttccaccttaccttaacccaaccctagtaccgaaacgtccgtacggttacctacggtaaccctaaaccgttaaggtaaacgtttacgtttacgaaacctttaaactttaccgttattttacgaacctaacgtaagttacttaacttacgtttacctttccctttacgttaccgtttcccgggacccgttaaggggaaaccgttaaggtaacttaaacgttaaaccgtaaacgtaaaaccgttactacgggtaacgtcgtacgtaccctaccgttacttccgtttaacgtttccc

SEQ ID NO: 405348 - DNA, 506 bp, Homo sapiens
  misc_feature: GZ8MTXP02JL5PW.21.55.E11.1.454.CMB.2.raw
  modified_base (253)..(253): a, c, t, g, unknown or other
  modified_base (422)..(422): a, c, t, g, unknown or other
  modified_base (503)..(503): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaacacttttaaatgtatcancacaaacaggaagaccccaaagctctgatcgatgctgcataccaaatttagagtagtggggtacccatccccaggttcagtggcgatggatcgtagggacaaaatttcactctcaaccatacagcagtctagacaacctgaaatatttgactaacttatattgacaaanagaagttacagttattcctttcacgtttcgcctaggaccgtaatcgaatactacaaaacgactgtgctacgcacctatctntac

SEQ ID NO: 405349 - DNA, 537 bp, Homo sapiens
  misc_feature: GZ8MTXP02JZZE4.21.55.E11.1.454.CMB.2.raw
  modified_base (221)..(221): a, c, t, g, unknown or other
  modified_base (347)..(347): a, c, t, g, unknown or other
  modified_base (384)..(384): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgganaagtcacgacataaactacctttttaaatggtatcagcacaaaccagggaacgccccaaagctcctgatcgatgctgcatccaatttagagagtggggtcccatccccgaggttcagtggcatggntcgtgggaactaatttcactctcaccatcagcagtcngcaactgaagtatttgactaaactttactattagtacaaactagtagttactaagttactttcctttactacgtttcgcccgttagggaccctaagtccgaatactaccaaaacgtactggtaacggtctacgacctacacgttctcgttacc

SEQ ID NO: 405350 - DNA, 603 bp, Homo sapiens
  misc_feature: GZ8MTXP02GP6HF.21.55.E11.1.454.CMB.2.raw
  modified_base (227)..(227): a, c, t, g, unknown or other
  modified_base (407)..(407): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtcctccatcactccctgtctgcatctggtcggagacagaactcacctattattcgaccganaagtcacgactaataaactacttttaatgtatcagacaacaaacgaggaacgacccaagctactgatcgatgctgactataccgtaattaggagtacggtcgggacccatcccgaggttcaggtcggacgtatgggactcggtaagggtaactaaacgtttccactctaccacattcganctactctacgacctaactagaagttattactaactaacctttaagttacttagtacaaacgtagtaagttacctagtttacctttacctttcttaacgttcccggacgttacggaaccgtaggtctaaagttacctaaacgtaaaccgtacgtggtaacggtactacgtacctaacctacgtccgtactttacccg

SEQ ID NO: 405351 - DNA, 553 bp, Homo sapiens
  misc_feature: GZ8MTXP02G9LFU.21.55.E11.1.454.CMB.2.raw
  modified_base (253)..(253): a, c, t, g, unknown or other
  modified_base (388)..(388): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccggacaagtcacgacataaactacttttaaatgtatnagcaacaaacaggaacgaccccaaagctctgactcgatgctgcatcctaatttgagtagtcgggtccatccccgaggttcaggtcggcgtaagtggatcgtagggtactaaatttccaactctacacctatccanctagtctagccaaactgaattactttgactaaattctattgtaccaatagtaacttacgtacttacttcctttacgtacgtttaccggacccgttacgggggaaccctagtaccgtaattaacttacaaaacggtctaggtcgctaacgctacgtatctatttcc

SEQ ID NO: 405352 - DNA, 589 bp, Homo sapiens
  misc_feature: GZ8MTXP02G48VM.21.55.E11.1.454.CMB.2.raw
  modified_base (197)..(197): a, c, t, g, unknown or other
  modified_base (220)..(220): a, c, t, g, unknown or other
  modified_base (281)..(281): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgccganagtcacgacaataaactacttttaaatggtatcagacaacaaacgaggaacgaccccaaanctccagatcgatgctgactatacctaaatttaagagtaggtcggggtccctaagtcccccgaaggtttccaggtcggcgagtggatcgtaggaacttaaaatttcactctaccactatcagactagtctacactaacgtagaattatttgaaccttaattactagtttacaatacaagtaattaccaggtttaaccttcctttactaccgtttaccgaccgttacggggaaccctaggtacctaaataacttacgaaaacggtactggtaacggaccttaggaccctaaccttacttacgttacgtac

SEQ ID NO: 405353 - DNA, 552 bp, Homo sapiens
  misc_feature: GZ8MTXP02HYZH4.21.55.E11.1.454.CMB.2.raw
  modified_base (196)..(196): a, c, t, g, unknown or other
  modified_base (278)..(278): a, c, t, g, unknown or other
  modified_base (349)..(349): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgcgacagtcacgacataaacacttttaaatgtatcagcacaaacaggaacgaccccaaagctccngactcgatgctgcatacctaatttagagtaggtcggggtcctagtccccgtaggttcaggtggcgagtggntcgtagggaactaagtttcactctccacatccagcagtctagacctaaactgaagttatttagacttaaactttactagtttagtacaaacgtagtaagttacaagtttactttcctttacgtactttaccggcccttagggaccgtaagtaccgaattactacaaaacgtactgtaagctagcctacgtatcgttacttacc

SEQ ID NO: 405354 - DNA, 615 bp, Homo sapiens
  misc_feature: GZ8MTXP02IBAHA.21.55.E11.1.454.CMB.2.raw
  modified_base (197)..(197): a, c, t, g, unknown or other
  modified_base (351)..(351): a, c, t, g, unknown or other
  modified_base (385)..(385): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgcgacagtcacgacataaacaccttttaatggtatcagcaacaaaccgaggaacgccccaaagcctcctgactcgatgctgctataccaaatttgagtagtcggggtaccagtcccgaggttcagtggcgtagtggntcgtaggaaactaaattcactctacactatcganctacgtctagacctaacgtagtaacgtatttacgaccttaaacttactacgtttacgtactaaacgtaacgtagttaacgtagtttacctttccgtttacgtaccgttttccgggacccgttacggggtaaccgtaagtaccggtaacttaactaaccggtaaaaaccgttacgttcggtaacggtacttacgggacccttaaccgtactttaccgttacggtttacccg

SEQ ID NO: 405355 - DNA, 610 bp, Homo sapiens
  misc_feature: GZ8MTXP02ICU02.21.55.E11.1.454.CMB.2.raw
  modified_base (197)..(197): a, c, t, g, unknown or other
  modified_base (220)..(220): a, c, t, g, unknown or other
  modified_base (283)..(283): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgccganaagtcacgaactataaactacttttaatgtatcagcacaaacgaggaacgaccccaaagctcnatcgatgctgcataccaatttagagtagtcgggtacccagtccccgtagtcaggtggcgagttggatcgtaggtactaaactttcactctacacctatccgagctagtctacgacctaaaccgtgtaaacgttatttgaaccttaaactttactaagtttcgaaacctaacgtaggttaacctttaatacgtttactttaccctttcgttaacccgtttccgggaccccgtttacgggaacccgtaaacgtacggtaaacttaaacgtaccgaaaaaccgtactacggttaacggacctacgacctaactacttcgttacgtttacc

SEQ ID NO: 405356 - DNA, 568 bp, Homo sapiens
  misc_feature: GZ8MTXP02I7AKH.21.55.E11.1.454.CMB.2.raw
  modified_base (196)..(196): a, c, t, g, unknown or other
  modified_base (220)..(220): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctattattgccganaagtcacgacataaactacttttaaatggtatcagcacaaacaggaacgccccaaagctcctgatcgatgctgacatccaatttagagtacggtcggggtcccagtccccgaggttccaggtggcgagttgggactcgtaggggaacctaaaagtttcaacttcctacaacctatcaagctagtctagcctaaacctgaaactatttagaccttaaactttactatttacgtacaaagtagtaacgttacagttactttcctttactacgtttccggcctacgggtaccaagtcgtaaatacgtaccaaacgtactggtaacgctcgacctactattccgtagttccc

SEQ ID NO: 405357 - DNA, 683 bp, Homo sapiens
  misc_feature: GZ8MTXP02HH0G8.21.55.E11.1.454.CMB.2.raw
  modified_base (197)..(197): a, c, t, g, unknown or other
  modified_base (211)..(211): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagatcactattnttgccggacagtcacgacaataaactaccttttaatgtatcagcaacaacgaggaacgcccaaagcctcagatcgatgctgcatacctaaatttagagtagtcggggtaccagtccccgtaaggtcaaggtcgggacgtagttcgggtatcggtacgggtaaacttaaactttccgaacctttcctaccctaaccctaattaccgaacgtccgtaagttccctagtaccctaaaccgttagtaaacgtttacgtttacgaaaccttaaactttaacgttagtttacgtaaactaaaccgtaagtaaacgtttactaacgtttacttttacccgtttacttacccggttttaccggccccgtttaacgggggtaacctaaaggttaccgtaactaaacgttaaaccgaaaacgttaacggttcggtaacggtaccttacggacctaacctacgttccgtttacgtttaacccg

SEQ ID NO: 405358 - DNA, 546 bp, Homo sapiens
  misc_feature: GZ8MTXP02ITGGT.21.55.E11.1.454.CMB.2.raw
  modified_base (340)..(340): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacataaactaccttttaaattgtatcagcacaaacaggaacgcccaaagctcctgatcgatgctgcatccaatttagagagtgggtaccatcccgagttcagtgcgatggntcgtgggaactaaattcactctacaccatacagctagtctagaccaactgtaagtatttcgactaaactttatatttatacaacagtacgttacagttactttacctttctacgtttccgacccgttagggacccgtaaggtacgtaataacttacgaaaacgtacgttacgtcggacttacgacctacctacttcttcgtttacc

SEQ ID NO: 405359 - DNA, 635 bp, Homo sapiens
  misc_feature: GZ8MTXP02FRUDU.21.55.E11.1.454.CMB.2.raw
  modified_base (223)..(223): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcactccctgtctgcatcgtgtcggagacagaatcactattattcgcganagtcacgactataaactacttttaatgtatcagacaacaaacgaggaacgacccaaagctcctagatcgatgctgctatactaagtttagagtaggtcgggtaccagtcccgtaggttcaggtggacgtagtaggtctacggtagggtaaactaacttttccaactactaccaaactatacacgtacaacgttctacgaacctaaacgttggtaaacttactttacgaaaccttaaacttacttagttacgtacctaaaagtacgtaaactttacgtacgttttactttaccctttacgtaccgttttacccgggaccgttaacgggtaacgtaaacgttacgtaaattaaccgtaaaccgtaaaacggtcgttaggaacgtcgtacgacctacttacgttcgtcgtttacc

SEQ ID NO: 405360 - DNA, 598 bp, Homo sapiens
  misc_feature: GZ8MTXP02FT7XN.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccggacaagtcacgacaataaactacttttaatgtatcagcaacaaaccagggaacgacccccaaagcctaccgtgatcgatgctgcatcctaaatttaggagtaggtcggggtaccctagtaccccgaggttcaaggtgggcgaagttcggatcgtagggaactaaatttcaactctacaccatcagacagttcacgacctaacgtagtaaagtattttcgaacttaaacttacttattacgtacaaactagtaacttacagtttactttcctttacacgttttccggaccgttacgggtaaaccgtattacgtaacttaaacgtaaccgaaaaacgtccttggtaacggactacggtacaccgtatcctttaacgtttccc

SEQ ID NO: 405361 - DNA, 561 bp, Homo sapiens
  misc_feature: GZ8MTXP02JEVSL.21.55.E11.1.454.CMB.2.raw
  modified_base (289)..(289): a, c, t, g, unknown or other
  modified_base (297)..(297): a, c, t, g, unknown or other
  modified_base (350)..(350): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctattattgccggacaagtcacgacaataaactaccttttaaatggtatcagcaacaaacgaggaacgccccaaagctcctnatcgatgntgcataccaatttagagagtcgggtccatccccgagttcagtggcgtagtggntcgtagggaactaaagttcactctcaccatcaagcccagtctgacctaacgtgaaagttactttcgacttaacttacttagttcgtaacagtaagtacgtttaacatttactttccttacgttacgttcccgaccgttacgggaaccctaggtccaaagttactaaaccgaaacgtaacttggtcgtctcgaccaatccttacgtctttcc

SEQ ID NO: 405362 - DNA, 618 bp, Homo sapiens
  misc_feature: GZ8MTXP02I6R36.21.55.E11.1.454.CMB.2.raw
  modified_base (258)..(258): a, c, t, g, unknown or other
  modified_base (281)..(281): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcctccatcactccctgtctgctatctgtcggagacagaactcactattattcgccgacatcacgacaataaactacttttaatgtatcanacacaaacgaggaccgacccaanctctgactcgatgctgcactacctaatttagagtaggtccgggacctacgtccccgtaggttcgaggtcggacgtaagtcgggtagtacggtaacgggtaaacttaaacctttcctaaccttcctacccaactactacacggtactacgtcgtacaccctaacgtaggttaacttatttcgaacttaaacttattacgtttacaaaccagtaaacgtaacgttacgtacgtttactttaccttacgttacggtttcccgtaccgtaacggtacgtaacgtactaatactacgaaaacgtcgtaggaacgtcacgtacctactacgttctactttacc

SEQ ID NO: 405363 - DNA, 563 bp, Homo sapiens
  misc_feature: GZ8MTXP02FFG0N.21.55.E11.1.454.CMB.2.raw
  modified_base (254)..(254): a, c, t, g, unknown or other
  modified_base (344)..(344): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccggacaagtcacgactataaactacttttaatgatcancacaaacaggaacgaccccaaagctctgatcgatgctgcatccaaattagagtagtcgggtaccatccccgagttcagtcggacagtggntcgtaggaactaaactttcaactctacacctaatcagctagtctgactaactaggaattatttcgactaaacttacttagttagacaaactagtactttacacgttactttccttactaccgttttcggaccccgtagggtaaccctagtaccgtaaattactaaccgtaaaaccgaacgttggtaacggactcgtaccacctaactacgtacgtttcc

SEQ ID NO: 405364 - DNA, 560 bp, Homo sapiens
  misc_feature: GZ8MTXP02IWYMJ.21.55.E11.1.454.CMB.2.raw
  modified_base (196)..(196): a, c, t, g, unknown or other
  modified_base (557)..(557): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcganacagaatcactattattgcgacagtcacgacataaactacttttaatgtatcagcacaaacaggaacgcccaaagctctgatcgatgctgcactacctaatttagagtagtcggggtacccatccccgtaggttcaggtggacgatgggatcgtagggaactaaactttcaactctcaccatcagctagtctacgacctaactgaaacgtattttacgaccttaaactttactatttacgtaaccaaacgtaacgtaacgttacttaagttacttttacccgtttctaaccgtttccggacccgtagggaacctaagtcgtaaatactaccaaaacgtcgtgtcgactgaccactactctnttc

SEQ ID NO: 405365 - DNA, 577 bp, Homo sapiens
  misc_feature: GZ8MTXP02JXTV7.21.55.E11.1.454.CMB.2.raw
  modified_base (225)..(225): a, c, t, g, unknown or other
  modified_base (235)..(235): a, c, t, g, unknown or other
  modified_base (358)..(358): a, c, t, g, unknown or other
  modified_base (385)..(385): a, c, t, g, unknown or other
  modified_base (548)..(548): a, c, t, g, unknown or other
tcagtcgtcgctcgcacgaccggtgctcgatttagcactcgcacgttgggtttggggagtcagtctcagtcaggacacagcatggacatgagggtcccccgctcagctcctggggctcctgctactctggctccgaggtgccagatgtgacatccagatgacccagtctccatcatccctgtctgcatctggtcggagacagaatcaacctattattgccggaanaagtcacganataaactacttttaaatgtatcagcacaaccaggaacgaccccaaagctcctgatcgatgctgcatcctaaatttagagtagtcggggtccctagtccccgtaggttcagttggacgagtggntacgtaggggtaactaaagttcaactntaccactatcagcagtctacgacaaccgtagaagtagtttacaactactttaactatttagacaacgtagtacgttaactagttaactttccctttacttaccgtttcggacccgttacgggaacccgtaggtcctaaagtactaacgtaaacgtaacttggngtacctcgaccacgacgttctacgtttcc

SEQ ID NO: 405366 - DNA, 525 bp, Homo sapiens
  misc_feature: GZ8MTXP02HV08Y.21.55.E11.1.454.CMB.2.raw
  modified_base (218)..(218): a, c, t, g, unknown or other
  modified_base (220)..(220): a, c, t, g, unknown or other
  modified_base (225)..(225): a, c, t, g, unknown or other
  modified_base (244)..(244): a, c, t, g, unknown or other
  modified_base (246)..(246): a, c, t, g, unknown or other
  modified_base (248)..(248): a, c, t, g, unknown or other
  modified_base (270)..(270): a, c, t, g, unknown or other
  modified_base (274)..(274): a, c, t, g, unknown or other
  modified_base (283)..(283): a, c, t, g, unknown or other
  modified_base (328)..(328): a, c, t, g, unknown or other
  modified_base (334)..(334): a, c, t, g, unknown or other
  modified_base (370)..(370): a, c, t, g, unknown or other
  modified_base (372)..(372): a, c, t, g, unknown or other
  modified_base (417)..(417): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgctgcatctgtcggagacagaatcacattattgccgaanancacanaataaactactttaatganananacaacaaacgaggaacaccaanctcnatcatgctnacactactaaattagagtagtcggaccatacccgtagtcagtggngagtgntacgtagaaactaaattcactactacaacagtacananactctacactaactagtaagtattagtactaacttattattatanaactaagtaagtaactattacttacttacttacgttacgtaccgtacggacgtagtacgtaataactaactaaacgtaacgtagtaacgacactacacactactactc

SEQ ID NO: 405367 - DNA, 603 bp, Homo sapiens
  misc_feature: GZ8MTXP02GMSCY.21.55.E11.1.454.CMB.2.raw
  modified_base (219)..(219): a, c, t, g, unknown or other
  modified_base (250)..(250): a, c, t, g, unknown or other
  modified_base (253)..(253): a, c, t, g, unknown or other
  modified_base (278)..(278): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganaagtcacgacataaactacttttaaatgtancancacaacgaggaacgcccaaagctcngatcgatgctgctatacctaatttagagtaggtcgggtacccagtccccgtaggtcaggtggacgtagtggacttcgtagggtaactaaatttcaaccttctaccaaccataccagactaacggtcacgacctaacgtagaacgttatttacgacttaaactttattagttcgaactaacgtaggttaactaccttagtttactttacccgtttagtacccgtttccgggcccgttaagggacccgtaggttacctaaagttactaaccgtaaaacgtcgttaggtaaccgacttacgacctacctagttacccttgtttaaccc

SEQ ID NO: 405368 - DNA, 646 bp, Homo sapiens
  misc_feature: GZ8MTXP02GEK4S.21.55.E11.1.454.CMB.2.raw
  modified_base (203)..(203): a, c, t, g, unknown or other
  modified_base (229)..(229): a, c, t, g, unknown or other
  modified_base (296)..(296): a, c, t, g, unknown or other
tcagtcgtcgctcgcacgaccggtgctcgatttagcactcgcacgttggggtttggggggagtcagtctcagtcaggacacagcatggacatgagggtccccgctcagctcctggggctcctgctactctggctccgaggtgccagatgtgacatccagatcgacccagtctccatcactccctgtctgcatcgtggtcgganacagaactcactattattcgaccganagtcacgactaataaactaacttttaatggtatcagacaacaaacgaggaacgaccccaaagcctcngatcgatgctgcactactaattaggagtaggtcgggtaccagtcccgtaggttcaaggtcggacgtagtaggtcgtacgtagggtaaacttaaacttccactccttacaacctattaccgaacgtactacgtctacgacctaaaccgtaggtaaattacttttacgaaaccttaactttaacgttactttacgaacctaaagtaacggtaactttacgtacgtttacctttaccgtttactaccggtttcggacccggttagggtaacccgttaaggtactaaacttacgaaaccgtaaaacggtcgttaaggcggtaactcgtacctaacgtcgttacgtcgtttaacc

SEQ ID NO: 405369 - DNA, 631 bp, Homo sapiens
  misc_feature: GZ8MTXP02HUXQN.21.55.E11.1.454.CMB.2.raw
  modified_base (201)..(201): a, c, t, g, unknown or other
  modified_base (232)..(232): a, c, t, g, unknown or other
  modified_base (295)..(295): a, c, t, g, unknown or other
  modified_base (297)..(298): a, c, t, g, unknown or other
  modified_base (300)..(300): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcctcatcactccctgtctgcatcgtggtcgganacaagaactcaactattagttcggaccgaanaagtcaacgactaataaactacttttaatgtatcagacaacaaacgaggacgacccaagctcnannangctgcatctaaagttagagtaggtccggggtaccacgtccgtaggttactaggtcggagtacgtggtacgtcggtaaggaacttaacgttcactctacaccgtaatccgagcgtatcgtacgacctaacgtagtaaagttactttacgaactttaacgttacttatttacgaactaaagtagtaacgtaacgtagtttactttccttacgttacgttccggtacccggtaggtaaaccggttagtacgtaaacgttaactaaaccgtaaacgttaacgtcggtaacggttacgaccgtacaccggtttactcggttttacgtttaaccccg

SEQ ID NO: 405370 - DNA, 609 bp, Homo sapiens
  misc_feature: GZ8MTXP02INKTU.21.55.E11.1.454.CMB.2.raw
  modified_base (197)..(197): a, c, t, g, unknown or other
  modified_base (219)..(219): a, c, t, g, unknown or other
  modified_base (279)..(279): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattgcganaagtcacgacataaactacttttaatgtatcagcacaaacgaggaacgcccaaagcctcngatcgatgctgctataccctaaatttagaggtaggtcggggtccccagtccccgaagggttcaggtcggcgtagtggactcgtagggtaaacctaaagtttcccaactctaccaaacctcttaccgaacgtcgtaaagttcctacggaccctaaaccgtggtaaagttactttcgaacttaaacttacttattagtactaacgtagtacgttacatttacttcctttataccgtttccgggacccttacgggaccgtaattaccggtaaattaacgtaccaaaacgtacgttggtaacggtcttacgaccacgtaacttcgtcgtttccc

SEQ ID NO: 405371 - DNA, 549 bp, Homo sapiens
  misc_feature: GZ8MTXP02FX7Q7.21.55.E11.1.454.CMB.2.raw
  modified_base (344)..(344): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaactaccttttaaatggtatcagcacaaaccagggaacgccccaaagctcctgatcgatgctgcatccaatttagagagtgggtcccatcccagttcagtgcgatgggntctagggactaaatttcactctcaccatcagcagtctgctaaacctgaagtattttgacctaaactttactattagtacaacgtagtagttacagttactttccctttctaacgttttccgggcccgttaggggacccgtaaaggttccgaacttactaccgaaaacgtacttggtcggactcgacctacctatccttagtttcc

SEQ ID NO: 405372 - DNA, 561 bp, Homo sapiens
  misc_feature: GZ8MTXP02JGQVU.21.55.E11.1.454.CMB.2.raw
  modified_base (196)..(196): a, c, t, g, unknown or other
  modified_base (220)..(220): a, c, t, g, unknown or other
  modified_base (282)..(282): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctcatcatccctgtctgcatctgtcgganacagaatcactattattgaccganagtcagacataaactacttttaaatgtatcagcaacaaacgaggaacgccccaaagcctccngatcgatgactgcatacctaatttagagtagtcggggacccataccccgtagttcaagtggcgagttggatcgagggaaactaaagttcaacttctacactatacagactagtctagacctaacttagaaacgttatttacgaaccttaaactttactagtttacgaactaacgtaagtaacgttactagttactttcttacgtacgtttcgaccgttaggtaccgagtacgaatacgtacaaaccgtatggtgactcgacctactactcgtattaccg

SEQ ID NO: 405373 - DNA, 655 bp, Homo sapiens
  misc_feature: GZ8MTXP02FL2IW.21.55.E11.1.454.CMB.2.raw
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccgacaagtcacgacaataaactacttttaatgtatcagcaacaaacgaggaacgaccccaaagctctgatcgatgactgactatacctaaatttaggaggtaacggtcggggtacccctagtaccccgtaggtttcgaggttgggacgtagtcgggtactcggtaaggggtaaacttaaaacgtttcctaacttcctacctaaaccgtacttacgaacgtacgtaagttccctagacctaaacctaggtaaacgttatttacgaaccttaaactttactattacgtaactaaactaagtaaccgtttaagtacgtttaactttcccgtttactaccgttttccggacccgttacgggtaccgtaagtacgtaaacttaactaccgtaaaaccgtacgtcggtaacggtaccgtacgaccctactacttacgttctttacc

SEQ ID NO: 405374 - DNA, 644 bp, Homo sapiens
  misc_feature: GZ8MTXP02HJ0TX.21.55.E11.1.454.CMB.2.raw
  modified_base (220)..(220): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtcctccatcatccctgtctgcatctgtcggagacagaatcactattattgccganaagtcacgacaataaactacttttaaatgtatcagcaacaaaccgaggaacgaccccaaagcctacctgatcgatcgctgactaagtaccctaaagtttaaggaggtaacggttcggggtacccctagtacccccgtaggttccaggttcggacgtagttgggatcgttaaggggaacttaaacgtttccaacttaccttaccaaccctataccaagcctagtcctagaccctaaaccgttagtaaacgttatttttacgaaccttaaacttttactaagtttacgtaacaaacgtagtaacgtttactagtttaacctttcctttacgtacctttcgggaccccgttagggaacccgtaagttcccgtaaattacgtacgtaaaacgtcgttagcgtactcgactacctactccgttattccc

SEQ ID NO: 405375 - DNA, 632 bp, Homo sapiens
  misc_feature: GZ8MTXP02G5981.21.55.E11.1.454.CMB.2.raw
  modified_base (198)..(198): a, c, t, g, unknown or other
  modified_base (221)..(221): a, c, t, g, unknown or other
tcagtcgtcgctcgcacgaccggtgctcgatttagcactcgcacgttgggtttgggggagtcagtctcagtcaggacacagcatggacatgagggtcccccgctcagctcctggggctcctgctactctggctccgaggtgccagatgtgacatccagatgacccagtctccatcatccctgtctgcatctgtcgganacagaatcactattattgccganaagtcacgacataaactacttttaatgtatcagcaacaaacgaggaacgaccccaaagctcctgatcgatgctgcatacctaaatttagagtacggtcggggtacccctagtcccccgtaggttccaggtggaccgtaagttgggtatacgttaggggtaaacctaaaactttcaccttactaccaacccattaccagctagttcctagaccctaacgtaggtaaatagttttacgactaaactttaccgtatttaggactaaacgtataacgtttacgtagtttactttacccgttacttaaccggtttcccggacccgtttacggggtaaacccgttagtaccggtaaacttactaaaccgaaaacgtacgttaggcgtacgtacggtaccctactactcttcgttacc

SEQ ID NO: 405376 - DNA, 709 bp, Homo sapiens
  misc_feature: GZ8MTXP02FRSLZ.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattcgaccggacaagtcaacgactaataaacttaactttttaatggtatcagacaacaaacgaggaacgaccccaagctactgatcgatgctgcatacctaagtttagaggtacggtcgggtacccagtaccccgtaggttacgaggtcggacgtagtacgggtcgttacggtacgggtaaaccttaaacgtttccaaacttcctaccaacccgtattcccgagtactacggttacctacgaaccgttaaaccgtaaggttaaacttacgtttacaaaccttaaaaccgtttattaacgttacgtaaacgtaaaacctaaagggttaactttaacgttaaactttaccgttttaacccctttccgtaaccggtttttacccgggacccggttaacggggtaaacccgttaaaggttacgtaaaacttaaccgttaaacgtaaaaccggtacttacggtaacggtcgtacgtacctaacgttactcgttcgtttaaccc

SEQ ID NO: 405377 - DNA, 877 bp, Homo sapiens
  misc_feature: GZ8MTXP02GBMN9.21.55.E11.1.454.CMB.2.raw
  modified_base (229)..(229): a, c, t, g, unknown or other
  modified_base (302)..(302): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgaccctagtcctccatcactccctgtctgcatctggtcggagacagaatcactattagttcgaccgganaagtcacgacaataaactacttttaatgtatcagcaacaaccaggaacgacccaaagcctctagatcgatcgntcgacactaccgtaaatttaggaaggtacggttcgggggtacccctacgttccccgtaagggtttaccgtaggtacggggtacggtaacgttacggggtacgttaccggtaaacgggggtaaaccttaaaagtttttacccccaactttacccttaaccctaaaaccccttaacgggtttaaacccaacggtaccgttaaacgggttaccctttaaaccgggtacccctaaaaccccggtttagttaaaacgggtttaacttttttaacccggaaaccttttaaaacccgtttaaacctttaacgttttacgggtaaaccccttaaaacgggttaacggtttaaaacccgttttaaacgttaaaccggtttttaacccttttaccccgtttttaacggttaaccccgggtttttacccgggaacccccggtttaaagggggtaaacccccggttaaaggtttacccgggttaaacttaacgttaaaccgtaaaaccgtaacggtttacggggtaaccgttacggtaaccggtaccgttacccctaaaggtttacccgttcggttttaaacccccg

SEQ ID NO: 405378 - DNA, 748 bp, Homo sapiens
  misc_feature: GZ8MTXP02HOJCO.21.55.E11.1.454.CMB.2.raw
  modified_base (204)..(204): a, c, t, g, unknown or other
  modified_base (261)..(261): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcctccatcactccctgtctgctatcgtggtcggaanacaagaactcactattattcgaccgatagtcacgacaataactactttaatgatcanacaacaacgaggacacccaagcctacagatcgatcgctacgactactacgtaaagttaggaaggtacggtacggggtaccctagttacccccgtaggttacgtacggtcggacgtaaggtggtacgtacggtaaggtaaaccttaactttccactacttaccaacctataccgtacgtaccgtaacgttaccgtacgtaaaccgtaaacgttaaggttaaacgtttacgtttaaacgtaaacctttaaaccgttttaacttaacgttttaagaaacctaaaacgttaacggttaaacggtttaacccgttaacgtttacccttttaccctttaaccgttcccgtttacccggggtaccccggttaaacggggaaaacccgttaaggttaaccggtaaacttaaaccggtaaaaccgtaaacggttaaaccggttcggtaacggtactaccgtaaccgtacctaacgtttccggtttaccgtttaccg

SEQ ID NO: 405379 - DNA, 615 bp, Homo sapiens
  misc_feature: GZ8MTXP02GIBV6.21.55.E11.1.454.CMB.2.raw
  modified_base (198)..(198): a, c, t, g, unknown or other
  modified_base (222)..(222): a, c, t, g, unknown or other
  modified_base (412)..(412): a, c, t, g, unknown or other
tcagtcgtcgctcgcacgaccggtgctcgatttagcactcgcacgttgggtttggggagtcagtctcagtcaggacacagcatggacatgagggtcccccgctcagctcctggggctcctgctactctggctccgaggtgccagatgtgacatccagatgacccagtctccatcatccctgtctgctatctgtcgganacagaatcactattattgccgganaagtcacgataataaactacttttaatgtatcagacacaaacgaggaacgaccaagctcctagatcgatgctgactatacctaagtttaggagtacgggtcgggacctagtccccgtaggttacgaaggtggtacgtaagtcggagttcgtagggtaaacttaacttccgaactcctacacgaatcgacncgtagtctacgaccaacgtacggtaattactttacgacttaaacttacttatacgtaacaacgtagtaacgttacttaagtttacctttcttacgttaccgttccggtacccgtaacgggtaccgtaagttaccgtaaagtactaaacgtaaaccgtacgttaggtccggtaatctaccgtaacgtcttaccgttcgtttacc

SEQ ID NO: 405380 - DNA, 664 bp, Homo sapiens
  misc_feature: GZ8MTXP02JK9E0.21.55.E11.1.454.CMB.2.raw
  modified_base (196)..(196): a, c, t, g, unknown or other
  modified_base (310)..(310): a, c, t, g, unknown or other
  modified_base (352)..(352): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattcgccggacagtcacgactaataaactacttttaatgtatcagcaacaaaccgaggaacgaccccaagctactgatcgatgctgcatactatttaggngtagtcgggtccagtcccgtagttcgagtcggtcgagtggtntcggtaggaaacttaagttccaactccgactaaccgattacgaatctacgtcgtaagtccctaaacgtagtaagttactttacgacttaaactttaactagtttacgtaaacaacgtaacgttaacttacgttacgtttaactttccctttcggtttaaacccgtttccgggtaacccccggtttaagggaaccccgtttaaaggtacccggttaaaagttaaccctaacccgtaaaaacgggttccttaacgggggttaaccgacttaaccccggtcgtaaaaccttcggtttaacttccggttttaaccc

SEQ ID NO: 405381 - DNA, 755 bp, Homo sapiens
  misc_feature: GZ8MTXP02JBJE5.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtctccatcactccctgtctgcatctggtacggagacagaactcaacctattacgtttcgaccggaacaacgtcaacgaacaacttaaacttaacctttttaaatgtatcacacaacaaaccgaggaacgacccaagcctctagatcgatcgctgactactaccgtaaattacggagtacggtcgggtacctacgtccccgtaggttaccgtaggtacgggcgtacggttagggtacgttacggtaacggggtaaaccttaaaacgtttccctaacgttacccttacccgaaaccctacttaccgacgtaacgtaccggttaccgtacgtaaacccgtaaaccgtttaagtaaacggtttacttttaccggtaaaaccgtttaaacccgtttttaacttaacgtttacggtaaactaaacggttaaacgttaacgtttaacgtaacgttttacctttacctttaccggttaccgtttcccgggacccgtaacggggtacccgtaaaggtacccgtaaattaacgaacctaaaacgtacgtacggtaacggtctaacggtacctacctttaacgtccgttaccgtttacc

SEQ ID NO: 405382 - DNA, 634 bp, Homo sapiens
  misc_feature: GZ8MTXP02I94WP.21.55.E11.1.454.CMB.2.raw
  modified_base (218)..(218): a, c, t, g, unknown or other
  modified_base (227)..(227): a, c, t, g, unknown or other
  modified_base (246)..(246): a, c, t, g, unknown or other
  modified_base (251)..(251): a, c, t, g, unknown or other
  modified_base (274)..(274): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgcganagtcacganataactactttaatgtatnagcanaaccaggacgcccaagctctagntcgatgctgcatacctaaatttagagtaggtcggggtaccctataccccgtagttccaggtcggcgtaagtcgatcgtagggtaacttaaactttccactcctacaaccagttacaggctaaggttctacgacctaacgtaggttaactactttcgaaaccttaactttaacgttacgttttacgaaaccttaaacgtaaggttaacgtttaaactaaccggttttaccttttaacccgtttccgttaaaccgtttcccggggtacccttaccggggtaacccgttaaagtcccggtaaaattacgttaacgaaaaccgtacttggtaacgtctacgacctacctatacgtctttaaccg

SEQ ID NO: 405383 - DNA, 584 bp, Homo sapiens
  misc_feature: GZ8MTXP02HAQZC.21.55.E11.1.454.CMB.2.raw
  modified_base (197)..(197): a, c, t, g, unknown or other
  modified_base (224)..(224): a, c, t, g, unknown or other
  modified_base (296)..(296): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcactattattcgaccggaanaagtcaacgataataaactacttttaaatgtatcagacaacaaaccgaggaacgaccccaaagtcctcgtanactcgatgctgacaattacctaaatttacggagtacggttcggggtacccagtccccgtaaggttccaaggtcggtagtaattcggatcgtaggtaaacctaaatttccactactacacctatccgaatactacgtactcgacaactacgtaagtattatactaacttaacttacttatactaactaataagtactaacttacttacttacttacgttcgtccgttacggacgtacgtactataactactaaacgaacgtacgtaagtacacacactactactacttc

SEQ ID NO: 405384 - DNA, 623 bp, Homo sapiens
  misc_feature: GZ8MTXP02I4GOC.21.55.E11.1.454.CMB.2.raw
  modified_base (196)..(196): a, c, t, g, unknown or other
  modified_base (294)..(294): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaatcacctattattgccggacaagtcacgacataaactacttttaaatgtatcagcaacaaacaggaacgaccccaaagcctctgatcgatgcngctatacctaaatttagagtagtcgggtaccatccccgaggtcagtggcgtatggatcgtagggaacttaaagttccaactctacaacctataccagcagttctgacctaaacgtgtaaagttatttacaaccttaaacttttattaacgttagttaaaaccaaaaaagggtttagttaaacctaaggttttactttaccctttaacgttaccgttttaccgggaccccgttaggggtaaacccggtaaaattcccggtaaaatacgttaaacaaaaccgttaactggttacggcttacgactaaccctagtttacgtctacctttacc

SEQ ID NO: 405385 - DNA, 560 bp, Homo sapiens
  misc_feature: GZ8MTXP02FWPVV.21.55.E11.1.454.CMB.2.raw
  modified_base (253)..(253): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgaccggacagtcacgacataaactacttttaaatgtatnagcacaacaggaacgccccaagctcctagatcgatgctgcataccaattagagagtggggtcccatccccgaggttcagtggcgaagttggatcgagggtaactaaactttcactctacacctatccagcagtctagacctaactagaaagttatttacgaacttaaactttacttagtcgtaacaaacgtagtaacgttactaagttacttttaccttcgtaacgtttcggcccgttagggtaccgtaagtacgtaatactacgaaaacgtacgttgtaaggctcgacctacctagtccttgttac

SEQ ID NO: 405386 - DNA, 598 bp, Homo sapiens
  misc_feature: GZ8MTXP02GDRB0.21.55.E11.1.454.CMB.2.raw
  modified_base (200)..(200): a, c, t, g, unknown or other
  modified_base (224)..(224): a, c, t, g, unknown or other
  modified_base (258)..(258): a, c, t, g, unknown or other
  modified_base (282)..(282): a, c, t, g, unknown or other
  modified_base (570)..(570): a, c, t, g, unknown or other
tcagtcgtcgctcgcacgaccggtgctcgatttagcactcgcacgttggggtttgggggagtcagtctcagtcaggacacagcatggacatgagggtccccgctcagctcctggggctcctgctactctggctccgaggtgccagatgtgacatccagatcgacccagtctccatcactccctgtctgcatctgtcgganacagaactcactattattgccganagtcagactaataaactaccttttaatgtatcancaacaaacgaggaacgacccaaancctcctagatacgatgctgacactactaattagaggtagtcggtacccagtccccgagttcgaaggtcggataagtcggtgtcgtaacgggtaaactaaacgtttccaacttcacccaacctagtcctaagactacgttcacgacctaaactgtaaacgttagtttacaaccttaaagttaacttagtacgtaactaaacgtattaacgtactacgtttacttcttactcgttaccgcccgtagggacctaagtcgtaaataccgtaacgaaaacgtcgtagaacgtnacgtacaaccgtactacgttctttaccc

SEQ ID NO: 405387 - DNA, 635 bp, Homo sapiens
  misc_feature: GZ8MTXP02HDS4A.21.55.E11.1.454.CMB.2.raw
  modified_base (196)..(196): a, c, t, g, unknown or other
  modified_base (261)..(261): a, c, t, g, unknown or other
  modified_base (513)..(513): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcgganacagaactcacctatttagttgaccgaactaaggtcaacgaactacttaaaactacctttttaancggtatcagtacaacaaaccgaggaacggaccccaaagtcctacgtagattccgatcggctacggcaacttacgtaatttaggacgtaacggttcggggtaccctagtcccccgtaggttacgaacggtcggtacggaagtcggtactccggttaagggtaaacctaaacgtttccaaccgtttacactaccgatccaggactagactcgaccaaactaggtaactacttttacgactttaaaccttaagtntttacaaactacgtaagttaacgttacgtattactttccttagtccgtttaccgcgttacgggacctagttacacgtaactacgaaacgtgtcgtaagtaccacgtacactcgtactactac

SEQ ID NO: 405388 - DNA, 685 bp, Homo sapiens
  misc_feature: GZ8MTXP02HSYFV.21.55.E11.1.454.CMB.2.raw
  modified_base (128)..(128): a, c, t, g, unknown or other
  modified_base (233)..(233): a, c, t, g, unknown or other
tcagtcgtcgctcgcacgaccggtgctcgatttagcactcgcacgttgggtttgggggagtcagtctcagtcaggacacagcatggacatgagggtccccgctcagctccgtggggctcctgctactntggctccgaggtgccagatgtgacatccagatcgaccagtctcatcactcctgtctgctatctggtcggagaacaagtaactcaactatttagttcggaccgaanaacgtcaacgaactaacttaaaccttactttttaaagtggtaactacgacgacaaccgaaaacggagggaacgaccccaaagtcctccgtagactcggaatggacgtacgactaacgttacctaaagtttaaggaggtaacggttccggggacctaacgtcccgtaagttccgaggtcgggactaaggttgacgttcgtaaacgggaaacttaaaactttccaacctactacccaaacttcacgtagacctaggtacacgtaacaacgtagtaactttcttagaaccttaattatactttagaacaaacgagtttaacgtaaactagtttaacttcccgtttacgtacggtttccgacggtacggtaaaccgttagtaacctattaaaacgtaacccgtaaaagtaaccgttggaacgttacgacgaaccttacacgtttacgtctttaccg

SEQ ID NO: 405389 - DNA, 740 bp, Homo sapiens
  misc_feature: GZ8MTXP02HIL72.21.55.E11.1.454.CMB.2.raw
tcagtcgtcgctcgcacgaccggtgctcgatttagcactcgcacgttggggtttgggggagtcagtctcagtcaggacacagcatggacatgagggtccccgctcagctcctggggctcctgctactctggctccgaggtgccagatgtgacatccagatcgacccagtctccatcactccctgtctgcatctgtcgagacaagactcactattattcggaccgacaagtcaacgaactaacttaaactaccttttaaagtgtatcagacaacgaaaccgaggaaccgaccccaaagtcctactagatcgatcgctagactactacctaaagttacggaggtacggtccgggtaccctagtaccccgtaggttacgaggtcggacgtagtcggtacgtcggtaacgggtaaaccttaaactttcccgactaccttacccgaacctactaccgtaacgcgtacgttccgtactacccgtaaacgttagttaaaaccgtttagtttaccgaaaaccgtttaaacctttaacgttacggtttaacaaccgaaaaccgttaaggttaaaccgtttaacgtacgttttaacctttaccgtttaccttaacccgggtttcccgggtacccgttaacggggtaacccgttaaggttacgtaaacttaaccgtaaaaccgtaaacggttaaccgttggtaacggtccgtaaccgtaacctaacctacgttccgttacgttttaacccc

SEQ ID NO: 405390 - DNA, 629 bp, Homo sapiens
  misc_feature: GZ8MTXP02HWC3B.21.55.E11.1.454.CMB.2.raw
  modified_base (196)..(196): a, c, t, g, unknown or other
  modified_base (287)..(287): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggcgccagatgtgacatccagatgacccagtctccatcatccctgtctgcatctgtcgganacagaatcacctattattcgccggacagtcacgacaataactaccttttaaatgtatcagacaacaaacgaggacgaccccaaagctaccngatcgatcgctcgactaactacctaaagtttacgaggtacgggttcggggtaccctaacgttccccgaaggtttaccgaggtacgggtacgtaagttgggtacttacgggtaaggggtaaaccttaaaacgtttccaacttccttacccacctactacaggtctaacggtcctagacctaacgtagtaacgttatttcgaacttaaacctttattatttagacaacgtagtaacgtactagtttacttactttcgttaacgttcccggtaccttacgggacctaagtacgtatactaacgaacgtaagtcggtaacgctacgactacgactccgttacttcc

SEQ ID NO: 405391 - DNA, 663 bp, Homo sapiens
  misc_feature: GZ8MTXP02F3J97.21.55.E11.1.454.CMB.2.raw
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgacccagtctccatcactccctgtctgcatctggtcggagacagaactccactatttagttcgaccggaactaagtcaacgaactaattaaacttaacttttaaagtgtatcagacaacgaaaccgaggaacgaccccaaagtcctactagactcggatcgtactcgactaacttaccgtaaagttaaggaggtacggtcggggtaccctagtaccccgtaggttcagggtcggtacgtacgtggtcgtacgaaggtaaacttaaacgttcctaactcctacccactaagtaccgagtactacgtacacgtacctaacgtagttaagttactttacgtacttaaacgttacttagtaccgtaactaaacgtagtaacgttaactactttactttaccgttaccttaccggttaccggacgtacgggtaactagtacgtaaacttacgtaacgtaaaacgtcgttacgaacggtactacgacctacgtacgtacgttactttacc

SEQ ID NO: 405392 - DNA, 658 bp, Homo sapiens
  misc_feature: GZ8MTXP02FFSUO.21.55.E11.1.454.CMB.2.raw
  modified_base (219)..(219): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcactattattgccganaagtcacgacataaactacttttaatgtatcagcaacaaacgaggaacggaccccaaagctctagatcgatgactgactaataccgtaaattacggaaggtacggtcggggtaccccctaagtacccccgtaagggtttaccgaggttcgggacgtaagttggggtactccgggtaagggtaaactaaaatttccaacttcctaccaaccctataccagtacctagtcctagaccctaaactaaggtaattactttacgacctaaacttactatttacgactaaacgagtacttactacgttactttccctacgtaccgtttaccggaccgttaacgggaacccgttaagtaccgttaaatacgtaaaaccgtaaaacgtccgttaaggtcggtacccttacggacccctaaaccgtttacgttaccgttacgtttacc

SEQ ID NO: 405393 - DNA, 731 bp, Homo sapiens
  misc_feature: GZ8MTXP02ISP8M.21.55.E11.1.454.CMB.2.raw
  modified_base (198)..(198): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtcctccatcatccctgtctgcatctgtcgganacagaatcactatttattgccggacagtcacgacaataaactacttttaaatgtatcagacaacaaaccgaggaacgcccaaagcctctgatcgatgctgacatacctaaagtttaggaggtaggtccggggtccctagttcccccgtaggttcaggttcggacgtagttcgggcgttacgtacggggtaaaccttaaaacttttccgaaccttaccttaccaaccctataccgaacgcgtaacgttctacgtaaccctaaccgttaggtaaaacgttatttcgtaaacccttaaactttacttaagtttacgtaaccctaaagtaacggttaacgtttaactaacggtttttacctttacccgttttacgttaacccgtttttcccggggacccccggtttaaacggggtaaaccccggttaaagggtttaccctaaacgttaaaccgttaaccgaaaaaaccgggtttccgttagggtttaaccggccttacgtaaaccccgtactaccgttttcgttaacgtttttcccg

SEQ ID NO: 405394 - DNA, 603 bp, Homo sapiens
  misc_feature: GZ8MTXP02HX7R1.21.55.E11.1.454.CMB.2.raw
  modified_base (188)..(188): a, c, t, g, unknown or other
  modified_base (195)..(195): a, c, t, g, unknown or other
  modified_base (217)..(217): a, c, t, g, unknown or other
  modified_base (276)..(276): a, c, t, g, unknown or other
  modified_base (287)..(287): a, c, t, g, unknown or other
  modified_base (336)..(336): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctcgaggtgccagatgtgacatccagatgacccagtctccatcatccctgtctgcatcngtcgganacagaatcacattattcgcganaagtcacgacaataaactactttaaatgtaatcagcaacaacaggaagccaaagctctnatcatgactgnatccaaatttagagtaagtgggtacccactaccccgaggttacaggtgngtagcgatgtagggaacctaaatttcactctaccaaccacacgagtacacgtactcgaacctaacgtaagtaagttattacgtactaactttaacttaacggttataaccgtaaacgtagtaacgttaaactacgtttaacctttacctttaccgtaacccggtttaccgggtaacccggtacggtaaaaccgtaacggttacctaaataaacgtaaacgtaaaacgtacgtaggtccgtactacgacgaaccgtactactacgttc

SEQ ID NO: 405395 - DNA, 703 bp, Homo sapiens
  misc_feature: GZ8MTXP02GFI5G.21.55.E11.1.454.CMB.2.raw
  modified_base (299)..(299): a, c, t, g, unknown or other
  modified_base (367)..(367): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgacccagtcctccatcactccctgtctgcatctgtacggagacagaatcaactatttagttcgccgacaagtcaacaactaataaacttaacttttaatgtatcacacaacgaaacgaggaacgaccccaagcctactnatcgatgactgctaactacctaaatttaggaggtacggtcggtaccctagttaccccgtaggttacgngtacggagtacgtggtacgtcgtaacggtaaacttaacgtttccaaccctctacctaaccactaccgtatacgtacgtccgttacgaacccttaaacgtaacggtaaactttcgtttaactaaacctttaaaccttaattacgtttaactaacctaaagtacgttaacgtttaacaacgtttttaccttaccgtttaccttccggttttacccgggacccgttaaacgggggtaaaccccgtaaggttaccgtaaacggttaaactaacccggttaaaaacgtcggttaaggtaaccgttcgaacgttaccctaccgttacgtcgtttactttacc

SEQ ID NO: 405396 - DNA, 673 bp, Homo sapiens
  misc_feature: GZ8MTXP02GGUXO.21.55.E11.1.454.CMB.2.raw
  modified_base (217)..(217): a, c, t, g, unknown or other
  modified_base (224)..(224): a, c, t, g, unknown or other
  modified_base (233)..(233): a, c, t, g, unknown or other
  modified_base (252)..(253): a, c, t, g, unknown or other
  modified_base (255)..(255): a, c, t, g, unknown or other
tcagtcgtcgctcgcacgaccggtgctcgatttagcactcgcacgttggggtttgggggagtcagtctcagtcaggacacagcatggacatgagggtccccgctcagctcctggggctcctgctactctggctccgaggtgccagatgtgacatccagatgacccagtctccatcactccctgtctgcatcgtggtcggagacagaatcaactattnttgcganagtcacganaataactactttaatgtannancaacaaacgaggaacgacccaaagctcctgatcgatgctgaccaatacctaaatttaaggagtaggtcgggtaccctataccccgtaggttccaaggttcggacgtagtggacgtcgtagggtaaactaaacgtttcgactactaccaccctatacacgacgtacgtcttacggaacctaacctaggtaattaactttacgaaacttaaacctttaattacttaggtaaacctaacgtaaggttaaacgtttaactaacgtttactttacccttttacgttaaccgttttccgggacccggttaacgggttaaccggtaaaccgttaggtaactttaaaccgtaaaacgtaaaaccgtaaccggttggtaaccggttaaccgtacgtacccgtaactttacgtccgtttaccgttacg

SEQ ID NO: 405397 - DNA, 556 bp, Homo sapiens
  misc_feature: GZ8MTXP02HW856.21.55.E11.1.454.CMB.2.raw
  modified_base (195)..(195): a, c, t, g, unknown or other
  modified_base (216)..(216): a, c, t, g, unknown or other
  modified_base (225)..(225): a, c, t, g, unknown or other
  modified_base (258)..(258): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctcgaggtgccagatgtgacatccagatgacccagtctccatcatccctgtctgcatctgtcgganacagaatcacattattgcganaagtcaganaataaacacttttaaatgatcagacacaaaccnggaacgccccaaagctctgactcgatgctgcatccaaagtttacgagagtcgggtcccattccccgaggttcaggtggcaagtcggatcgtaggaactaaatttcaactctacaaccatcagctagtctgaccaactagaaagttactttgacctaaatttactaagtttcgaacaaacgtagtaaagttacagtttaatttccttaccgtaactttcgggacccttggggaaacctaggtctaatacgtacaaacgtacgtgtaacggacttacggacctacctattcctaagtccc

SEQ ID NO: 405398 - DNA, 573 bp, Homo sapiens
  misc_feature: GZ8MTXP02H00RN.21.55.E11.1.454.CMB.2.raw
  modified_base (223)..(223): a, c, t, g, unknown or other
  modified_base (496)..(496): a, c, t, g, unknown or other
  modified_base (545)..(545): a, c, t, g, unknown or other
  modified_base (549)..(549): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcatccctgtctgcatctgtcggagacagaatcacctatttattcgccganaagtcacgacataaactacttttaaatgtatcagcaacaaacgaggaacgaccccaaagcctcctgatcgatgctgacacttaccctaaagtttagaggtaaggtcggggtaccccaagttccccgaagggttcaggtggacgtagtggattcgtagggaaactaaatttccactctacaccatcagctaacgtctgaacctaacctaggtaacttatttcaaccttaaacttactattcgataacgtagtacgttacagttactttcctttntaccgtttcggcctaacgggacctaagtcaatacgtccaaaaacggttntagngtaccacgacctactcgtctcttc

SEQ ID NO: 405399 - DNA, 757 bp, Homo sapiens
  misc_feature: GZ8MTXP02HE4WD.21.55.E11.1.454.CMB.2.raw
  modified_base (198)..(198): a, c, t, g, unknown or other
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgacccagtcctcatcactccctgtctgcatctgtcgganacagaactcaacctatttagttcggaccggaacaagtacaacgtaactaaacttaaaccgtttaaccttttaaagtacggtaactacgaacgaaccaaaccgtaaaacggacgggaaaccggaccccaaagtccctactagacgtcgatcgactgacctaataccgtaaagtttacgaggtacggtcggtaccctagtcccggtaacgtcgagtcggagtacgtcggatacgggtaacggtaaccttaaattccctacgtacctacctaacctaacgtacgaacgtactacggttcgtaccgaaaccgttaacgtaacggttaaacgtttactttacgtaaactttaaaccgtttaaacgttacgtttaacgtaacgttaaaccggttaaagttaaccggtttaaacttacgttttaaccgtttcccgtttaaaccgtttacggtttaccccggaccgggttaaccgggtaaaccgtaacgttacggtaaactacgtaaaacccgtaaacggtcgttaacgtccgtacgtacgtcctaaacgtcttacggtctttaccc

SEQ ID NO: 405400 - DNA, 663 bp, Homo sapiens
  misc_feature: GZ8MTXP02GZVI2.21.55.E11.1.454.CMB.2.raw
tcagtcgtcgctcgcacgaccggtgctcgatttagcactcgcacgttgggtttgggggagtcagtctcagtcaggacacagcatggacatgagggtcccccgctcagctcctggggctcctgctactctggctccgaggtgccagatgtgacatccagatcgacccagtctccatcactccctgtctgcatctgtcgagacagaactcactattattgccgacaagtcagactaataaactacttttaatgtatcagcaacgaaacgaggaaccgacccaagcctcagatcgatgctgcaatcctaaagtttgaggtacggtcgggtaccctagtacccccgtaggttcaggtcggacgtaagttcgggacgtacggtaacggtaaaccttaaacgtttcccgaacttccgtaaccaaccctagtaccgaacgtacgtacgttaccgtacgaccctaaacgttcgggtaaaatttccgtttaacaaaccctttaaacgttaactttacgttaccgtacgtaaacgttaacgtaaacgtttacctaaacgttttaccctttacccgtttacggttaaccccgtttcgggacccggttaacggacgtacgttacgaagttacacgtaaacgtactggccgtactcgactcgtactcttacgttac

SEQ ID NO: 405401 - DNA, 745 bp, Homo sapiens
  misc_feature: GZ8MTXP02GFZCD.21.55.E11.1.454.CMB.2.raw
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatcgacccagtctccatcactccctgtctgctatcgtgtcggaagaacaagaactaccaacctatttactttcggaccggaactaacgtcaacgaactaaacttaaacttaacctttttaaagtggtatacgacgaccaaacgaaaccgaggaaccgacccaaatctcgtagacgtcgatgactgactatactaaagttaggaagtacggtcgggtacctacgtcccgtacggttacgaggtcggtacgtagttacggtacgtacggtaacgggtaaactttaaaccgtttccaacctttaccctaacgtaccctagttccgaagtccttacgtccgtaacgaaccgttaaccgttaagttaaagttacgtttacaaacctttaacgttaatttaacgttcgtaaccttaaacgtaagttaaccggttaattaaccgttttacttacccgtttacgtaacccggtttcccgggaccgtaaaccgggttaccgtaattaacccggttaattaaacctaacgtaaaaccggtacgttacggtaaccggtacaccgttaacctacctttacgtacccgtttcgtttaacccc

SEQ ID NO: 405402 - DNA, 712 bp, Homo sapiens
  misc_feature: GZ8MTXP02HIT9S.21.55.E11.1.454.CMB.2.raw
  modified_base (226)..(226): a, c, t, g, unknown or other
  modified_base (235)..(235): a, c, t, g, unknown or other
  modified_base (258)..(258): a, c, t, g, unknown or other
  modified_base (279)..(279): a, c, t, g, unknown or other
  modified_base (283)..(283): a, c, t, g, unknown or other
  modified_base (293)..(293): a, c, t, g, unknown or other
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatcgaccagtcctccatcatccctgtctgcattcgtgtcggagacagaactcactatttattgaccganagtcacganaactaactacttttaatgatcanacaacaacgaggacgaccaanctcnactcgatcgntacgacactacctaagtttagacggtacggtccgggtcctaagtaccccgtacggttcgacgggtaggtagtaggtacggacgttaccgggttaaaggtaaaccttaaattttcccaacgttacccttaaccaacctacgtaccgtacgaccgtaacgttccgttacggaccgttaaaccgttaggttaaacctttagtttactaaaccgttaaccttttatacgtttaacgtaacctaaagtaaacggtttacgttaacgttaaagtttcccttttacctttaccgttaccggttttaccgggaaccccggtttaacgggaacccgttaacggttacgtaaactttaaacgaaaccgttaacgtaaccgttggttaacggacttaccggactaaccgtttacttaccgtttactaccg

SEQ ID NO: 405403 - DNA, 693 bp, Homo sapiens
  misc_feature: GZ8MTXP02GI6W7.21.55.E11.1.454.CMB.2.raw
tcagtcgtcgctcgcacgaccggtgctcgatttagcactcgcacgttgggtttgggggagtcagtctcagtcaggacacagcatggacatgagggtccccgctcagctcctggggctcctgctactctggctccgaggtgccagatgtgacatccagatgacccagtctccatcactccctgtctgcatctgtcggagacagaatcacctattattcgaccggacaagtcacgacaataaactaccttttaaatgtatcagacacaaacgaggaacgaccccaaagctcctagatcgatgctgcactacctaagtttaggagtacggtcggggtacccacgtccccgtaggttcaagggtggaccggtagtgggtactcgtacgggtaaactaaaccgttttcaaccttctaccaacctacgtaccgacgtacgtaagtcccgtacgaacctaaccgtaaggtaaacgttacgttttacgaacctttaaaactttaacttacgtttaccggtaaacaaacgttaaggttaacttaaccgttaagtttaccgttttacctttaccgttacccgtttacccggtacccggttcgggtaaaacccgttaggtaccgtaactaacgttaacgaaaacccggttaagtccggtaagtacccgtagtacccaaccgttacgtaccgtttacgtttcccg

SEQ ID NO: 405404 - DNA, 786 bp, Homo sapiens
  misc_feature: GZ8MTXP02FTR6S.21.55.E11.1.454.CMB.2.raw
tcagtcgtcgctcgcacgaccggtgctcgatttagcactcgcacgttgggtttggggagtcagtctcagtcaggacacagcatggacatgagggtccccgctcagctcctggggctcctgctactctggctccgaggtgccagatgtgacatccagatacgacccagtctccatacactccctgtctgctatcgtggtacggaagaacaagaactaccaaccttaatttacgtttacggacccggaactaacgtaccaaacgtaactaaacttaaaacctttaactttttaaagtacggtaactacgaagaaccaaaccgaaaccggaacgggaaaccgaaccccgaagtccgtacctagacgtacgagtacgtctacggacttaacgtaaccgttaagttaacggtaacggtacggggtaccgggtaccctacggttaccccgtaacggttcgaacgggttacggtacgtagttacggacggttacgaaagggtaaacctttaacttactaccttaccgacctaaccgattaccggactacgtacgtactacgtacccgtaacgtaaggttaacttaacgtttactaaaacccctttaaagtttaaacgtttaaccggtactaaaccgtaaagttaaacggttaacgttaaacttaacgtttactttcccgtttaacgtacccgggtttccggaacccgggtacgtaaccgggttagtacgttaaactaacggtaaacctaaacgacgttaggtaactcggactacgtacctagtccttacttac

SEQ ID NO: 405405 - DNA, 520 bp, Homo sapiens
  misc_feature: GZ8MTXP01CAFG9.3.48.E04.1.454.CMB.2.raw
  modified_base (246)..(246): a, c, t, g, unknown or other
  modified_base (306)..(306): a, c, t, g, unknown or other
  modified_base (368)..(368): a, c, t, g, unknown or other
  modified_base (492)..(492): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttggaggtcggggggagcgtggcccagcctgggacgtccctnagctctctgtgcagcgtctggattcagtttcgctacacatggcatgctacgtgggtcccnccagtctccgaggcgaagggggctgcaggtggggtgtccgtttatcgaagcgagtgggactnatagaaacaatatgacagactcggtaggaacgggcgtattcatcatctacagacgaacaacctaccaaacaacacactgactcaccaatcgaacagctgaagagcgaggacgacggcttagttnttagtgtgtccttgattactaattgtaa

SEQ ID NO: 405406 - DNA, 540 bp, Homo sapiens
  misc_feature: GZ8MTXP01CDXHK.3.48.E04.1.454.CMB.2.raw
  modified_base (243)..(243): a, c, t, g, unknown or other
  modified_base (302)..(302): a, c, t, g, unknown or other
  modified_base (377)..(377): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtgggacgtccctnagactctcctgtgcagcgtctggattcagtttcgctacacatggcatgcacgtggtccncagtctccgaggcgaaggggctggcaggtgggtgtccgtttagtcggaagcgagtcgggactcatagaaacatancgacagactccgaggaacggccgattcatcatccacagacacaacctaccaaacaacacactagactacctaccaaatcgaaccacgcctagaacggacgttcggaacggacgacggtcttagttattacgttgtcgtcccttagtacttactaagttgtaag

SEQ ID NO: 405407 - DNA, 516 bp, Homo sapiens
  misc_feature: GZ8MTXP01EU9IU.3.48.E04.1.454.CMB.2.raw
  modified_base (242)..(242): a, c, t, g, unknown or other
  modified_base (302)..(302): a, c, t, g, unknown or other
  modified_base (360)..(360): a, c, t, g, unknown or other
  modified_base (372)..(372): a, c, t, g, unknown or other
  modified_base (382)..(382): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggacgtccctnagactctcctgtgcagcgtctggattcagtttcgctacacatggcatgcacgtgggtccncagtctccgaggcgaaggggctgcaggtgggtgtcgtttatcgaagcgagtgggactnatagaaacatangcagactcgngaaggcatcatcatcaccagacgacaactaccaacaacacactcggactacaactacacacgactcgagaagtcgacggacgacgacgtaacttagttattagtcgtaccttcgtattacttatgttaagtaag

SEQ ID NO: 405408 - DNA, 580 bp, Homo sapiens
  misc_feature: GZ8MTXP01C4VYH.3.48.E04.1.454.CMB.2.raw
  modified_base (242)..(242): a, c, t, g, unknown or other
  modified_base (302)..(302): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggacgtccctnagactctcctgtgcagcgtctggattcagtttcgctacacatggcatgcacgtgggtccnccagtcctccgaggcgaagggggctggcgtaggtggggtggtccgtttatcgagcgagtgggactcatagaaactaatatcgacacgaccgtccggtaggaaacgggccgtaatttcaattccaacttcctacccaagaacgaaaccaaacctaccaaacaaaccaactacgtaggaactacctaaccaaaatcgaaacacgccgtagaacgaggttcgaacggacgacggtacttaagttcttattgtacgtcccttagtacttactaagttgtaag

SEQ ID NO: 405409 - DNA, 509 bp, Homo sapiens
  misc_feature: GZ8MTXP01EVK4A.3.48.E04.1.454.CMB.2.raw
  modified_base (239)..(239): a, c, t, g, unknown or other
  modified_base (386)..(386): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggccagcctgggagtccctnagactctcctgtgcagcgtctggattcagtttcgctacacatggcatgcactgggtcccgccagtctccaggcaagggggctgcagtgggtgccgtttatcgaagcgatgggactcatgaacatatgcagactcgtgaggcgatcancatctcagagacaactaccaacaacaacactaggactactaccaaactacgaacacgcctgaagagttacgacggacgaacggtccaagttacttattgtgccctttggacttactaattgaa

SEQ ID NO: 405410 - DNA, 556 bp, Homo sapiens
  misc_feature: GZ8MTXP01A6MQP.3.48.E04.1.454.CMB.2.raw
  modified_base (242)..(242): a, c, t, g, unknown or other
  modified_base (303)..(303): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggacgtccctnagactctcctgtgcagcgtctggattcagtttcgctacacatggcatgcacgtcgggtccnccagtcctccgaggcgaagggggctgcaggtgggtggtccgtttatcggaagcgagtcgggactcgatagaaacaatatgacacgactccggtaggaacgggcctattcgaatcatcctaccgagacgaacaacctaccgaaacaacacactacgactcctacaaatcgaacacgcctgaagacgttacggacgaccgacgggtaccttagttacttagttcgtcgtaacccttgtacttactaagttgtaag

SEQ ID NO: 405411 - DNA, 507 bp, Homo sapiens
  misc_feature: GZ8MTXP01AC7MH.3.48.E04.1.454.CMB.2.raw
  modified_base (240)..(240): a, c, t, g, unknown or other
  modified_base (299)..(299): a, c, t, g, unknown or other
  modified_base (392)..(392): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctnagactctcctgtgcagcgtctggattcagtttcgctacacatggcatgcacgtggtccncagtctccaggcaaggggctgcaggtgggtgccgtttatcgaagcgatgggactcatgaaacatatgcagactcgtgaaggcgatcatcatcnccagacgacaactaccaacaacacactagatacaccaaatcgaaacacgcctgaagacgttcgaggacgacggtacttagttattattgtcgtcccttgtacttactaattgtaa

SEQ ID NO: 405412 - DNA, 524 bp, Homo sapiens
  misc_feature: GZ8MTXP01CKU96.3.48.E04.1.454.CMB.2.raw
  modified_base (244)..(244): a, c, t, g, unknown or other
  modified_base (304)..(304): a, c, t, g, unknown or other
  modified_base (491)..(491): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcgggggagcgtggcccagcctgggacgtccctnagactctcctgtgcagcgtctggattcagtttcgctacacatggcatgcactgggtcccnccagtcctccgaggccaagggggctgcaggtgggtgtccgtttatcgaagcgagtgggactcatagaaacatatgcagactccgtagacgggccgtatcatcatctaccagacgacaactaccaacaacacactgactcaccaaatcgaacagcctgaacgacgttcgacggacgacggcgttattnttacttgtcgtcccttgacttactaagttgtaa

SEQ ID NO: 405413 - DNA, 537 bp, Homo sapiens
  misc_feature: GZ8MTXP01ELA2B.3.48.E04.1.454.CMB.2.raw
  modified_base (178)..(178): a, c, t, g, unknown or other
  modified_base (245)..(245): a, c, t, g, unknown or other
  modified_base (307)..(307): a, c, t, g, unknown or other
  modified_base (468)..(468): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagnggtgtccactgtcagctgcttctagttgaggtcggggggagcgtggccccagcctgggacgtccctnagactctcctgtgcagcgtctggattcagtttcgctacacatggcatgcacgtcgggtcccncagtcctccgaggcgaagggctgcaggtgggtgtccgtttattgaagcgagtgggactcatagaaacatatgacagtactcgtaggaacgggcctattcaatcatccaccgagacacaacctaccaaacaacactactagactacctaccaaatcgaaacngcctgaagtacgttcggaaggacgacgggtacttattacttatgtctccttagacttactaagttgtaa

SEQ ID NO: 405414 - DNA, 679 bp, Homo sapiens
  misc_feature: GZ8MTXP01A79ZT.3.48.E04.1.454.CMB.2.raw
  modified_base (243)..(243): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtgggacgtccctnagacctctcctgtgcagcgtctggattcagttcgctacacagtggcatcgctacgtcgggtcccgcctagtcctccgaggacgaaggggctgcgtaggtgggtggtccgtttagtacggaagcgagtacgggactcgaatacgaaactaagtagtacgactacggtaccgtacggtacggtaaacggggtcccgtaacgttacctaacgttacctaacttccctaacccgaacgaaacgaaaccctaaaccctaacccgaaaacctaaaccaaccgtaacgtaacggtaacctacccgtaaacctaaaacgtaccgaaaccgtacgtacccgtaggaaaggtaacggttaccgggaaacggaaccgtaaccgggtaccgttaagttacgtttacgttcggttacgtaacccgtttagtacttacgtaagttgtaag

SEQ ID NO: 405415 - DNA, 591 bp, Homo sapiens
  misc_feature: GZ8MTXP01AXM17.3.48.E04.1.454.CMB.2.raw
  modified_base (243)..(243): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagtgaggtcgggggagcgtggcccagccgtgggacgtccctnagctctcctgtcgcagcgtctggattcagttcgctacacatggcatgcacgtcggtccgccagtctccgaggcgaagggctgcgaggtggtgtccgtttagtcgaagcgagtcgggactcgatacgaaactaatagtgactaacgaccgtcggtaggaacggccctagttacactcacttcacagaacaaccaacctaccaaacaacgaaccacgtacgactccaacaaactacgaaaccacgtcctagaagaacggttcggaaacggttaaccgaccgggtaaccttaagttacgtttacgttcgtaccgttcccgtttagtactttaacttaaggttaacgtaaag

SEQ ID NO: 405416 - DNA, 580 bp, Homo sapiens
  misc_feature: GZ8MTXP01EHEVY.3.48.E04.1.454.CMB.2.raw
  modified_base (201)..(201): a, c, t, g, unknown or other
  modified_base (244)..(244): a, c, t, g, unknown or other
  modified_base (305)..(305): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttntagttgaggtcgggggagcgtggcccagcctgggacgtccctnagactctcctgtgcagcgtctggattcagtttcgctacacatggcatgcacgtcgggtccncctagtcctccgaggcgaagggggctgcgtaggtgggtgtccgtttatcggaagcgtagtgggactcgagtagaaactaagtatcgacacgtacgtcggtaggaacggggtcctatttacgactctaacttccaccgaaggaacaaccaaaccctaccaaacaacacctacgtagaacctacctaaccaaatcgaacacgcctaggaagtacgttacgacggacgacggtacgttattacttattaacgtcgtccttagtacttataagttgtaa

SEQ ID NO: 405417 - DNA, 552 bp, Homo sapiens
  misc_feature: GZ8MTXP01BVLEX.3.48.E04.1.454.CMB.2.raw
  modified_base (246)..(246): a, c, t, g, unknown or other
  modified_base (309)..(309): a, c, t, g, unknown or other
tcagagacgcactccacgaccggtgctcgatttagagagcgtcacagagagaagggactgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcggggggagcgtggcccagccgtgggacggtcccctnagacctctcctgtgcagcgtctggattcagtttcgctacacatggcatgcacgtcgggtcccnccagtcctccgaggccgaagggggctggcaggtggggtggtccgtttatcggaagcgagtgggactcgatagaaacaatatgacgagtactcgtaggaacgggctattcatctatctaccagacgaacaacctaccgaaacaacaccactacgactcctaccaaatcgtaaacagcctagaacgtagttcggacgacgacggtcttagttattacgttgtcgtccttagattactaattgtaa

SEQ ID NO: 405418 - DNA, 504 bp, Homo sapiens
  misc_feature: GZ8MTXP01ASYJQ.3.48.E04.1.454.CMB.2.raw
  modified_base (241)..(241): a, c, t, g, unknown or other
  modified_base (404)..(404): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccatgtcagctgcttctagttgaggtcgggggagcgtggcccagcctgggagtccctnagactctcctgtgcagcgtctggattcagtttcgctacacatggcatgcactgggtccgccagtctccaggcaaggggctgcagtggtgccgtttatgaagcgatgggactcatgaacaatatgcagactcgtagaagggccgattcgatcatctcagacganaacctacaacaacaccactagatctaccaaatcgaacagcctagaagagttcgaggacgacggccgttattagttatgtgccttgacttactaattgtaa

SEQ ID NO: 405419 - DNA, 563 bp, Homo sapiens
  misc_feature: GZ8MTXP01AL0B5.3.48.E04.1.454.CMB.2.raw
  modified_base (245)..(245): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcgggggagcgtggcccagccgtgggacgtccctnagactctcctgtgcagcgtctggattcagtttcgctacacatggcatgcacgtcggtccgccagtctccgaggcgaaggggctgcgaggtgggtggtccgtttatcgaagcgagtgggactcatgaaacaatatgacagaccgtcgtaggaacgggccgattcatcactcctaccagaacgacaacctaccaaacaacacacgtagactaccgtaccaaatcgaacctacgcctgaacgacggttacggacggaaccgaccggtaccgttaagttacgttacgttgtcgtaacccgttagtacttactaagttgtaag

SEQ ID NO: 405420 - DNA, 553 bp, Homo sapiens
  misc_feature: GZ8MTXP01CJEXY.3.48.E04.1.454.CMB.2.raw
  modified_base (200)..(200): a, c, t, g, unknown or other
  modified_base (243)..(243): a, c, t, g, unknown or other
  modified_base (255)..(255): a, c, t, g, unknown or other
  modified_base (303)..(303): a, c, t, g, unknown or other
  modified_base (524)..(524): a, c, t, g, unknown or other
tcagagacgcactccacgaccggtgctcgatttagagagcgtcacagagagaaggggctgggagaggagcccagcactagaagtcggcggtgtttctattcggtgatcagcactgaacacagaggactcaccatggagtttgggctgagttgggttttcctcgttgcttcttttaagaggtgtccactgtcagctgcttntagttgaggtcgggggagcgtggcccagcctgggacgtccctnagctctcctgtncagcgtctggattcagtttcgctacacatggcatgcacgtcgggtccnccagtcctacccgaggcgaagggggctggcaggtggggtggtcccgttttattcggaagtcgattggggacttcgaatagaaactaatatggactaagacctccggtagaaacgggtccgaattcattcatctcaagacaacaactaccgaaacaaacacactagactacctaccaaatcgaacagcctagaacgagttcgagacgacggtacgttagttnttagtgtctccttgattactaagttgtaa

SEQ ID NO: 405421 - DNA, 520 bp, Homo sapiens
  misc_feature: GZ8MTXP01B0ZNY.3.48.E04.1.454.CMB.2.raw
  modified_base (241)..(241): a, c, t, g, unknown or other
  modified_base (301)..(301): a, c, t, g, unknown or other
  modified_base (413)..(413): a, c, t, g, unknown or other
  modified_base (460)..(460): a, c, t, g, unknown or other
  modified_base (491)..(491): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggccagcctgggacgtccctnagactctcctgtgcagcgtctggattcagtttcgctacacatggcatgcactcgggtccnccagtctccaggcaagggggctgcaggtgggtggtccgtttagttcgaagcgagtagggactcgatgaaacaatatgcagactccgtaggaacggccgatcatcatctacanagaacaactaccaaacaacacaactagactactaccaaatgaacacncctgaagagttcgaggacgacggcttagttnttattgtctccttgattacgtaattgtaa

SEQ ID NO: 405422 - DNA, 572 bp, Homo sapiens
  misc_feature: GZ8MTXP01C9QRX.3.48.E04.1.454.CMB.2.raw
  modified_base (198)..(198): a, c, t, g, unknown or other
  modified_base (239)..(239): a, c, t, g, unknown or other
  modified_base (300)..(300): a, c, t, g, unknown or other
  modified_base (327)..(327): a, c, t, g, unknown or other
  modified_base (366)..(366): a, c, t, g, unknown or other
  modified_base (370)..(370): a, c, t, g, unknown or other
  modified_base (380)..(380): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccatgtcagctgcttntagttgagtcgggggagcgtgccagccgtgggacgtccctnagactctcctgtgcagcgtctggattcagtttcgctacacatggcatgcacgtcgggtccnccagtctccgaggcgaaagggggctgnaggtgggtggtccgtttatcgaagcgagtagggactaanatanaaactaatangacacgacgtacgtaggaacggactatacatctactacacagaacaacaaaccaaccgaaacaaacaacactagtactacctaacaaatacgaacgacgacgagaacgaacggttacggaacggaccgtaaccggtacgttaattagttacgttcgtcgttaaccgttagtaacttacttaagttaagtaag

SEQ ID NO: 405423 - DNA, 765 bp, Homo sapiens
  misc_feature: GZ8MTXP01ANGMC.3.48.E04.1.454.CMB.2.raw
  modified_base (243)..(243): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtcgccagccgtgggacgtccctnagtactctctgtgcagtcgtcgtggtacttcgagtttcgactacactagtggactagtcgacctacgtcgggtcccacctagtcctaccgaggacgaagggggtctaggcgtaggttggggtcggttaccgtttagtacggaaggtccggtagtacggggtaacctaagtaagttaacggaaactaaagttacgtacgggaaccgtaaacggtacccgttacgggtaacgggtaaaccggggtacccgttaacgtttacctaacttaccgtaacctttacccgaaacccgtaaacgtaaaccggaaacccttaaaccccttaaaccccgaaaaacgtaaaccccgaaacctaaaccggtacggtaaaccttaccctaaacccgtaaaagtacgaaaccgaccgtaccgtaaggtaaaggaccggttacgggaaaccggaccggtaaaccggtaccgtttaagtttaacgtttacgttggttacccgtaacctttaggtaactttacttaagttggttaaacg

SEQ ID NO: 405424 - DNA, 636 bp, Homo sapiens
  misc_feature: GZ8MTXP01DX7PO.3.48.E04.1.454.CMB.2.raw
  modified_base (242)..(242): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggccagcctgggaggtccctnagactctcctgtgcagcgtctggattcagtttcgctacacatggcatgcacgtcggtccgccagtcctccgaggcaagggggctgcgtaggtggggtgtccgtttatcgaagcgagtcgggactcgaatcggaaactaagtatggactacgaccgttaccggtaggaacgggccgtattacgtactctactcctaccgaagaacgaaaccaaccctacccaaaaccaaaccaacctaacgtacggaacttacctaaccctaaaagtacgtaaaccaacgtacccgttgggaaacggtacggttacgggaaacgggaccggtaaccgggtacccgttaagttacgtttagttcggttaccgtcccgtttaggtactttaacttaagttaagtaag

SEQ ID NO: 405425 - DNA, 515 bp, Homo sapiens
  misc_feature: GZ8MTXP01ET3BN.3.48.E04.1.454.CMB.2.raw
  modified_base (242)..(242): a, c, t, g, unknown or other
  modified_base (359)..(359): a, c, t, g, unknown or other
  modified_base (368)..(368): a, c, t, g, unknown or other
  modified_base (395)..(395): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggccccagcctgggagtccctnagctctcctgtgcagcgtctggattcagtttcgctacacatggcatgcacgtgggtcccgccagtctccaggcaagggggctgcaggtgggtgccgtttatcgaagcgacggactcntgaacaatntgcagactcgtgaaggcatcatcatcnccagacacaactccaacaacacactaggactcctaccaaatacgaactagcctagagaacgtacgaggacacggtccgtaattattacgttgtcgtcccttgattacttatgttaataag

SEQ ID NO: 405426 - DNA, 626 bp, Homo sapiens
  misc_feature: GZ8MTXP01ADJ5F.3.48.E04.1.454.CMB.2.raw
  modified_base (245)..(245): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttggaggtcggggggagcgtggcccagccgtgggagtccctnagactctcctgtcgcagcgtctggattcagtttcgctacacatggcatcgctacgtcgggtcccgccagtcctccgaggcgaagggggctggcgaggtggggtgtccgtttatcgaagcgagtcgggactcgatagaaacaagtatcgacaagtaccgtaccggtaggaaacgggccgtattcaactctaactcctaccgaagaacgaaacctaaacctaaccccgaaaacaaaccaacaaccgttacggaactacccgtaacctaaaactacgtaaaccacgtacctaggaaggacggttacggaaacggaaccgtaccgggtaaccgttatttacgtttagttcgttacgtcccttagtaccttacttaagttaagtaa

SEQ ID NO: 405427 - DNA, 600 bp, Homo sapiens
  misc_feature: GZ8MTXP01AXBEM.3.48.E04.1.454.CMB.2.raw
  modified_base (243)..(243): a, c, t, g, unknown or other
  modified_base (305)..(305): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggacggtccctnagactctcctgtgcagcgtctggattcagtttcgctacacatggcatgcacgtcgggtcccnccagtcctccgaggccgaagggggctgcgtaggtggggtggtccgtttagtcggaagcgagtgggactcgatagaaactatatgacagaccgtcgtaggaacgggccgtattcgatcactcctaccgagaacgaacaacctaccaaacaacacactgaactctaaccaaatcgaaacacgtaccgtaggaagtacggttccggaaacggaccgaaaccgggtaccgttaacgtttagtttacgttaacggtaccgtaaccccgtttaggtactttaaccttaagttaacggtaag

SEQ ID NO: 405428 - DNA, 538 bp, Homo sapiens
  misc_feature: GZ8MTXP01AWZFQ.3.48.E04.1.454.CMB.2.raw
  modified_base (244)..(244): a, c, t, g, unknown or other
  modified_base (303)..(303): a, c, t, g, unknown or other
  modified_base (362)..(362): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacgtccctnagactctcctgtgcagcgtctggattcagtttcgctacacatggcatgcactgggtccnccagtctccgaggcgaagggggctgcaggtgggtgccgtttatcgaagcgatgggactnactagaaacatatgacagactccgtaggaacgggcgattcatcatctacagaacgacaactacccaaacaaacacacctagactcctacaaactgaaacctagcctaggaacgagttcgaacggaccgacggtaccttagttcttacttgtgtaacccttgacttactaattgtaa

SEQ ID NO: 405429 - DNA, 528 bp, Homo sapiens
  misc_feature: GZ8MTXP01BYXYX.3.48.E04.1.454.CMB.2.raw
  modified_base (257)..(257): a, c, t, g, unknown or other
  modified_base (307)..(307): a, c, t, g, unknown or other
  modified_base (473)..(473): a, c, t, g, unknown or other
  modified_base (500)..(500): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacgtccctcagactctcctgtncagcgtctggattcagtttcgctacacatggcatgccacgtcgggtcccnccagtcctccgaggcgaagggggctggcgagggttggggtcggtccgttttagtcggaagcgagtcgggactcgatagaaacaatatgacacgactcgtaggaacgggcgtattcatcactcacagacacaacctacaaacaacacactgactcacaaatcgaacngcctgaagcgcgagacgacgcttattnttatgtctccttgacttactgttgtaag

SEQ ID NO: 405430 - DNA, 620 bp, Homo sapiens
  misc_feature: GZ8MTXP01CAW82.3.48.E04.1.454.CMB.2.raw
  modified_base (242)..(242): a, c, t, g, unknown or other
  modified_base (301)..(301): a, c, t, g, unknown or other
  modified_base (435)..(435): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagtgaggtcgggggagcgtggccagccgtgggacgtccctnagactctcctgtcgcagcgtctggtattcagttcgctacacatggcatgcacgtggccnccagtctcgaggcgaagggctgcgtggtgggtgtcgtttatcggaagcgtagtcgggactcgaatacgaaacatagtgacacgtaccgtcggtaggaacggggcctaattcgaactcgtactccacgaacgaanaacctaaacctaccaaacaaaccaaccaacgtcgaactacctaacaaaacgtcgaaacgtacgacccgtaggaaaggtacgttacgggaaacggacccgtaaccggggtcccttaaagtttacgtttaacgtttcggtaccgttaaccccgtttaggtaactttaaccgtaacgttaagttaaag

SEQ ID NO: 405431 - DNA, 530 bp, Homo sapiens
  misc_feature: GZ8MTXP01AUPYQ.3.48.E04.1.454.CMB.2.raw
  modified_base (308)..(308): a, c, t, g, unknown or other
  modified_base (471)..(471): a, c, t, g, unknown or other
  modified_base (526)..(526): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcggggggagcgtggccccagccgtgggacggtccctcagactctcctgtgcagcgtctggattcagtttcgctacacatggcatgcacgtcgggtcccnccagtcctccgaggcgaagggggctagcgaggtggggtggtccctttatcggaagcgagtgggactcgatgaaacatatgcagacctcgtaggacgggccgattcactcactctcagacgacaactaccaaacaacacactgactctaccaaatgaacagccngaagagcgaaggcgacggtacgttattgttattgtcgtccttgtacttactaagngtaa

SEQ ID NO: 405432 - DNA, 647 bp, Homo sapiens
  misc_feature: GZ8MTXP01A79FG.3.48.E04.1.454.CMB.2.raw
  modified_base (245)..(245): a, c, t, g, unknown or other
  modified_base (308)..(308): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgtcttcttttaagaggtgtccactgtcagctgcttctagttggaggtcgggggagcgtggcccagccgtgggacgtcccnagactctcctgtgcagcgtctggtattcagttcgctacacagtggcatgcacgtcgggtcccnctagtcctccgaggcgaaggggctgcgaggtggtggtccgtttatcggaagcgagtgggactcgaatagaaactaatagtcgactaacgtacgtaccgtaggaacgggccgtattacaactcctaactcctacgacgaacgaacctaaaccctaacccaaaacgaaacccaaccgtaacgtacgtaactaccgttaaaccaaaacgtccgaaacctacgtacccgtaaggaacggtaacggttaccggaaacggaaccgtaaccgggtacccgtttaagttacgtttacgtttcgtacgttaaccccgtttagttaacctttacgtaagttaagtaaag

SEQ ID NO: 405433 - DNA, 536 bp, Homo sapiens
  misc_feature: GZ8MTXP01CLKMH.3.48.E04.1.454.CMB.2.raw
  modified_base (242)..(242): a, c, t, g, unknown or other
  modified_base (302)..(302): a, c, t, g, unknown or other
  modified_base (375)..(375): a, c, t, g, unknown or other
  modified_base (469)..(469): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggacgtccctnagactctcctgtgcagcgtctggattcagttcgctacacatggcatgcacgtgggtcccncagtcctccgaggcgaaggggctgcgaggtggtgtccgtttagtcgaagcgagtgggactcgatgaaacatangacagtactccgtaggacggccgattcatcatcctaccagacacaacctacaaacaacacacgtagactcaccaaatcgaacacgcctagaagngttacggaaggaccgtacggtcgttaattcttagttgtacgtcccgttgtacttactaagttgtaag

SEQ ID NO: 405434 - DNA, 546 bp, Homo sapiens
  misc_feature: GZ8MTXP01CTXLD.3.48.E04.1.454.CMB.2.raw
  modified_base (242)..(242): a, c, t, g, unknown or other
  modified_base (302)..(302): a, c, t, g, unknown or other
  modified_base (376)..(376): a, c, t, g, unknown or other
  modified_base (413)..(413): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggacgtccctnagactctcctgtgcagcgtctggattcagtttcgctacacatggcatgcacgtcggtccnccagtctccgaggcgaaggggctgcgaggtgggtgtccgtttagtcgagcgagtagggactcatagaaacaatntagacacgctcgtaggaacggtcattcatcatcacanacacaacctacaaacaacacactcgataccacaaactcgaacagaccgtagaacgtacgttacgacggaccgacggtacgttagttacgtttacgttcgttaccgtcccgttagtaattacgtaagttgtaag

SEQ ID NO: 405435 - DNA, 513 bp, Homo sapiens
  misc_feature: GZ8MTXP01EVHG3.3.48.E04.1.454.CMB.2.raw
  modified_base (246)..(246): a, c, t, g, unknown or other
  modified_base (306)..(306): a, c, t, g, unknown or other
  modified_base (452)..(452): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcgggggagcgtggccccagcctgggacggtccctnagactctcctgtgcagcgtctggattcagtttcgctacacatggcatgcacgtgggtccnccagtctccgaggccaagggggctgcaggtgggtggtcccgtttatcgaagcgagtgggactcatgaacaatatgcagactcgtgaggccgattcatcatctcagagacaactaccaacaacacactagatctaccaaatcaacancctgaagagttcgaggacgacggcgttattattattgtgcccttgattacgtaattgtaag

SEQ ID NO: 405436 - DNA, 543 bp, Homo sapiens
  misc_feature: GZ8MTXP01CAG4P.3.48.E04.1.454.CMB.2.raw
  modified_base (242)..(242): a, c, t, g, unknown or other
  modified_base (301)..(301): a, c, t, g, unknown or other
  modified_base (362)..(362): a, c, t, g, unknown or other
  modified_base (458)..(458): a, c, t, g, unknown or other
  modified_base (502)..(502): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggagtccctnagctctctgtgcagcgtctggattcagtttcgctacacatggcatgcacgtcggtcccncagtctccgaggcaagggggctgcgtaggtgggtgtccgtttattgaagcgagtgggactnatagaaacatatgacagactcgtggaacggctattcatcatcacagacgacaaacctaccaaacaacaccacgtagactcctaacaaatcgaaacncgacctgaacgagttacggaaggaccgacgggtaccttaagttntttaactcggtctaacccgtttgactttaactaagttgtaa

SEQ ID NO: 405437 - DNA, 650 bp, Homo sapiens
  misc_feature: GZ8MTXP01DL73Q.3.48.E04.1.454.CMB.2.raw
  modified_base (243)..(243): a, c, t, g, unknown or other
  modified_base (301)..(301): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggagtccctnagctctcctgtgcagcgtctggattcagtttcgctacacatggcatgcacgtggtccnccagtctccgaggcaagggggctgcaggtgggtggtccgttttatcggaagcgagtaggggactcgaatagaaactaatagtcgacaacgtaccgtaccgtaggaaacgggtccgtaagtttcattaccgtaattccctaaccgacgaacgaaacctaaacccttacccgaaaacctaaaaccgaacctaaccgtacggtaacttacccttaaccaaaaacgttcggtaaaccaacgtacccgttaggaaaggtaacggttacggaaacgggaacccgaacgggtaacccggttaatttatttaacgtttgttacgtcccctttaggtactttacgtaagttaagtaag

SEQ ID NO: 405438 - DNA, 546 bp, Homo sapiens
  misc_feature: GZ8MTXP01AHHZB.3.48.E04.1.454.CMB.2.raw
  modified_base (243)..(243): a, c, t, g, unknown or other
  modified_base (382)..(382): a, c, t, g, unknown or other
  modified_base (392)..(392): a, c, t, g, unknown or other
  modified_base (414)..(414): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcggggggagcgtggcccagcctgggagtccctnagctctcctgtgcagcgtctggattcagtttcgctacacatggcatgcacgtcgggtcccgcagtctccgaggcgaagggggctggcgaggtgggtcggtccgtttatcggaagcgagtgggactcgatagaaacatangcagactcgngacgggcatcatcatcacaganacaacaccaacaacacactagactcaccaaatacgaacagaccgtgaacgagttccgggaaggaaccgtaccgggtaccgttaagttatttagttcgtacgtcccgtttagtactttactaagttaagtaag

SEQ ID NO: 405439 - DNA, 523 bp, Homo sapiens
  misc_feature: GZ8MTXP01EYFPX.3.48.E04.1.454.CMB.2.raw
  modified_base (246)..(246): a, c, t, g, unknown or other
  modified_base (465)..(465): a, c, t, g, unknown or other
  modified_base (496)..(496): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcggggggagcgtggcccagccgtgggacgtccctnagactctcctgtgcagcgtctggattcagtttcgctacacatggcatgcacgtggtccgcagtctccgaggcaagggggctgcaggtgggtgtccgtttatcgaagcgatgggactcgatagaaactaataatggacagtacctccggtagaacggggctaattcaatcatctaccagacgacaactacaaacaacacactgatctacaaatgaaacanccagaagagttcgagacgacggcgttaattnttactgtgtccttgattataattgtaa

SEQ ID NO: 405440 - DNA, 643 bp, Homo sapiens
  misc_feature: GZ8MTXP01ACZFT.3.48.E04.1.454.CMB.2.raw
  modified_base (244)..(244): a, c, t, g, unknown or other
  modified_base (304)..(304): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacgtccctnagactctcctgtcgcagcgtctggattcagtttcgctacacatggcatgcacgtggtccncagtctccgaggcgaaggggctgcgaggtggggtgtccgtttatcgaagcgagtgggactcgaatacgaaactaagtagtcgacaacgtaccgtaccggtaggaacgggtcccgatttcactcacttccacccgagaacgaacctaaacctaccgaaaacaaacacctaacgtacggaactaccgtaaccaaaacgtacgaaaccgaacgtccctaagggaagtaacgggttaccggaaacgggaccgtaaccggggtaacccggttaatttaacgtttaggttaacggttccggtaaccccttttaggtaaccgttttacttaagttaacgttaaagg

SEQ ID NO: 405441 - DNA, 565 bp, Homo sapiens
  misc_feature: GZ8MTXP01CY6X3.3.48.E04.1.454.CMB.2.raw
  modified_base (244)..(244): a, c, t, g, unknown or other
  modified_base (396)..(396): a, c, t, g, unknown or other
  modified_base (486)..(486): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcgggggagcgtggccagtcgtgggacgtccctnagacctctcctgtcgcaggcgtcgtggtattcgagtttcgctacacagtggcatcgcacgtcgggtcccgcctagtcctccgaggcgaagggggctgcgaggtggggtcggtccgtttagtcgagcgagtcgggactcgatagaaactatangacagactcggtagaacgggtcgtattcatcactctacagacacaacctaccaaacaacacacgtagaactcctaaccaaatcgaaaccngtacctgaacggacgcggaacggaccgtaacggtcgttattatttagttcgtcgtccgttgtacttactaagttgtaag

SEQ ID NO: 405442 - DNA, 506 bp, Homo sapiens
  misc_feature: GZ8MTXP01DFLTV.3.48.E04.1.454.CMB.2.raw
  modified_base (201)..(201): a, c, t, g, unknown or other
  modified_base (243)..(243): a, c, t, g, unknown or other
  modified_base (372)..(372): a, c, t, g, unknown or other
  modified_base (412)..(412): a, c, t, g, unknown or other
  modified_base (437)..(437): a, c, t, g, unknown or other
  modified_base (475)..(475): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttntagttgaggtcgggggagcgtggccagccgtgggagtccctnagactctcctgtgcagcgtctggattcagtttcgctacacatggcatgcacgtcggtccgccagtctccgaggcgaaggggctgcaggtggtgtcgtttatcgagcgagtgggactcatagaaacatangacagactcgtagaggcgattcatcatcacagagacaacncaaacaacacactgactcacaaatnaacacgctagaagagttcgagacgacggtcttaagttnttagtgtcgtccttagacttactaattgtaa

SEQ ID NO: 405443 - DNA, 524 bp, Homo sapiens
  misc_feature: GZ8MTXP01A6ES0.3.48.E04.1.454.CMB.2.raw
  modified_base (304)..(304): a, c, t, g, unknown or other
  modified_base (310)..(310): a, c, t, g, unknown or other
  modified_base (368)..(368): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgctcttttaagaggtgtccactgtcagctgcttctagttgaggtcggggggagcgtggcccagcctgggacgtcccctcggactctcctgtgcagcgtctggattcagttcgctacacatggcatgcactgggtcccncagtcnccaggcaaggggctgcagtggtgcgttatcgagcgatgggaactcaatgaaacaatangacagactccgtgaacgggccgattcatacatcctccagacgaacaacctaccaaacgaacacactaggatcctaccaaatgaaacagccctagagaaggtcgaaggaccacggaccgtaattagttattgtcgcccttgattacttatgaataag

SEQ ID NO: 405444 - DNA, 603 bp, Homo sapiens
  misc_feature: GZ8MTXP01AUV22.3.48.E04.1.454.CMB.2.raw
  modified_base (245)..(245): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcggggggagcgtggcccagccgtgggagtccctnagactctcctgtgcagcgtctggattcagtttcgctacacatggcatgcacgtcggtccgccagtcctccgaggcgaagggggctgcgtaggtgggtggtccgtttagtcgaagcgagtcgggactcgatagaaactatagtcgacacgtaccgtcggtaggaacgggtccgtattcactctactcctccgaagaacaaccaacctacaaacaacaacacgtagactactaacaaactacgaaacacgtaccgaggaacgtacggttacggacggaaccgtaaccggggtacccttaagtttagtttaacgttcggttaccggttccctttagtaactttaaccgtaagttaagtaag

SEQ ID NO: 405445 - DNA, 535 bp, Homo sapiens
  misc_feature: GZ8MTXP01A37ON.3.48.E04.1.454.CMB.2.raw
  modified_base (200)..(200): a, c, t, g, unknown or other
  modified_base (243)..(243): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttntagttgaggtcgggggagcgtggcccagcctgggacgtccctnagactctcctgtgcagcgtctggattcagtttcgctacacatggcatgccactcgggtccgccagtctccgaggcaagggggctggcaggtggggtggtccgtttatcggaagcgagtggggactcatgaaacatatgcagacgtccgtaggtaacgggcctagttcatcactcctaccagacgacaactaccaaacaacacactgactctacaaatcgaacacgcctgaagagttcgaaggacgacggaccttagttcttattaagtcgtcccttgtattactaattgtaa

SEQ ID NO: 405446 - DNA, 581 bp, Homo sapiens
  misc_feature: GZ8MTXP01A6JL0.3.48.E04.1.454.CMB.2.raw
  modified_base (371)..(371): a, c, t, g, unknown or other
  modified_base (414)..(414): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtgggacgtccctcagactctcctgtgcagcgtctgattcagttcgctacacatggcatgcacgtcggccgccagtctccgaggcgaagggctgcgaggtgggtgtcgttagtcgaagcgagtgggactcagtgaaacatanacgcagacctcgtaggaacgggcgtatacatcatcctaccganacgaacaaccctaccaaacaaactaccaacgtagtaactacctaaccgaaaacgttacaaaccgtacgacccgtagggaaacgtaacggttacggaaacgggaccgaccgggtaccgttagttagtttacttggtacgtccctttaggactttactaagttggtaag

SEQ ID NO: 405447 - DNA, 508 bp, Homo sapiens
  misc_feature: GZ8MTXP01BN7UV.3.48.E04.1.454.CMB.2.raw
  modified_base (242)..(242): a, c, t, g, unknown or other
  modified_base (303)..(303): a, c, t, g, unknown or other
  modified_base (408)..(408): a, c, t, g, unknown or other
  modified_base (413)..(413): a, c, t, g, unknown or other
  modified_base (426)..(426): a, c, t, g, unknown or other
  modified_base (431)..(431): a, c, t, g, unknown or other
  modified_base (458)..(458): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggacgtccctnagactctcctgtgcagcgtctggattcagtttcgctacacatggcatgcacgtcgggtccncctagtctccgaggcgaaggggctgcaggtgggtggcgtttatcgaagcgtagtgggactcgatagaaacatatgacagactcgtaggagggcgtatcatcatcncaganacaactcaacaanacacngactcaccaaatcgaacagcctgaagngacgagacgacggcttagttcttagtgtctccttagacttatgttgtaag

SEQ ID NO: 405448 - DNA, 578 bp, Homo sapiens
  misc_feature: GZ8MTXP01AXXRU.3.48.E04.1.454.CMB.2.raw
  modified_base (309)..(309): a, c, t, g, unknown or other
  modified_base (543)..(543): a, c, t, g, unknown or other
tcagagacgcactccacgaccggtgctcgatttagagagcgtcacagagagaaggggctgggagaggagcccagcactggaagtcggcggtgtttccattcggtgatcagcactgaacacagaggactcaccatggagtttggactgagttgggttttcctcgttgcttcttttaagaggtgtccactgtcagctgcttctagttgaggtcgggggagcgtggcccagccgtgggacgtccctcagactctcctgtgcagcgtctggtattcagtttcgctacacagtggcatcgcacgtcgggtcccnctagtctccgaggcgaagggggctggcgtaggtggggtggtccgtttagtcggaagcgagtgggactcagtagaaactaatagtcgacaagtaccgtcggtaggaacgggccgtattacagtctactccgtacacgaacgaaccaaacctaccaaacaacaccactacgactacctacaaactacgaaaccacgaccgtgaagacgttacggaacggaccgacggcttacgttnttacttggtctcccgttgtacttactaagttgtaa

SEQ ID NO: 405449 - DNA, 837 bp, Homo sapiens
  misc_feature: GZ8MTXP01CJGTD.3.48.E04.1.454.CMB.2.raw
  modified_base (242)..(242): a, c, t, g, unknown or other
  modified_base (257)..(257): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggccagcctgggacgtccctnagactctcctgtgcngcgtctggattcagtttcgctacacatggcagtcgccgtacgttcgggtccccgcctacgttccctccgaaggggacccgaaaggggggtccttggacgagggttgggggttcggttacccgttttagttacggaaggtcggtagtacgggggtacctcgaaagtttacggaaaacctaaagtacgtacggaccgtaacgtacccgttacccggggtaacgggaaaccgggggtaccccggtaaagttttacccgaaacgtttaccccgtaaacttcccccgttaaaccccgaaacgggtaaaacccggaaaaccccctaaaaccccgtttaaacccccgtaaaaaacccaaaaccctaaaccccgtaaaccgtttaaccgggtaaacccttaacccctttaaaacccggaaaaaacttacggaaaaacccgttaccgaacccgttaagggaaacggtacgggttaaccgggaaaccgggaaccgtaaacccggggtacccgtttaaagttaacttttaagtttcggttaccgttaaccccgttttaggttaaactttaccgtttaaagttcggttaaag

SEQ ID NO: 405450 - DNA, 587 bp, Homo sapiens
  misc_feature: GZ8MTXP01EV96E.3.48.E04.1.454.CMB.2.raw
  modified_base (244)..(244): a, c, t, g, unknown or other
  modified_base (264)..(264): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccatgtcagctgcttctagttgaggtcgggggagcgtggccccagccgtgggacgtccctnagctctcctgtgcagcgtcnggtattcagttcgctacacagtggcatcgcacgtcggtcccgcagtcctccgaggcgaaggggctgcgaggtgggtgtccgtttagtacgaagcgagtagggactcgatagaaacaatatagactagtacgtccgtaggaaacgggtccgtattcactctatcctaccgaagaacgaaaccaaccctaaccaaactaaaccaacctacgtacggtaacctacctaacctaaaactacgaaaccgacgacccgtaggaacgtacggttacggacggttaccgacgtacgttattattagtgtctctagtattactaagttgtaa

SEQ ID NO: 405451 - DNA, 537 bp, Homo sapiens
  misc_feature: GZ8MTXP01D3XN0.3.48.E04.1.454.CMB.2.raw
  modified_base (199)..(199): a, c, t, g, unknown or other
  modified_base (241)..(241): a, c, t, g, unknown or other
  modified_base (302)..(302): a, c, t, g, unknown or other
  modified_base (379)..(379): a, c, t, g, unknown or other
  modified_base (507)..(507): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttntagttgaggtcgggggagcgtggcccagcctgggagtccctnagctctcctgtcgcagcgtctggattcagtttcgctacacatggcatgcacgtcgggtccnccagtctccgaggcgaagggggctgcgaggtggggtgtccgtttagtcgaagcgagtagggactcgatgaaacatangcagactcgtaggaacgggcgtattacatctatacctcagaacgaacaacctaccaaacaacaacactagaactcctacaaatagaacacgccgtgaagacgttcgaacggacgacggtacgttattnttagtgtcgtccttgattactgttaagtaa

SEQ ID NO: 405452 - DNA, 627 bp, Homo sapiens
  misc_feature: GZ8MTXP01BJ3V5.3.48.E04.1.454.CMB.2.raw
  modified_base (203)..(203): a, c, t, g, unknown or other
  modified_base (248)..(248): a, c, t, g, unknown or other
  modified_base (307)..(307): a, c, t, g, unknown or other
  modified_base (313)..(313): a, c, t, g, unknown or other
  modified_base (623)..(623): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgtagtttgggttttcctcgttgcttcttttaagaggtgtccactgtcagctgtcttntagttgaggtcggggggagcgtggcccagccgtgggacgtccctnagtctctcctgtgcagcgtctggtattcagttcgctacacatggcatgcacgtcggccncagtcnccgaggcgaggggctgcgaggtgggtggtccgtttagtcgaagcgagtccccgggatcgagtagaaactaatagtacggacaacgtaccgttaccgggaagggtaaccggggtacccgtaacttcgaaactcctaacgttaccgaccgaaacgaaccgaaacctaaacccctacccaaaacaaccaaccgtacgtaacgtaactacctaaccaaaagtaccgaaacacgtaccgtaggaacgaaggttaccgacggacgtaccggtacgttattagtttacgtcgtcttaaccgttagtacttactgttntaag

SEQ ID NO: 405453 - DNA, 648 bp, Homo sapiens
  misc_feature: GZ8MTXP01BZ0FT.3.48.E04.1.454.CMB.2.raw
  modified_base (238)..(238): a, c, t, g, unknown or other
  modified_base (299)..(299): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccatgtcagctgcttctagttgaggtcgggggagcgtgccagcctgggacgtcctnagactctctgtgcagtcgtctggattcagttcgctacacagtggcatgctacgtcggtccnccgtagtctccgaggcgaagggggctggacgtaggtggggttcggtaccgtttagtcggaagtcgtagtaggggaccttgaattaggaaactaaagtacgtagactagaccgttaccggaggaaacgggccgtaattcaacttcctaatccctaccgaacgtaacgaaacctaaccctaacccgaaaacaaaccgtaacctaacgtacggtaacttacccttaaccaaaacgttaccgtaaaccacgtacccgagaaaggtacggttacgggaaacgacgtaacccggggccttaagttacgttaagttcggtacgtcccgtttaggactttacctaagttcgggtaaa

SEQ ID NO: 405454 - DNA, 618 bp, Homo sapiens
  misc_feature: GZ8MTXP01CDU9K.3.48.E04.1.454.CMB.2.raw
  modified_base (241)..(241): a, c, t, g, unknown or other
  modified_base (269)..(269): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtggagtccctngactctcctgtgcagcgtctggtattcngtttcgcttacactatggccatgctacgtcggtcccgcagtcctccgaggcgaagggggctcgcgaggtgggtggtaccgtttagtcggaagcgagtgggactgatagaaactaatgtgacagacctcggtacggaacgggccgtatcgacttcatcctaccgaagacaaccaaccgtaccaaacgaaccaccacgtaggaaccttccgtaaccaaacgttcgaaaccagtcccgtaaggaacggtacggttaccggaaacgggacccgtaaaccgggtcccgtttaaagttacgtttacgtttaacgtcccgttaaccgtttaggtactttaccttaagttaagtaag

SEQ ID NO: 405455 - DNA, 646 bp, Homo sapiens
  misc_feature: GZ8MTXP01B2BMZ.3.48.E04.1.454.CMB.2.raw
  modified_base (201)..(201): a, c, t, g, unknown or other
  modified_base (247)..(247): a, c, t, g, unknown or other
  modified_base (268)..(268): a, c, t, g, unknown or other
  modified_base (313)..(313): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgtagttgggttttcctcgttgcttcttttaagaggtgtccactgtcagctgcttntagttggaggtcgggggagcgtcggcccagccgtgggacgtccctnagacctctctgtcgcagcgtntggtattctacgttcgctacactagtgcatgcctacgtcggtccncgacgtctccgaggccgaagggggctggcgtagggtgggtcggttacgtttacgtacgaagcggtagtcgggaactcgaatacgaaactaatcgtacgcgaacgtacgttacggaggacggtactacgtctaactactctctacgacgtaacgaaaccacctaaccaaacgtaaaccacgtaacgtagtaacctaccctaacctaaagtaccgtaaaccacggtaccgtacgggaacgtacgggaacgggaaacggaccggtaacccggtaacgttagtttacgttacggttcgtacggtcccctttagtactttaacgtaagttaacgtaag

SEQ ID NO: 405456 - DNA, 670 bp, Homo sapiens
  misc_feature: GZ8MTXP01EHGCB.3.48.E04.1.454.CMB.2.raw
  modified_base (179)..(179): a, c, t, g, unknown or other
  modified_base (245)..(245): a, c, t, g, unknown or other
  modified_base (259)..(259): a, c, t, g, unknown or other
  modified_base (405)..(405): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagnggtgtccactgtcagctgcttgtagttgaggtcgggggagcgtggcccagccgtgggacgtccctnagctctcctgtgcngcgtctggtattcagtttcgctacacagtggactatcgctacgtcggtcccgcctagtcctaccggaggccgaagggggctggcgaggttggggtgtcccgtttatacggaagtcgtagtcgggactcgagtagaaactattacgngacaggtaccgtcggtacggaacgggtacctacgttacctaagtacctaacgttacccgtaccgaaacgaaacggtaaaccctaaaccccgtaaacccgaaaacccgaaaacccgtaaccaaccgttaaggaaacctacccgttaaacaaaacgtcgaaactacggacccgttaggaacgttaacgggaccggtaacggaccgtaaccgggtaaccttagttactttacgttcgtacgttcccgttattattactaagttgtaag

SEQ ID NO: 405457 - DNA, 508 bp, Homo sapiens
  misc_feature: GZ8MTXP02I58R2.3.48.E04.1.454.CMB.2.raw
  modified_base (241)..(241): a, c, t, g, unknown or other
  modified_base (301)..(301): a, c, t, g, unknown or other
  modified_base (356)..(356): a, c, t, g, unknown or other
  modified_base (405)..(405): a, c, t, g, unknown or other
tcagagacgcactccacgaccggtgctcgatttagagagcgtcacagagagaaggggctgggagaggagcccagcactagaagttggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggagtccctnagactctcctgtgcagcgtctggattcagtttcgctacacatggcatgcacgtggtcccncagtctccaggcaaggggctgcaggtggtgtccgtttatcgaagcgatgggactnatgaaacatatgcagactccgtagaagggccgatcatcatctaccaganacaactaccaacaacacactagactactacaaatagaacagcctagaagacgtacgacggaacaccggtcgtaatattatgtcgcccttagattactatagta

SEQ ID NO: 405458 - DNA, 488 bp, Homo sapiens
  misc_feature: GZ8MTXP02JI9BR.3.48.E04.1.454.CMB.2.raw
  modified_base (240)..(240): a, c, t, g, unknown or other
  modified_base (299)..(299): a, c, t, g, unknown or other
  modified_base (476)..(476): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctnagactctcctgtgcagcgtctggattcagtttcgctacacatggcatgcactgggtccncagtctccaggcaaggggctgcagtgggtgccgtttatcgaagcgatgggactcatgaacatatgcagactcgtgaaggcgattcatcatctccagagacaactccaacaacacactgatctacaaatgaacagcctgacgagtcgaggacacggccgtatattattgtcgcccttnattactatgtaa

SEQ ID NO: 405459 - DNA, 541 bp, Homo sapiens
  misc_feature: GZ8MTXP02J17YD.3.48.E04.1.454.CMB.2.raw
  modified_base (240)..(240): a, c, t, g, unknown or other
  modified_base (299)..(299): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctnagactctcctgtgcagcgtctggattcagtttcgctacacatggcatgcactgggtccncagtctccaggcaggggctgcaggtggtgccgtttatcgaagcgatgggactcatgaacatatgacagacctcggtaggaacgggccgtattcactcactcctaccagaacgacaacctaccaaacaaccacacgtaggactacctaaccaaagtacgaaacacgcctagaacgacggtacggacggaaccacgggaccgtagttaattagttgtcgtcccttagtactttactatagtacg

SEQ ID NO: 405460 - DNA, 516 bp, Homo sapiens
  misc_feature: GZ8MTXP02FP6FE.3.48.E04.1.454.CMB.2.raw
  modified_base (240)..(240): a, c, t, g, unknown or other
  modified_base (299)..(299): a, c, t, g, unknown or other
  modified_base (357)..(357): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctnagactctcctgtgcagcgtctggattcagtttcgctacacatggcatgcactgggtccnccagtctccgaggcaaggggctgcaggtgggtgccgtttatcgaagcgagtgggactnatgaaacatatgacagactcgtagaagggcgattcatcatctaccagacgacaacctaccaacaacacaactacgactctaccaaatcgaacagtccagacgagtacgacggaccacggccgtaatagtttatgtacgaccttagtacttactatagta

SEQ ID NO: 405461 - DNA, 510 bp, Homo sapiens
  misc_feature: GZ8MTXP02F0OW0.3.48.E04.1.454.CMB.2.raw
  modified_base (240)..(240): a, c, t, g, unknown or other
  modified_base (299)..(299): a, c, t, g, unknown or other
tcagagacgcactccacgaccggtgctcgatttagagagcgtcacagagagaaggggctgggataggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctnagactctcctgtgcagcgtctggattcagtttcgctacacatggcatgcactgggtccnccagtctccaggcaaggggctgcagtggtgccgtttatcgaagcgatgggactcatgaaacaatatgcagactccgtagaagggccgattcatcatctaccagagaacaactaccaaacaacacactagactactaccaaatagaacagcctagaacgagtacgacggacacggaccgtatattatgtcgacccttagattactatagtaa

SEQ ID NO: 405462 - DNA, 548 bp, Homo sapiens
  misc_feature: GZ8MTXP02JR5KB.3.48.E04.1.454.CMB.2.raw
  modified_base (241)..(241): a, c, t, g, unknown or other
  modified_base (302)..(302): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggagtccctnagactctcctgtgcagcgtctggattcagtttcgctacacatggcatgcacgtcgggtccnccagtcctccgaggcaaggggctggcaggtggggtgtccgtttatcggaagcgagtggggactcgatagaaacaatatgacagactccgagtggaagggccgattcatcatctaccagagaccaactaccaaacaacacactagactactaccaaatacgaacacgacctaggaacgacgtacggaacggaaccgacggaccttaagttattaagttcgtacgtcccttagtactttacgtattag

SEQ ID NO: 405463 - DNA, 528 bp, Homo sapiens
  misc_feature: GZ8MTXP02FOROW.3.48.E04.1.454.CMB.2.raw
  modified_base (243)..(243): a, c, t, g, unknown or other
  modified_base (303)..(303): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggacgtccctnagactctcctgtgcagcgtctggattcagtttcgctacacatggcatgcactgggtcccncagtctccaggcaaggggctgcaggtgggtggtccgtttatcgaagcgatcgggactcatgaaacaatatgacagactccgtagaacgggccattcatctatctccagacgaacaaacctaccaaacaacacactagactactaccaaatacgaaacacgcctagaacgagtacgacggaacgacggaccgtaatattatgtcgtccttagactttactatgtaa

SEQ ID NO: 405464 - DNA, 613 bp, Homo sapiens
  misc_feature: GZ8MTXP02H54VA.3.48.E04.1.454.CMB.2.raw
  modified_base (244)..(244): a, c, t, g, unknown or other
  modified_base (305)..(305): a, c, t, g, unknown or other
  modified_base (384)..(384): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagttttgggctgagtttgggttttcctcgttgcttcttttaagaggtgtccactgtcagctgcttctagttgaggtcgggggagcgtggcccagcctgggagtccctnagactctcctgtgcagcgtctggattcagttcgctacacatggcatgcacgtcgggtcccnccagtcctccgaggcgaaaggggctgcgaggtggggtgccgttattcgaagcgatggggactcgaatagaaactaatanggacaagacccgttcccggaggaacggggcccgtaatacgtacttacacttacctacccgagaacgaaaccaaacctaacccaaacaaaccaccacgtaggaactacctaaccaaaatcgaaaaccacgaccctaggaagtaacggtaccggaacggaaccgaaccgggtaccgttaacgttaatttaacgttcgtacgtacccttagtaactttactaacttagtaag

SEQ ID NO: 405465 - DNA, 558 bp, Homo sapiens
  misc_feature: GZ8MTXP02FY2NJ.3.48.E04.1.454.CMB.2.raw
  modified_base (245)..(245): a, c, t, g, unknown or other
  modified_base (305)..(305): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcgggggagcgtggcccagccgtgggacgtccctnagctctctgtgcagcgtctggattcagtttcgctacacatggcatgctacgtcgggtccnccagtcctccgaggcgaaggggctggcgtaggtgggtggtccgtttatcgaagtcgagtcgggactcatagaaacaatagtgcaacgtaccgtccggtaggaacgggtcctagttcatcaactcctaccgagtaacgaccaaacctaccaaacaacacaacgtagactacacaaatacgacacgcctagacgacgtacggacgacgacggtcttaatacgttatcgtacgtccttagtactttactagtatag

SEQ ID NO: 405466 - DNA, 498 bp, Homo sapiens
  misc_feature: GZ8MTXP02F7ENV.3.48.E04.1.454.CMB.2.raw
  modified_base (240)..(240): a, c, t, g, unknown or other
  modified_base (300)..(300): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctnagactctcctgtgcagcgtctggattcagtttcgctacacatggcatgcactgggtcccncagtctccaggcaaggggctgcagtgggtgccgtttatcgaagcgatgggactcatgaaacatatgcagactccgtagaacgggcgattcatcatctcagagacaactaccaacaacacactagactctaccaaatacgaacagcctagacgagtcgacgacgacgcgtatattatgtcgccttagattactatgtaa

SEQ ID NO: 405467 - DNA, 595 bp, Homo sapiens
  misc_feature: GZ8MTXP02FWJ4F.3.48.E04.1.454.CMB.2.raw
  modified_base (242)..(242): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggagtccctnagactctcctgtgcagcgtctggattcagtttcgctacacatggcatgcacgtgggtcccgcagtctccgaggcaaggggctgcaggtgggtgtccgtttatcgaagcgatgggactcatagaaacaatatgacagaccgtccggtaggaacgggccgtagttcatccaatcctaccagacgaaccaaacctacccaaaacaaacaccaacgtagaactacctaaccaaaatacgaaacacgacctaggaaggaacgtacggaaacggaaccgaaccgggtaccgttaaattaacgtttaagttcggttacgtaccccgtttaggtaactttaaccgtaacgttacggtaaag

SEQ ID NO: 405468 - DNA, 495 bp, Homo sapiens
  misc_feature: GZ8MTXP02JS7UU.3.48.E04.1.454.CMB.2.raw
  modified_base (242)..(242): a, c, t, g, unknown or other
  modified_base (301)..(301): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggagtccctnagactctcctgtgcagcgtctggattcagtttcgctacacatggcatgcactgggtccnccagtctccaggcaaggggctgcaggtgggtgccgtttatcgaagcgatgggactcatgaacaatatgcagactcgtgaagggcgattcatcatctccagacgacaactccaacaacacactgactctacaaatcgaacagcctgacgagtacgagacacggccgtatatatgtctccttagacttactatgta

SEQ ID NO: 405469 - DNA, 563 bp, Homo sapiens
  misc_feature: GZ8MTXP02FUL1N.3.48.E04.1.454.CMB.2.raw
  modified_base (242)..(242): a, c, t, g, unknown or other
  modified_base (301)..(301): a, c, t, g, unknown or other
  modified_base (355)..(355): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggacgtccctnagactctcctgtgcagcgtctggattcagtttcgctacacatggcatgcactgggtccnccagtctccaggcaaggggctgcagtggtgcgtttatcgaagtcgacggactcntgaaacaatatgacagactaccgtgaacgggccgagttcatcatctacagacgacaaacctaccaaacaaccacactaggactacctaccaaatcgaaacacgacctagacgaacggtaccggaaggaccggaccggtaccgttaacttaacgttaagtttcgtaacggttccccttaggtaacctttaacttacgtacggtattaag

SEQ ID NO: 405470 - DNA, 569 bp, Homo sapiens
  misc_feature: GZ8MTXP02JKWQ4.3.48.E04.1.454.CMB.2.raw
  modified_base (244)..(244): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacgtccctnagacctctcctgtgcagcgtctggattcagtttcgctacacatggcatgcacgtcgggtcccgccagtcctccgaggcgaaggggctgcgaggtgggtggtccgtttagtcgaagcgagtcgggactcgaatagaaactaatagtgacaagtaccgtccggtaggaacgggtcgtattcatcatctaccagacaaccaactaccaaacaacacactagactactaccaaatcgaaacacgccgtagaacgtacgtacggaaacggaaccgaccggtaccgtaacttatttaagtcgtcgtaccttagtactttacgtattagtaa

SEQ ID NO: 405471 - DNA, 549 bp, Homo sapiens
  misc_feature: GZ8MTXP02I3OM9.3.48.E04.1.454.CMB.2.raw
  modified_base (177)..(177): a, c, t, g, unknown or other
  modified_base (240)..(240): a, c, t, g, unknown or other
  modified_base (301)..(301): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagnggtgtccactgtcagctgcttctagttgagtcgggggagcgtggcccagcctgggagtccctnagactctcctgtgcagcgtctggattcagtttcgctacacatggcatgcacgtgggtcccncagtcacgaggcgagggctgcgtaggtgggtgtccgtttagtcgaagcgtagtcggactcgatagaaactagtgtcgacacgtaccgtacggtaggacggctattcatcatctacagacaacaacaccaaacaacacacgtagactactaacaaagtacaacacgacgtagaacgacggtacgaacggaaccgacggtacgtaacttattagttcgtacgtaccgtttagtactttactagtacgtag

SEQ ID NO: 405472 - DNA, 550 bp, Homo sapiens
  misc_feature: GZ8MTXP02JFSA2.3.48.E04.1.454.CMB.2.raw
  modified_base (242)..(242): a, c, t, g, unknown or other
  modified_base (302)..(302): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggacgtccctnagctctcctgtgcagcgtctggattcagtttcgctacacatggcatgcacgtgggtcccnccagtcctccgaggcgaaggggctggcgtaggtggggtggtccgtttatcgaagcgagtgggactcatagaaacatatgcagacctcggtaggaacgggcctattcgatcactcctaccagacgaaccaacctaccaaacaacaacaatagactactaacaaatacgaaacacgacctagacgagtacggaacggacgacggtaccgtaacttattagtgtacgtccttagtacttactactagtaag

SEQ ID NO: 405473 - DNA, 509 bp, Homo sapiens
  misc_feature: GZ8MTXP02FQSA3.3.48.E04.1.454.CMB.2.raw
  modified_base (243)..(243): a, c, t, g, unknown or other
  modified_base (304)..(304): a, c, t, g, unknown or other
  modified_base (372)..(372): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcgggggagcgtggcccagcctgggagtccctnagactctcctgtgcagcgtctggattcagtttcgctacacatggcatgcacgtcgggtccnccagtctccaggcaaggggctgcaggtgggtgtccgtttatcgaagcgatgggactcatgaaacatangcagactcgtagaggcattcatcatctcagacacactacaacacacactgactcaccaaatcgaacacgcctagagacgtacgacggacacggaccgtatattatcggtctacccgttagtactttactagtagtaa

SEQ ID NO: 405474 - DNA, 508 bp, Homo sapiens
  misc_feature: GZ8MTXP02JSAQU.3.48.E04.1.454.CMB.2.raw
  modified_base (304)..(304): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgctcttttaagaggtgtccactgtcagctgcttctagttgaggtcggggggagcgtggcccagcctggggaggtccctcagactctcctgtgcagcgtctggattcagtttcgctacacatggcatgcactgggtccncagtctcaggcaaggggctgcagtgggtgccgtttatcgaagcgatgggactcatgaaacatatgacagactccgtgaaggcgattcatcatctcagagacaactccaacaacacactagactccaccaaatcgaacagcctagacgagtcgaacgacgacggaccgtatacttattgtacgccctttagactttactattaga

SEQ ID NO: 405475 - DNA, 557 bp, Homo sapiens
  misc_feature: GZ8MTXP02HRFV6.3.48.E04.1.454.CMB.2.raw
  modified_base (242)..(242): a, c, t, g, unknown or other
  modified_base (303)..(303): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggaggtccctnagactctcctgtgcagcgtctggattcagtttcgctacacatggcatgcacgtgggtcccnccagtcctccgaggcaaggggctgcgaggtggggtgtccgtttatcgaagcgagtgggactcgatagaacaatatgacagacctcgtagaagggccgattcatcatctacagacgacactccaaacaacacactagactactacaaatcgaaacagaccctagacgtaacgtcggaacggacgaacggtacccgttaacttaacgttaagttcggtacgtccccgtttagtaaactttacgttaacgtagtaag

SEQ ID NO: 405476 - DNA, 549 bp, Homo sapiens
  misc_feature: GZ8MTXP02H78MJ.3.48.E04.1.454.CMB.2.raw
  modified_base (177)..(177): a, c, t, g, unknown or other
  modified_base (240)..(240): a, c, t, g, unknown or other
  modified_base (252)..(252): a, c, t, g, unknown or other
  modified_base (302)..(302): a, c, t, g, unknown or other
  modified_base (470)..(470): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagnggtgtccactgtcagctgcttctagttgagtcgggggagcgtggcccagcctgggagtccctnagactctcctgngccagcgtctggattcagtttcgctacacatggcatgcacgtcgggtccnccagtcctccgaggcaaaggggctgcaggtggggtgccgtttatcgaagcgagtggggactcattagaaactaatatgactagaccttccggtaggaacgggccgagttcagtcactcacctagacgaacaactaccaacaacacactgatacctacaaatcgaaacncgacctaggacgaggtcgaacggaccgacggtaccgtattaacgttactcggtctacccttgaactttactagttagaa

SEQ ID NO: 405477 - DNA, 630 bp, Homo sapiens
  misc_feature: GZ8MTXP02IN691.3.48.E04.1.454.CMB.2.raw
  modified_base (245)..(245): a, c, t, g, unknown or other
  modified_base (309)..(309): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacggtccctnagactctcctgtgcagcgtctggattctagtttcgctacacagtggcatgcacgtcgggtcccncgagtccgtccgaggcgaaggggctggcgtagggtgggtggtccgttttagtacgagcgtagtcggactcagtagaaactaatatgacaagtacctaccggtaggaacggggcctaattcgtactacctactacctaccgaagaacaaaccaaacctaaccaaactaacaactacgtagaactaccctaactaaaactacgaaaccgacgtaccgaaggaaacgtacggtaacggaacggaaacccgaaacggggttacccttaaagttacttaacgtttcgtaccgtacccgttaagtaactttacgtaagtacgtaaag

SEQ ID NO: 405478 - DNA, 493 bp, Homo sapiens
  misc_feature: GZ8MTXP02F1QRW.3.48.E04.1.454.CMB.2.raw
  modified_base (242)..(242): a, c, t, g, unknown or other
  modified_base (302)..(302): a, c, t, g, unknown or other
  modified_base (364)..(364): a, c, t, g, unknown or other
  modified_base (400)..(400): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagttgggctgagttgggttttcctcgttgctcttttaagaggtgtccactgtcagctgcttctagttgaggtcgggggagcgtggcccagcctgggacggtccctnagactctcctgtgcagcgtctggattcagtttcgctacacatgacatgcacgtgggtccncagtctccaggcaggggctgcagtggtgcgtttatcgaagcgagtggactcatgaaacaatntgcagactccgtgaagggcattcatcatctccaganacaactaccaaacacacactgaactctacaaatgaacagcctagacgagtacgagacacggcctaatattatgtcaccttgattactatagta

SEQ ID NO: 405479 - DNA, 507 bp, Homo sapiens
  misc_feature: GZ8MTXP02FN8JV.3.48.E04.1.454.CMB.2.raw
  modified_base (244)..(244): a, c, t, g, unknown or other
  modified_base (304)..(304): a, c, t, g, unknown or other
  modified_base (408)..(408): a, c, t, g, unknown or other
  modified_base (503)..(503): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggaggtccctnagactctcctgtgcagcgtctggattcagtttcgctacacatggcatgcacgtgggtccnccagtctccaggcaaggggctgcaggtgggtgccgtttatcgaagcgatgggactcatgaaacaatatgcagactccgtagacgggcgattcatcatctcaganacaactaccaaacaacacactagactacaccaaatacgaacagctagacgagacgacggacacggccgtatattatgtcgccttagattactatntaag

SEQ ID NO: 405480 - DNA, 683 bp, Homo sapiens
  misc_feature: GZ8MTXP02F2W5G.3.48.E04.1.454.CMB.2.raw
  modified_base (245)..(245): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcgggggagcgtggcccagccgtgggacgtccctnagactctcctgtgcagcgtctggattcagtttcgctacacatggcatgcacgtcgggtcccgcgaggcctaccggaggggaaggggcgtggggagtggcgtcggaccccaacgaacgtaaaaccccgagaacgttacggaaacctttaacgttccaaactaacttagttacggtacgggtaacttcgttagggtacggggacgggggtacccgtagtttaccaacccgtaattcccgtacccgaaagaaccgaacccaaaacccccgtaaagtaaacccttacgtaaccgtttacggtttacctacgtaaccgtaaaacgtcgggaaaccacggtacccgtaggaacggaaccggaccggaacggaaccgacggtactacggtaaattacgttacgtacgtgacgaagagtaatacgtagaaacgaaactagtaaaag

SEQ ID NO: 405481 - DNA, 548 bp, Homo sapiens
  misc_feature: GZ8MTXP02GHARR.3.48.E04.1.454.CMB.2.raw
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggaggtccctcagactctcctgtgcagcgtctggattcagtttcgctacacatggcatgcacgtgggtcccgccagtcctccgaggcgaaggggctgcgaggtggggtggccgtttatcgaagcgagtgggactcgatagaaacaatatgacagacgtccgtaggaacgggcgattcatccatccacagacacaactaccaaacaacacactagactacctaacaaatacgaacacgtccgagaacggacgtacggacggacgacggtaccgtaacgttattagttcgtcgtaccgttagtaattactatagtaag

SEQ ID NO: 405482 - DNA, 592 bp, Homo sapiens
  misc_feature: GZ8MTXP02FT4H4.3.48.E04.1.454.CMB.2.raw
  modified_base (244)..(244): a, c, t, g, unknown or other
  modified_base (306)..(306): a, c, t, g, unknown or other
  modified_base (380)..(380): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctggggacgtccctnagactctcctgtgcagcgtctggattcagtttcgctacacatggcatgcacgtcgggtcccncagtcctccgaggcgaaggggctgcgaggtgggtgtcgtttatcgaagcgagtggactcgatacgaaacaagtntaggacagtacctccggtaggaacggggtcctattccgatccattcctaccgaagtacaaaccaaacctaaccaaacaacacctacgtagacctactaccaaatacgaaacacgtaccgtaagaacggtacggtacggaacggaaccggaccggtaccgttaattacgttaagttcgtacgtaccgtttagtaactttacgtagtagttaag

SEQ ID NO: 405483 - DNA, 510 bp, Homo sapiens
  misc_feature: GZ8MTXP02GLE6S.3.48.E04.1.454.CMB.2.raw
  modified_base (240)..(240): a, c, t, g, unknown or other
  modified_base (301)..(301): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctnagactctcctgtgcagcgtctggattcagtttcgctacacatggcatgcacgtgggtcccnccagtcctccgaggcaaggggctgcaggtgggtggccgtttatcgaagcgatgggactcatgaaacaatatgcagactccgtagaagggccgattcatcatctccagagacaactaccaacaacacactgatctacaaatagaacagcctagagacgtcgacggacgacggaccgtatattattgtcgtcccttagactttactatgta

SEQ ID NO: 405484 - DNA, 523 bp, Homo sapiens
  misc_feature: GZ8MTXP02ILZ3G.3.48.E04.1.454.CMB.2.raw
  modified_base (299)..(299): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctcagactctcctgtgcagcgtctggattcagtttcgctacacatggcatgcacgtggtccnccagtctccaggcaggggctgcaggtgggtgccgtttatcgaagcgagtgggactcatgaaacatatgcagactcgtaggaacggcgatcatcatctcagagaacaaccaccaacaacacactagactactacaaatacgaacacgaccgtagaagaggtacggaacggaaccgaccggaccgtaatacttagttgtacgtacccttagtacttactatagtaa

SEQ ID NO: 405485 - DNA, 580 bp, Homo sapiens
  misc_feature: GZ8MTXP02F8ODW.3.48.E04.1.454.CMB.2.raw
  modified_base (245)..(245): a, c, t, g, unknown or other
  modified_base (307)..(307): a, c, t, g, unknown or other
  modified_base (438)..(438): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacggtccctnagactctcctgtgcagcgtctggattcagtttcgctacacatggcatgcacgtcgggtcccncagtcctccgaggacgaaggggctgcgaggtgggtggtccgtttatcgaagcgtagtcgggactcatagaaacaaatagtgacaagacctccgtaggaaacgggccgtattcgaatcaatcctaccaaganaaacaacctaccaaaacaacacacgtagaactcaacctaaatacgaaacacgacctagaagtacgtacggaacggaaccgaaccggtaccgtaaattatttaagttgtacgtacccgttacgtaatttaactattagtaaag

SEQ ID NO: 405486 - DNA, 526 bp, Homo sapiens
  misc_feature: GZ8MTXP02JG9J6.3.48.E04.1.454.CMB.2.raw
  modified_base (240)..(240): a, c, t, g, unknown or other
  modified_base (301)..(301): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctnagactctcctgtgcagcgtctggattcagtttcgctacacatggcatgcacgtgggtcccnccagtctccgaggcaaggggctgcaggtgggtgccgtttatcgaagcgatgggactcagtgaaacaatatgacagactccgtagaacgggcattcatcatctccagacgacaaactaccaaacaacacacgtagactactaccaaatcgaaacagacctagagagtacgacggaacgacggtaccgtaattattattgtactcccgttagacttactagtataag

SEQ ID NO: 405487 - DNA, 525 bp, Homo sapiens
  misc_feature: GZ8MTXP02FGXXI.3.48.E04.1.454.CMB.2.raw
  modified_base (242)..(242): a, c, t, g, unknown or other
  modified_base (301)..(301): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctggggaggtccctnagactctcctgtgcagcgtctggattcagtttcgctacacatggcatgcactgggtccncagtcctccaggcaaggggctgcagtgggtgcgtttatcgaagcgagtgggactcatagaaacaatatgcaagactccgtaggaacggggccgattcatcatctccagacgacaactaccaacaacaacactagactactaccaaatcgaaacacgcctagagagtacggacggacacgggtaccgtaactattattgtcgtcccttagtactttactatgtaa

SEQ ID NO: 405488 - DNA, 549 bp, Homo sapiens
  misc_feature: GZ8MTXP02JGZ6G.3.48.E04.1.454.CMB.2.raw
  modified_base (178)..(178): a, c, t, g, unknown or other
  modified_base (246)..(246): a, c, t, g, unknown or other
  modified_base (280)..(280): a, c, t, g, unknown or other
  modified_base (307)..(307): a, c, t, g, unknown or other
  modified_base (467)..(467): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagnggtgtccactgtcagctgcttctagttgaggtcgggggaggcgtggcccagccgtgggacggtccctnagactctcctgtgcagcgtctggattctagttcnctacacatggcatgcacgtcgggtccnccagtcctacgaggcgaaggggctggcgaggtgggtgtccgtttagtcgaagcgagtgggactgatgaaactaatagtgacaagaccgtcgtaggacggccgtattcactcactctacagacgacaactaccaaacaacacactagactactaacaatanaacacgactagacgacgacgacggacgacggtaccgtattacttagttcgtacgtacccgttagtactttactactagtaag

SEQ ID NO: 405489 - DNA, 516 bp, Homo sapiens
  misc_feature: GZ8MTXP02IIHL8.3.48.E04.1.454.CMB.2.raw
  modified_base (242)..(242): a, c, t, g, unknown or other
  modified_base (301)..(301): a, c, t, g, unknown or other
  modified_base (357)..(357): a, c, t, g, unknown or other
  modified_base (406)..(406): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggagtccctnagctctcctgtgcagcgtctggattcagtttcgctacacatggcatgcacgtgggtccnccagtctccgaggcaaggggctgcaggtgggtgcgtttatcgaagcgatgggactnatgaaacatatgcaagactcgtagaagggccgattcatcatctacaganacaactaccaaacaacacactagactctacaaatcgaaacacgctagacgtagtcgaacggacgacggtaccgtaatatttatgtacgtccttagtacttactatagtaa

SEQ ID NO: 405490 - DNA, 531 bp, Homo sapiens
  misc_feature: GZ8MTXP02F13QZ.3.48.E04.1.454.CMB.2.raw
  modified_base (243)..(243): a, c, t, g, unknown or other
  modified_base (301)..(301): a, c, t, g, unknown or other
  modified_base (368)..(368): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcggggggagcgtggcccagcctgggagtccctnagctctcctgtgcagcgtctggattcagtttcgctacacatggcatgcactgggtccnccagtctccgaggcaaggggctgcagtgggtgccgtttatcgagcgatgggactcatagaaacaatntgacagacctccgtagacgggccattcatcatcctacagacgaacaacctaccaaacaacacactgaactctaccaaaatgaaaccagccctagaacgagtacggacggaaccacgggccgtaattacttaagttcgtcgccctttagactttacgtatgtaa

SEQ ID NO: 405491 - DNA, 560 bp, Homo sapiens
  misc_feature: GZ8MTXP02IBZJE.3.48.E04.1.454.CMB.2.raw
  modified_base (241)..(241): a, c, t, g, unknown or other
  modified_base (300)..(300): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggagtccctnagactctcctgtgcagcgtctggattcagtttcgctacacatggcatgcactgggtccnccagtctccgaggcgaaggggctgcgaggtgggtggccgtttatcgaagcgatgggactcatgaaacaatatgacagacctcgtaggaagggccattcatcatctaccagacgaccaacctaccaaacaacacacgtagactctaccaaatacgaaacacgaccctagaacgacgtaccggaagggacccgaacgggtaccgttaaattagtttaacgtttgtacggttaccctttagtaactttacttaagttagtaag

SEQ ID NO: 405492 - DNA, 568 bp, Homo sapiens
  misc_feature: GZ8MTXP02JH3YQ.3.48.E04.1.454.CMB.2.raw
  modified_base (244)..(244): a, c, t, g, unknown or other
  modified_base (305)..(305): a, c, t, g, unknown or other
  modified_base (312)..(312): a, c, t, g, unknown or other
  modified_base (324)..(324): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacgtccctnagactctcctgtgcagcgtctggattcagtttcgctacacatggcatgcacgtgggtcccncacgtcncgaggcgaggcngcgtggtggtgtacgtttagtcgagcgtagtcggactcgagtagaaactaagtagtcgacgacgtaccgtaccggtaggaacgggtaccgtattacactactactcctaccaacgaacaaccaacctaaccaaaccaaaccacacgtagactaccaacaaatacgaacacgcgtagacgacgacgaacggaccgacggtacgttaactattagtcgtacgttaccttagtacttactactagta

SEQ ID NO: 405493 - DNA, 587 bp, Homo sapiens
  misc_feature: GZ8MTXP02GJB04.3.48.E04.1.454.CMB.2.raw
  modified_base (244)..(244): a, c, t, g, unknown or other
  modified_base (306)..(306): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacgtccctnagactctcctgtgcagcgtctggattcagtttcgctacacatggcatgcacgtcgggtcccnccagtcctccgaggcgaaggggctgcaggtgggtggccgtttagtcgaagcgagtgggactcgaatagaaactaatagtgacgacgtaccgtccggtaggaacggggtacccgtattccgaatccgtacttaccgtacccgaagaacgaaacctaaaccctaacccaaaaccaaaccaaccacgtagacctacctaaccaaatacgaacacgaccgtagacgacgtacggacggacacggtcctaatattagtcgtcgtaccttagtacttactactgtaa

SEQ ID NO: 405494 - DNA, 517 bp, Homo sapiens
  misc_feature: GZ8MTXP02F5LHY.3.48.E04.1.454.CMB.2.raw
  modified_base (244)..(244): a, c, t, g, unknown or other
  modified_base (304)..(304): a, c, t, g, unknown or other
  modified_base (409)..(409): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaaagaggtgtccactgtcagctgcttctagttgaggtcgggggagcgtggcccagcctgggagtccctnagctctcctgtgcagcgtctggattcagtttcgctacacatggcatgcacgtgggtcccnccagtctccgaggcgaaggggctgcaggtggggtgccgtttatcgaagcgagtgggactcatagaaacatatgcagactccggtagaacgggcgattcatcatcncagagacaactaccaacaacacactggactctaccaaatcgaaacagcctaggacgagtcgacggacacggaccgtatattatgtctacccttagatttactatgtaa

SEQ ID NO: 405495 - DNA, 589 bp, Homo sapiens
  misc_feature: GZ8MTXP02IL977.3.48.E04.1.454.CMB.2.raw
  modified_base (242)..(242): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggagtccctnagactctcctgtgcagcgtctggattctagtttcgctacacatggcatgcacgtcggcccgccagtcctccgaggcgaaggggctggcgtaggtggggtcggtaccgtttagtcgaagcgtagtcgggactcgaatagaaactaatatcgacaacgacgtaccgtaggaacgggccgtattacgatccaactcctaccagacgaacaacctaccaaacaacacacgtagactacctaacaaatcgaaactacgacctagaagacggtacggaacgaaccgacggtaccgttaacttaagtttaacgtgttacgtacccgtttagtaactttacttaagtacgtaacg

SEQ ID NO: 405496 - DNA, 682 bp, Homo sapiens
  misc_feature: GZ8MTXP02F6EHN.3.48.E04.1.454.CMB.2.raw
  modified_base (305)..(305): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtgggacgtccctcagactctcctgtgcagcgtctggattcagtttcgctacacatggcatgcacgtcgggtcccncagtctccgaggcaaggggctggcgtggtgggtgtacgtttagtacgagcgtaggtcggactgagtaacgaaactaatagtacgacgtaacgtaccgtaccggtaaagggaaccggggtaccttaacgttactaactctaaccttaccgtaccgaaaggtaaccaaacccaaaccctaaacccgaaaaccctaaccgaacctaacggtaacgtaaccttaccctaaaactaaaacgtaacgaaacgaccgtaccgtaaggaaacggtaccggaaacgggaaccggtaaaccggtaaccggggttaaccttaaagttacgtttaacgttaacggttacccgttacggttacgttaaacgtttaactacgtagttaaag

SEQ ID NO: 405497 - DNA, 523 bp, Homo sapiens
  misc_feature: GZ8MTXP02F68P8.3.48.E04.1.454.CMB.2.raw
  modified_base (243)..(243): a, c, t, g, unknown or other
  modified_base (303)..(303): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggacgtccctnagctctcctgtgcagcgtctggattcagtttcgctacacatggcatgcacgtgggtcccncagtctccgaggcgaaggggctgcgaggtgggtgccgtttatcgaagcgatgggactcatgaaacatatgcagacgtcgtagaacgggccgattcatcaatcctccagacgaacaacctaccaaacaacacactagactactaccaaatacgaacagcctagacgagtacgaacggacgacggaccgtatattatgtcgtccttagactttactatgtaa

SEQ ID NO: 405498 - DNA, 627 bp, Homo sapiens
  misc_feature: GZ8MTXP02GH8XG.3.48.E04.1.454.CMB.2.raw
  modified_base (242)..(242): a, c, t, g, unknown or other
  modified_base (306)..(306): a, c, t, g, unknown or other
  modified_base (392)..(392): a, c, t, g, unknown or other
tcagagacgcactccacgaccggtgctcgatttagagagcgtcacagagagaaggggctgggagaggagcccagcactagaagtcggcggtgtttccattcggtgatcagtactgaacacagaggactcaccatggagtttgggctgagtttgggttttcctcgttgctcttttaagaggtgtccactgtcagctgcttctagttgaggtcgggggagcgtggcccagcctgggagtccctnagactctcctgtgcagcgtctggattctagtttcgctacacatggcagtgcacgtcgggtcccnccagtcctccgaggacgaaggggctggcaggtggggtcgtcgtttagtacgaacgcgtagtcgggactcagtacgaaactaatagngacaagtacccgtaccgtaggaaacggccgtagttcactacactcctaccgaagaacgaactaaacttaccgaaaacgaacacgactagactactctacgaacaaagtacgaaacgacgaccgtaggaacggtaacggacccggaaacggacccgtacccggttaccctttaagtaaccgtaacggtaacgtaaccgaaaaaccctaacgtacgaaaccgtttaacgtaaaacgg

SEQ ID NO: 405499 - DNA, 525 bp, Homo sapiens
  misc_feature: GZ8MTXP02IDM35.3.48.E04.1.454.CMB.2.raw
  modified_base (241)..(241): a, c, t, g, unknown or other
  modified_base (301)..(301): a, c, t, g, unknown or other
  modified_base (357)..(357): a, c, t, g, unknown or other
  modified_base (368)..(368): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggagtccctnagactctcctgtgcagcgtctggattcagtttcgctacacatggcatgcacgtgggtccnccagtcctccaggcaaggggctgcaggtggtgccgtttatcgaagcgatgggactnatgaaacaatngacagactccgtaggaacgggcctaagttcaatcatctaccagagaacaactaccaaacaacacactgactactaccaaatacgaacagcctagagagtacgacggacgacggtaccgtattattattgtcgtacccttagtactttactaatgtaa

SEQ ID NO: 405500 - DNA, 560 bp, Homo sapiens
  misc_feature: GZ8MTXP02I3K8W.3.48.E04.1.454.CMB.2.raw
  modified_base (241)..(241): a, c, t, g, unknown or other
  modified_base (301)..(301): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggagtccctnagactctcctgtgcagcgtctggattcagttcgctacacatggcatgcacgtgggtcccnccagtcctccgaggcgaaggggctgcgaggtgggtggtccgtttagtcgaaggcgagtggggactcgatagaaactaatagtgacaacgaccgtccggtaggaacgggccgtacttcgatctaactcctaccgagacgaaaccaaacctacccaaacaaaccacacgtagactacctacaaatacgaacagcctagacgacggtacgacggacgacggacgtacttattatgtacgtaccttagacttactatacgtag

SEQ ID NO: 405501 - DNA, 550 bp, Homo sapiens
  misc_feature: GZ8MTXP02J0329.3.48.E04.1.454.CMB.2.raw
  modified_base (241)..(241): a, c, t, g, unknown or other
  modified_base (300)..(300): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcggggggagcgtggcccagcctgggagtccctnagctctcctgtgcagcgtctggattcagtttcgctacacatggcatgcacgtggtcccnccagtcctccgaggcaaggggctgctaggtggggtggtccgtttagtcgaagcgagtcggggactcgaatagaaacaatatgactagaccgtccgtaggaacgggccgtattcactcaactcctaccgagacgaaccaaactacccaaacaaccacacgtagactcctaaccaaatacgaacacgccgtagacgtacgcgacggacacggtactacttattagtcgtcgtcctacgtacttactatcgta

SEQ ID NO: 405502 - DNA, 540 bp, Homo sapiens
  misc_feature: GZ8MTXP02HV8SC.3.48.E04.1.454.CMB.2.raw
  modified_base (246)..(246): a, c, t, g, unknown or other
  modified_base (307)..(307): a, c, t, g, unknown or other
  modified_base (434)..(434): a, c, t, g, unknown or other
  modified_base (449)..(449): a, c, t, g, unknown or other
tcagagacgcactccacgaccggtgctcgatttagagagcgtcacagagagaaggggctgggagaggagcccagcactagaagtcggcggtgtctccattcggtgatcagcactgaacacagaggactcaccatggagtttgggctgagtttgggttttcctcgttgcttcttttaagaggtgtccactgtcagctgctttctagttgaggtcgggggagcgtggcccagccgtgggacgtccctnagctctcctgtgcagcgtctggattcagtttcgctacacatggcatgcacgtcggggtccncctagtcctccgagggcgaaggggctggcagggtgggtcgtcgtttatcggaagcgagtggggctcatagaaacaagtatgacagactccggtagaacgggccgtattacattcactcctaccaganaaccaactaccaaanaaccacactagactacaccaaatagaacagcctagacgagacgaggaacacggactatattaagttgtacgtccttagtactacgttatag

SEQ ID NO: 405503 - DNA, 545 bp, Homo sapiens
  misc_feature: GZ8MTXP02IFGGG.3.48.E04.1.454.CMB.2.raw
  modified_base (241)..(241): a, c, t, g, unknown or other
  modified_base (302)..(302): a, c, t, g, unknown or other
  modified_base (376)..(376): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggacgtccctnagactctcctgtgcagcgtctggattcagtttcgctacacatggcatgcacgtgggtcccnccaggtcctccgaggcgaaggggctggcaggtgggtgtcgtttatcgaagcgatgggactcatagaaactaatntgcaagacctcggtaggaacgggcagttcatcatcctacagtacgaacctaaacctaccaaaacaacacctacgtcgaactcctaacaaatacgaacacgcctagacgagtacggacgaccgacgtcctaagttactagttcgtctaccgttgtaactttactatagta

SEQ ID NO: 405504 - DNA, 533 bp, Homo sapiens
  misc_feature: GZ8MTXP02FPEEC.3.48.E04.1.454.CMB.2.raw
  modified_base (243)..(243): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggaggtccctnagactctcctgtgcagcgtctggattcagtttcgctacacatggcatgcacgtgggtcccgccagtcctccgaggcaaggggctgcagtggggtggccgtttatcgaagcgagtggggactcgatgaaacaatatgcagacgtccgtaggaacgggccgattcatcatctccagacgaacaacaccaaacaacacactagactactaccaaatacgaacagacctgaacgagtacgacggacgacggaccgttaatattacttgtcgtaccttagtacttactactgtaa

SEQ ID NO: 405505 - DNA, 606 bp, Homo sapiens
  misc_feature: GZ8MTXP02HUMRS.3.48.E04.1.454.CMB.2.raw
  modified_base (242)..(242): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggaggtccctnagactctcctgtgcagcgtctggattcagttcgctacacatggcatgcacgtgggtccgccagtctccgaggcaaggggctgcgtaggtgggtgtcgtttagttcgaagcgagtgggactcgatagaaactaatagtgacagtactacccggaggaacgggccgtaattcgatcctatcctaccagacgaaccaacctaccaaacaacacactagactactaaccaaaatacgaaactacgaccgtaacggaacgacggtaccggaacggaaccggaacccgggttaccgtaaactttaaagttacgtttaacggttaccgttaccccgtttaggtaactttaccgttaaacgttaggttaaag

SEQ ID NO: 405506 - DNA, 544 bp, Homo sapiens
  misc_feature: GZ8MTXP02G72SA.3.48.E04.1.454.CMB.2.raw
  modified_base (240)..(240): a, c, t, g, unknown or other
  modified_base (301)..(301): a, c, t, g, unknown or other
  modified_base (352)..(352): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctnagactctcctgtgcagcgtctggattcagtttcgctacacatggcatgcacgtgggtcccncagtctccgaggccaaggggctgcgaggtgggtggtccgtttagtcgaagngaagtgggactcgatagaaacaatatgacacgactacgaaacggtcagtacatctactcctacgaagacaaccaactaccaaacaacaacactagactactaacgaaatacgaactacgacctagaacgtaacgtacgaagacgacggactaagttattagttcgcgtccttagtacttactatagaataag

SEQ ID NO: 405507 - DNA, 546 bp, Homo sapiens
  misc_feature: GZ8MTXP02G617K.3.48.E04.1.454.CMB.2.raw
  modified_base (303)..(303): a, c, t, g, unknown or other
  modified_base (381)..(381): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggagtccctcagactctcctgtgcagcgtctggattcagtttcgctacacatggcatgcacgtcgggtcccnccagtcctccgaggccgaaggggctgcgaggtggggtgtccgtttatcggaagcgagtgggactcgatagaaacaatntgcagactcgaggacgggcattcatcatctacagacgacaacctaccaaacaacacactagactacctacaaatacgaacacgcctagaacgacgtacgaacggaccgaccggtaccgttaataatttaagtcgtacgtacccgttagtactttactagtagtaa

SEQ ID NO: 405508 - DNA, 515 bp, Homo sapiens
  misc_feature: GZ8MTXP02GXYL5.3.48.E04.1.454.CMB.2.raw
  modified_base (244)..(244): a, c, t, g, unknown or other
  modified_base (305)..(305): a, c, t, g, unknown or other
  modified_base (511)..(511): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcgggggagcgtggcccagccgtgggagtccctnagactctcctgtgcagcgtctggattcagtttcgctacacatggcatgcacgtgggtcccncagtctccgaggcaaggggctgcaggtgggtgcgtttatcgaagcgagtggactcatagaaactaatatgacaagactccgtagaagggccattcatcatctcagacacaactacaaacaacacactagactacacaaatcaaacacgcctagaacgagtacgacggaccacggcctaatacttatcgtcgtcctagacttactangtaa

SEQ ID NO: 405509 - DNA, 560 bp, Homo sapiens
  misc_feature: GZ8MTXP02H9GVU.3.48.E04.1.454.CMB.2.raw
  modified_base (245)..(245): a, c, t, g, unknown or other
  modified_base (476)..(476): a, c, t, g, unknown or other
  modified_base (486)..(486): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagttttgggctgagtttgggttttcctcgttgcttcttttaagaggtgtccacttgtcagctgcttctagttgaggtcgggggagcgtggcccagcctgggagtccctnagactctcctgtgcagcgtctggattcagttcgctacacatggcatgcacgtggtccgccagtctccaggcaaaggggctgcgaggtggtgccgtttatcgtagcgagtgggactcagtagaaactataatgacagactccgtagaacggccgaattcatcatctaccagaacgaaccaactaccaaaacaaacaactaactacgaactacctaaccaaagtacgaaaacncgacctaganaacggtcgaaacggaccgacggaccgtattaagttattggttacacccgtttagtaacttacgttaattagtaa

SEQ ID NO: 405510 - DNA, 537 bp, Homo sapiens
  misc_feature: GZ8MTXP02JZED0.3.48.E04.1.454.CMB.2.raw
  modified_base (239)..(239): a, c, t, g, unknown or other
  modified_base (300)..(300): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggccagcctgggagtccctnagactctcctgtgcagcgtctggattcagtttcgctacacatggcatgcacgtgggtcccncagtcctcgaggcaaggggctggctaggtgggtgtccgtttatcgaagcgagtgggactcatgaaacatatgacacgactaccggtggaacgggccgtatcatcacgtctaccagacgacaacctaccaaacacacactgactacctaacaaatcgaaacacgacctagacgagtacgacggaacgaccggaccgtaattacttagtcgtcgtaccctttagactttactatagtaa

SEQ ID NO: 405511 - DNA, 577 bp, Homo sapiens
  misc_feature: GZ8MTXP02FRUMT.3.48.E04.1.454.CMB.2.raw
  modified_base (242)..(242): a, c, t, g, unknown or other
  modified_base (304)..(304): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggacgtccctnagactctcctgtgcagcgtctggattcagtttcgctacacatggcatgcacgtcgggtcccnccagtctccgaggcaaggggctgcagtgggtgccgtttatcgaagcgagtgggactcagtgaaacaatatgcagtactccgtaggaacgggccgagttcatcatctcagacgaacaacctaccaaacaacacactagactactaccaaatacgaaacacgaccgtagaacgtacggtacgacgggaaaccgaaccgggtacccgttaaattaacgtttaacgttaacggttacgtaccccgtttagtaactttaacctaacgttacgtaaacg

SEQ ID NO: 405512 - DNA, 533 bp, Homo sapiens
  misc_feature: GZ8MTXP02F7Q5D.3.48.E04.1.454.CMB.2.raw
  modified_base (242)..(242): a, c, t, g, unknown or other
  modified_base (302)..(302): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggaggtccctnagactctcctgtgcagcgtctggattcagtttcgctacacatggcatgcacgtgggtccncagtctccgaggcaaggggctgcaggtgggtgtccgtttatcggaagcggagtcgggactcagtgaaacatatcgacagactccgtaggaacggcgattcatcatctacagagaacaacaccaacaacacactgaactactacaaatagaaacacgacctgaagtagtacggaacggaccgacggtaccgtaagttacttattgtcgtacccttagacttactatacgtaa

SEQ ID NO: 405513 - DNA, 525 bp, Homo sapiens
  misc_feature: GZ8MTXP02GY3VA.3.48.E04.1.454.CMB.2.raw
  modified_base (242)..(242): a, c, t, g, unknown or other
  modified_base (303)..(303): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggagtccctnagactctcctgtgcagcgtctggattcagtttcgctacacatggcatgcacgtgggtcccnccagtctccgaggcgaaggggctgcaggtgggtgccgtttatcgaagcgagtgggactcatagaaacaatatgacagacctccgtaggaacgggccgattcatcatcacagacgaacaactaccaaacaacacactagactacaccaaatacgaacagctagacgagtacgacgacacggacctaatacttatcgtcgtacccttagtacttactatagtaa

SEQ ID NO: 405514 - DNA, 577 bp, Homo sapiens
  misc_feature: GZ8MTXP02IQLI4.3.48.E04.1.454.CMB.2.raw
  modified_base (280)..(280): a, c, t, g, unknown or other
  modified_base (302)..(302): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggagtccctcagactctcctgtgcagcgtctggattcagtttcgctacncatggcatgcacgtcgggcccnccagtcctccgaggcgaaggggctgcgaggtgggtggtccgtttagtcgaagcgagtcgggactcgaatacgaaactaatatcgactagacctcggaggaaacgggccgtattcgatcactcctacagacacaactacaaactaacacactagactacctaaccaaatcgaaaccagcctaagacgtacggtacgaacggaaccgaaccgggtaccttaattaacgtttacgttcggttacgtacccgtttagaacttttaccgtagtacgtaag

SEQ ID NO: 405515 - DNA, 598 bp, Homo sapiens
  misc_feature: GZ8MTXP02ISI9H.3.48.E04.1.454.CMB.2.raw
  modified_base (200)..(200): a, c, t, g, unknown or other
  modified_base (243)..(243): a, c, t, g, unknown or other
  modified_base (306)..(306): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttntagttgaggtcgggggagcgtggcccagcctgggacgtccctnagctctcctgtgcagcgtctggattctagtttcgctacacagtggcatgcacgtcgggtcccnccagtcctccgaggcgaaggggctggctaggtgggtggtccgtttagtcgaagcgagtcggactcgatagaaactatatcgactagaccgtacgtaggaacgggccgtagttcaacgttcactccgtaccgagaacgaaacctaaacctaaccaaaacctaacaactacgtacgactacctaaccaaataacgaactacgactaggacgacgtacgaacgaaccgtacggtaccgttaattaacgttagttaacgtaccgtaccgtttagtaactttacgtagttacgtaag

SEQ ID NO: 405516 - DNA, 586 bp, Homo sapiens
  misc_feature: GZ8MTXP02I6JY4.3.48.E04.1.454.CMB.2.raw
  modified_base (240)..(240): a, c, t, g, unknown or other
  modified_base (302)..(302): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctnagactctcctgtgcagcgtctggattcagtttcgctacacatggcatgcacgtcgggtcccnccagtcctaccgaggcgaaggggctgcgaggtgggtgtcgtttagtcgaagcgagtgggactcgaagtagaaacaatatgactagaactccggtaggaaacgggccgtaattccaagtcaatcctacgaacgacaaacctaaccaccaaaacaaaccacaacgtacgaacttaccgaacctaaagtacgaaacaacgcctaaggaagacggtacggaaacggaactaccggggaccttaacgttacttaagttcgtcgtcccttagactttaacgtatcgtaaa

SEQ ID NO: 405517 - DNA, 628 bp, Homo sapiens
  misc_feature: GZ8MTXP02HFH0D.3.48.E04.1.454.CMB.2.raw
  modified_base (310)..(310): a, c, t, g, unknown or other
  modified_base (404)..(404): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtggggacgtccctcgagactctcctgtgcagtcgtctggattcagtttcgctacacagtggcagtgcacgtcgggtcccnccagtcctccgaggtccgaaggggctcggacgtaggtggggtggtacccgttttagtcgaagtcgtagtcgggactcagtaagaaactaaagtntcgacgtaacgaccgttacccggtaggaaacggggtccgtaacttacgacttacgacttaccgtaccgaacgacgtaaaccaaccgtaaccaaacaacaccagtacgactcaaccaaatacgaaacacgtccgtaggaacgacggtaccggaacggtaaccaccgggtactaacgttacgttacgttcgtcgttacccgttagttaacttacgtagtacgtaag

SEQ ID NO: 405518 - DNA, 554 bp, Homo sapiens
  misc_feature: GZ8MTXP02F7UH1.3.48.E04.1.454.CMB.2.raw
  modified_base (244)..(244): a, c, t, g, unknown or other
  modified_base (305)..(305): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacgtccctnagctctcctgtgcagcgtctggattcagtttcgctacacatggcatgcacgtcgggtcccnccagtcctccgaggcgaaggggctgcgaggtgggtgtccgtttatcgaagcgagtgggactcaatgaaactaatatgacagaccgtccggtaggaacgggccattcatcatcctccagacgaaccaacctaccaaacaacacacgtagactccacaaatcgaacacgccgtagacgacggtacgaacggtacgacggtaccgtaattacgttagttcgtacgtacccttagtactttacgtatagtaag

SEQ ID NO: 405519 - DNA, 539 bp, Homo sapiens
  misc_feature: GZ8MTXP02FLDPW.3.48.E04.1.454.CMB.2.raw
  modified_base (243)..(243): a, c, t, g, unknown or other
  modified_base (277)..(277): a, c, t, g, unknown or other
  modified_base (304)..(304): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtgggacgtccctnagactctcctgtgcagcgtctggattcagtttcnctacacatggcatgcactggggtcccnccaggtcctccgaggccgaaaggggctggctaggtcggggtggtcccgttttatcgaagcgtaagtgggactcaatgaaacatatgacagactcgtagaacgggccgtattcatctatcctaccagacaacaacctaccaacaacacactgaactccaccaaatacgaacacgacctagacgagtacgacggaacgacggctaatattatgtctaccgttgattactatagtaag

SEQ ID NO: 405520 - DNA, 489 bp, Homo sapiens
  misc_feature: GZ8MTXP02FY3BY.3.48.E04.1.454.CMB.2.raw
  modified_base (240)..(240): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctnagctctcctgtgcagcgtctggattcagtttcgctacacatggcatgcactgggtccgcagtctccaggcaaggggctgcagtggtgcgtttatcgaagcgatgggactcatgaacaatatgcagactccgtgaagggccgattcatcatctccagagacaactccaacaacacactgactctaccaaatcgaacagcctgagagtcgagacacggccgtatattatgtcgccttagattactatgtaa

SEQ ID NO: 405521 - DNA, 624 bp, Homo sapiens
  misc_feature: GZ8MTXP02IXZJT.3.48.E04.1.454.CMB.2.raw
  modified_base (242)..(242): a, c, t, g, unknown or other
  modified_base (303)..(303): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtgggagtccctnagactctcctgtgcagcgtctggattcagtttcgctacacatggcatgcacgtgggtcccnccagtcctccgaggcgaaggggctgcgtaggtggggtgtccgtttatcgaagcgagtcgggactcagtagaaactaatagtgacagaccgtccggtaggaacgggccgtattacactctactcctaccagaacaaaccaaacctaacccaaacctaaaccacctaactacgaactacctaacaaagtaacgaaacgacgtaccgtaggaacgacggtacggaacggaaaccgtaaccgggtaccgttaaagtttaacgtttacgtttaacggttaccgttaccctttacggtaactttaaacgttaagttaacggttaaag

SEQ ID NO: 405522 - DNA, 686 bp, Homo sapiens
  misc_feature: GZ8MTXP02G4JQP.3.48.E04.1.454.CMB.2.raw
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcagtcgccacgtcggtgggccgtcccagacgtcctcctccgtgtcgcgagtcgtcgtaggtacttcgttacgttccgactaaccacgtagtcggactagtcgacgtaccggtcggtcccgacgtacgtccgtaccggacggacggacgggtctcgacggtaggggttcggggtcgttacgtttacgtaacgacggtacgtaggtacgggtactacgtaagtaacgtaaaacgtagtagtacgaacgtaacgtacccgttaccggaacggggaaccgggtaccttaagtactactactaacgtccaaacgaagtaaacaaccctaaaccaaccgaaacaacacgtacgtacgtacctacctaaacaagtacgaacgacgaccgtagaacggtacgacgaaacggtaccgacggtacttaagttacgtaacgtttcggaccgttacctaagttacctaacgttggtaaag

SEQ ID NO: 405523 - DNA, 677 bp, Homo sapiens
  misc_feature: GZ8MTXP02FT2C2.3.48.E04.1.454.CMB.2.raw
  modified_base (314)..(314): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggacggtccctcagacctctcctgtgcagcgtctggattcgagtttcgctacacagtcggcatcgaccaccggtcgggcccnctacgtcctaccggaggacgggaacgggtctcggacgtaggggtggggtcggttaccgttttacgtacgggaagtcggtaacggtacgggtaccttgacgtaaacgaaaacgtaattacgtacgaaccgtaacgtaccgtacggtaacgggaacggggtaccctattaccgacgtactaactaccgtaccgaaacggaaccaaacctaaaccctaaaccaaaaccaaccaaccgtaacgacgtaacctacctaaactaaacgtacgaaacgacgtaccgtaggaacgtacggtacggaacggtacgaccggtacttaagttaacttagttcggtacctacgttagttacttacgtagtataag

SEQ ID NO: 405524 - DNA, 578 bp, Homo sapiens
  misc_feature: GZ8MTXP02H79HZ.3.48.E04.1.454.CMB.2.raw
  modified_base (242)..(242): a, c, t, g, unknown or other
  modified_base (301)..(301): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggagtccctnagctctcctgtgcagcgtctggattctagtttcgctacacatggcatgcacgtggtccnccagtcctccgaggcgaaggggctgcgtaggtggtggtcgttatcgaagcgagtggactcagtagaaactaatagtgacagaccgtcgtaggaacggtcgtactcgtatccacttaccaccgagaacgaaccaaacctacccaaaacaacacctactacggtaactacctaaccaaatacgaaacacgaccgtagaacgacgtacggacgaaccgacggtaccgtaattacgttaagttcgtacgtaccgttagtactttacgtaattaggtaaacg

SEQ ID NO: 405525 - DNA, 564 bp, Homo sapiens
  misc_feature: GZ8MTXP02I46RS.3.48.E04.1.454.CMB.2.raw
  modified_base (244)..(244): a, c, t, g, unknown or other
  modified_base (305)..(305): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtgggacggtccctnagctctcctgtcgcagcgtctggattcagtttcgctacacatggcatgcacgtcgggtccnccagtcctccgaggcgaaggggctcgcgtaggtggggtggtccgtttagtcgaagcgagtcgggactcagtagaaacatatgacagacgtcggtaggaacgggtcattcatacatctacgagacgaacaacctaccaaactaacacacgtagactactacaaatacgaacacgacgtagaacggacgtacggaacggtaaccgacggtaccgttaattacgtttagtcgttcgtacccttagtactttactatagtaac

SEQ ID NO: 405526 - DNA, 537 bp, Homo sapiens
  misc_feature: GZ8MTXP02FPUU7.3.48.E04.1.454.CMB.2.raw
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcggggggagcgtgacccagccgtgggacggtcccctcagactctcctgtgcagcgtctggattcagtttcgctacacatggcatgcacgtcgggtcccgccagtctccgaggcaaggggctggcaggtgggtggtccgtttagtcgaagcgatgggactcatgaaacatatgacagactccgtagaacgggccattcatcatctaccagacgacaactaccaacaacacactagactactacccaaatacgaaacaacgcctagacgagtacggacgacgacggccgtaatacttattgtacgtcccgttagtacttacgtatagtaa

SEQ ID NO: 405527 - DNA, 601 bp, Homo sapiens
  misc_feature: GZ8MTXP02HSTS9.3.48.E04.1.454.CMB.2.raw
  modified_base (303)..(303): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggacgtccctcagactctcctgtgcagcgtctggattcagtttcgctacacatggcatgcacgtgggtcccnccagtcctccgaggcgaaggggctgcaggtgggtggtccgtttagtcgaagcgatcggggactcgatagaaacaatagtgacaacggacctccggtaggaacggggtccgatttcatcctaacttccaccagacgaaccaaacctaccaaaccaaacactacgtagaactacctaaccaaaatcggaaaccacgtaccctaggaacggtacgtacggaacggaaccgtaccggggtaccttaaacgttaagtttacgttcgttacgtaccccgtttagaactttactaagttagtaag

SEQ ID NO: 405528 - DNA, 551 bp, Homo sapiens
  misc_feature: GZ8MTXP02JVYM2.3.48.E04.1.454.CMB.2.raw
  modified_base (241)..(241): a, c, t, g, unknown or other
  modified_base (302)..(302): a, c, t, g, unknown or other
  modified_base (382)..(382): a, c, t, g, unknown or other
  modified_base (486)..(486): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagtgaggtcgggggagcgtggcccagccgtgggagtccctnagactctcctgtgcagcgtctggattcagttcgctacacatggcatcgcacgtcgggtccncagtctcgaggcgaaggggctgcgtaggtgggtgtaccgtttagtcgaagcgagtcgggactcgaagtagaaactaatancgacaacgtactccggtaaggaacggggctaacttacatccaatcctaccgagaacgaaccaaacctaccaaacaacacacgtagactactaacaaatcgaacngcctagacgtagcgaacgacgacggactatattagtcgtcgtaccttagacttactagtactaag

SEQ ID NO: 405529 - DNA, 515 bp, Homo sapiens
  misc_feature: GZ8MTXP02FQCOB.3.48.E04.1.454.CMB.2.raw
  modified_base (177)..(177): a, c, t, g, unknown or other
  modified_base (242)..(242): a, c, t, g, unknown or other
  modified_base (303)..(303): a, c, t, g, unknown or other
  modified_base (366)..(366): a, c, t, g, unknown or other
  modified_base (387)..(387): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagnggtgtccactgtcagctgcttctagttgaggtcgggggagcgtggcccagcctgggacgtccctnagactctcctgtgcagcgtctggattcgagtttcgctacacatggcatgcacgtgggtccncagtctccgaggcaggggctgcagtggtgcctttatcgaagcgagtggactcgatgaaacatntgcagactcgtagaggcattnatcatctccagacgaacaactaccaaacaacacacgtgactactacaaatacgaacagcctagacgacgtacgaacggaccacggtaccgtactagttactgtacgtaccttagtacttactatgtaa

SEQ ID NO: 405530 - DNA, 547 bp, Homo sapiens
  misc_feature: GZ8MTXP02JIJKL.3.48.E04.1.454.CMB.2.raw
  modified_base (302)..(302): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggagtccctcagactctcctgtgcagcgtctggatcagtttcgctacacatggcatgcacgtgggtccncagtctccgaggcaaggggctgcgaggtgggtgtccgtttatcgaagcgagtcgggactcgatgaaactaatatgacagtacctccggtaggaacgggccgattcatcactctccagacgaaccaactaccaaacaaccacacgtacgactcctaacaaatcgaaacacgcctagacgaggtacggaacggaccgacggtaccgtaatacttagttcgtcgtacccttagtacttacgtatgtaa

SEQ ID NO: 405531 - DNA, 718 bp, Homo sapiens
  misc_feature: GZ8MTXP02H19W6.3.48.E04.1.454.CMB.2.raw
  modified_base (243)..(243): a, c, t, g, unknown or other
  modified_base (304)..(304): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgctcttttaagaggtgtccactgtcagctgcttctagttgaggtcgggggagcgtggcccagcctgggacgtccctnagctctcctgtgcagcgtctggattcagtttcgctacacagtggcatgcacgtgggtcccncagtcctaccgaggcgaaggggctggcgtagggtgggtggtccgtttagtacgaagcgagtgggactcaagtagaaacctaatagtcgactaaacggacccgtaccggtaggggaaaccggggtcccgtaacgtttacccgtaaacgttacctaacgttaccctaacccgacggtaaaccgaaacccctaaaaccccttaaaccccaaaaacccgtaaacccaaacccgtaaacccggttacgggtaaacttaaccccgtaaacctaaaacgtaaccgtaaaaccgaccggtacccgttaaaggaacggtaaccggtaccgggaaacggaaacccggtacgggttacccgttaagttaacgtttacgttaacggttacgtaccccgtttagtactttaaccgtagtttacgaag

SEQ ID NO: 405532 - DNA, 719 bp, Homo sapiens
  misc_feature: GZ8MTXP02JAWC3.3.48.E04.1.454.CMB.2.raw
  modified_base (240)..(240): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtgcccagcctgggagtccctnagctctctgtgcagcgtctggtattcagtttcgctacacagtggcagtgcacgtcgggtcccgccagtcctccgagggccgaaggggcctaggcgtagggtggggtggtaccgtttagtccggaagcgtagtcggggaacctcgaagtacggaaacctaagttagtacggaccgtaacggtacccgttaccggtaacggaaaccgggggacccttaacgtttacccgaacttaccgtaacttacccgttaacccgaacgaaccgtaaaccctaaaccccgttaacccaaaacctaaaccctaaccgaaccgttacggtaaccttacccgtaaaccctaaaacgtaacgaaaccgacgtacccgttaagggaacgtaacggtaccggaacggtaaacccgtaacgggtacccgttaaagtttacgtttaacgtttcgtacgttaccccgtttaggtaacctttaactacgttagtaaacg

SEQ ID NO: 405533 - DNA, 567 bp, Homo sapiens
  misc_feature: GZ8MTXP02F3JXL.3.48.E04.1.454.CMB.2.raw
  modified_base (244)..(244): a, c, t, g, unknown or other
  modified_base (305)..(305): a, c, t, g, unknown or other
  modified_base (382)..(382): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggacggtccctnagacctctcctgtgcagcgtctggattcagtttcgctacacatggcatgcacgtgggtccncagtcctccgaggcgaaggggctgcgtaggtgggtgtccgtttagtcgaagcgagtgggactcatagaaactatacngacagactcgtaggacggcctattcatcactctaccagacgaacaacctaccaacaacacactagactcctaacaaatacgaacacgaccgtagaacgtacggtcggaaacggaaccgaccgggtaccttaacgttatttaacgttcgttcgtacccgtttagtacctttactacgttacgtaag

SEQ ID NO: 405534 - DNA, 648 bp, Homo sapiens
  misc_feature: GZ8MTXP02FOV68.3.48.E04.1.454.CMB.2.raw
  modified_base (244)..(244): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacgtccctnagacctctcctgtgcagcgtctggattcagtttcgctacacatggcatgcacgtcgggtcccgcctagtcctccgaggcgaaggggctgcgaggtgggtcggtccgtttagtcgaagcgtagtgggacttcatacgaaactaatatcgacagtaccgtccgtaggaacgggtcccgtaattccaagtccacttacctaccgaacgtaacgaaacctaaaaccctaccaaaaccaaacctaaccaacgttacggaacttaccgtaaacctaaaacgtacggaaaccaacggtaccgtaggaacggacggtaacggaacggaaacccgaaccgggtaaccgttaaattaacgtttacgttcggtaccgttacccgtttaggtactttaaaccttagtacgttaaag

SEQ ID NO: 405535 - DNA, 586 bp, Homo sapiens
  misc_feature: GZ8MTXP02GL8HS.3.48.E04.1.454.CMB.2.raw
  modified_base (244)..(244): a, c, t, g, unknown or other
  modified_base (305)..(305): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgctcttttaagaggtgtccactgtcagctgcttctagttgaggtcgggggagcgtggcccagccgtgggacgtccctnagactctcctgtgcagcgtctggattcagtttcgctacacatggcatgcacgtgggtcccnccagtcctccgaggcgaaggggctgcaggtggggtggtcgtttagtcgaagcgtatgggactcgatagaaactaatatgcagactccgtaggaacgggaccgtattcgatacgacttcctaccgagtacgaaactaaaccctaccaaaacaaccactacgtagaactccgtaccaaaagtacgaacacgcctagaacgacgtacggaaacggtaccacgggtaccgttaatacgtttacgttcgttacgtacccgttacgtaacgttacttacgtagtaag

SEQ ID NO: 405536 - DNA, 578 bp, Homo sapiens
  misc_feature: GZ8MTXP02IJGAL.3.48.E04.1.454.CMB.2.raw
  modified_base (199)..(199): a, c, t, g, unknown or other
  modified_base (243)..(243): a, c, t, g, unknown or other
  modified_base (274)..(274): a, c, t, g, unknown or other
  modified_base (304)..(304): a, c, t, g, unknown or other
  modified_base (436)..(436): a, c, t, g, unknown or other
  modified_base (477)..(477): a, c, t, g, unknown or other
  modified_base (533)..(533): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttntagttgaggtcgggggagcgtggcccagccgtgggacgtccctnagctctctgtgcagcgtctggattcagttcnctacactatggcatcgcacgtcgggtcccncacgtcctaccgaggcgaaggggctgcgtaggtggggtgtaccgtttagtcgaagtcgtagtgggactgaagtacgaaactaatgtacgacacgtaccgtcggtaggaacggccgtatcatcactccacganacgaaccactaccaaacaacacacgtagactactaacaaanacaacgacgtactaaggacgacgtacggaacggtaaccgacggtaccttaacgttntttaacgtcggttacgtaccgttagtaactttaactagtagtaag

SEQ ID NO: 405537 - DNA, 558 bp, Homo sapiens
  misc_feature: GZ8MTXP02F02L1.3.48.E04.1.454.CMB.2.raw
  modified_base (245)..(245): a, c, t, g, unknown or other
  modified_base (303)..(303): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcgggggagcgtggcccagccgtgggacgtccctnagctctctgtgcagcgtctggattcagtttcgctacacatggcatgcacgtgggtccnccagtctccgaggcaaggggctgcaggtgggtgtccgtttagtcgaagcgagtcggactcgatagaaacaatatgacagactcgtagaacgggctattcatcatctacagacgaacaacctaccaaacaacacacgtagaactactaacgaatacgaacacgtaccgtagacgacgtacggaacggtaccgacggtaccgttaattagtttaacgtcgttcgttacccgttagtactttacgtacgttagtaacg

SEQ ID NO: 405538 - DNA, 541 bp, Homo sapiens
  misc_feature: GZ8MTXP02JFSR1.3.48.E04.1.454.CMB.2.raw
  modified_base (244)..(244): a, c, t, g, unknown or other
  modified_base (303)..(303): a, c, t, g, unknown or other
  modified_base (373)..(373): a, c, t, g, unknown or other
  modified_base (419)..(419): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacgtccctnagactctcctgtgcagcgtctggattcagtttcgctacacatggcatgcacgtggtccncagtctccaggcaggggctgcaggtgggtgccgtttatcgtaagcgatgggactcgatagaaacaatgtnacgagtactccgtaggaacgggccgtattcgatccatctaccaganaaccaactaccaacaacacacgtagactactaccaaatcgaaacacgtcctaggaacgtaggtcggaaacggacacggtaccgtaatagttagtgtcgtccttagtacttactagtgtaaag

SEQ ID NO: 405539 - DNA, 597 bp, Homo sapiens
  misc_feature: GZ8MTXP02GWZPU.3.48.E04.1.454.CMB.2.raw
  modified_base (244)..(244): a, c, t, g, unknown or other
  modified_base (304)..(304): a, c, t, g, unknown or other
  modified_base (360)..(360): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctggggacgtccctnagactctcctgtgcagcgtctggattcagtttcgctacacatggcatgcacgtgggtccncagtctccgaggcgaaggggctgcagtggggtgcgtttatcgaagcgatgggactnatgaaactaatactgacagaacctccgtagaaacgggccgtattccatcaactctaccgagacgaaccaaacaccaaaccaaacacaacaggaacttcgaaaccaaaataacgaaacgaacgtaccgtacgaacggaagtaccggaaggaacggaaccggtaacccggttaacgttaactttaacgtttaagttcggtaccccttacggtaacgtttaacttaacttacggttaaag

SEQ ID NO: 405540 - DNA, 639 bp, Homo sapiens
  misc_feature: GZ8MTXP02GO44Z.3.48.E04.1.454.CMB.2.raw
  modified_base (240)..(240): a, c, t, g, unknown or other
  modified_base (253)..(253): a, c, t, g, unknown or other
  modified_base (300)..(300): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggagtccctnagctctctgtgcngcgtctggattcagttcgctacacatggcatcgcacgtcgggtcccnccagtcctccgaggcgaaggggctggcgaggtgggtgtcgtttagtcgaagcgagtcgggactcagtacgaaactaatacgtcgacgaacgaaccgttccggtaaggtaaacggggacccgtaagttaccaactccgtaactccctaccgaaacgaaacgaaaccaaaccctaaccaaaacaaaccaacctaaccgttacggaaaccttacctaaccctaaaagtacgaaaccaacgtacccgtaaggacggaacggtaccgaacgggtaaccgaccggtaccgtaagttaacgtttaagttcgtacgttacccttagtaactttacgtattacgtaag

SEQ ID NO: 405541 - DNA, 575 bp, Homo sapiens
  misc_feature: GZ8MTXP02HMAOA.3.48.E04.1.454.CMB.2.raw
  modified_base (177)..(177): a, c, t, g, unknown or other
  modified_base (242)..(242): a, c, t, g, unknown or other
  modified_base (254)..(254): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagnggtgtccactgtcagctgcttctagttgaggtcgggggagcgtggcccagcctgggacgtccctnagctctcctgtncagcgtctggattctagtttcgctacacatggcatgccacgtcggtccgccagtctccgaggcgaaggggctgcaggtggtgtcgtttatcgagcgagtgggactcgaatgaaactaatagtcgacaacgactaccggtaggaaacgggccgtacgtactagtactataccgtaccacgtaacaaacctaaacctaccaaaacctaacaacctacgtacggtactacctaaccaaaagtacgaaaccacgctagacgacggtacgacggacgaccggtacgtatattacgtgtcgtacctttagactttactagtagtaag

SEQ ID NO: 405542 - DNA, 509 bp, Homo sapiens
  misc_feature: GZ8MTXP02FPJY2.3.48.E04.1.454.CMB.2.raw
  modified_base (243)..(243): a, c, t, g, unknown or other
  modified_base (303)..(303): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagcctgggacgtccctnagctctcctgtgcagcgtctggattcagtttcgctacacatggcatgcacgtgggtcccncagtctccgaggcaaggggctgcaggtgggtggccgtttatcgaagcgatgggactcatgaaacaatatgcagactcgtaggaacgggccattcatcatcctcagacaacaacctacaaacaacacactagactcaccaatagaacacgcctagacgagcgaacggacacggcctaatattatgtctccttagacttacatagtaa

SEQ ID NO: 405543 - DNA, 584 bp, Homo sapiens
  misc_feature: GZ8MTXP02HY88Q.3.48.E04.1.454.CMB.2.raw
  modified_base (243)..(243): a, c, t, g, unknown or other
  modified_base (381)..(381): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgctcttttaagaggtgtccactgtcagctgcttctagttgaggtcgggggagcgtggcccagcctgggacgtccctnagactctcctgtgcagcgtctggattcagtttcgctacacatggcatgcacgtggtcccgccagtctccaggcaaggggctggcaggtgggtggtccgtttatcgaagcgagtgggactcgatagaacatatcgacanacgtccgtaggaacggggccgattcgaatccaagtcctaccgagaacgaccaaacctacccaaacaaccacactacgactacctaacaaaactcgaaacacgtaccctagtaacgacggtaccggacggaaccggaccggtacccgtaagttaacgttacgtttcggtcgtaccgtttacgtaacgtttactacttaggtaag

SEQ ID NO: 405544 - DNA, 504 bp, Homo sapiens
  misc_feature: GZ8MTXP02FRHU8.3.48.E04.1.454.CMB.2.raw
  modified_base (200)..(200): a, c, t, g, unknown or other
  modified_base (241)..(241): a, c, t, g, unknown or other
  modified_base (301)..(301): a, c, t, g, unknown or other
  modified_base (362)..(362): a, c, t, g, unknown or other
  modified_base (384)..(384): a, c, t, g, unknown or other
  modified_base (475)..(475): a, c, t, g, unknown or other
  modified_base (484)..(484): a, c, t, g, unknown or other
  modified_base (501)..(501): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgctcttttaagaggtgtccactgtcagctgcttntagttgagtcgggggagcgtggcccagcctgggagtccctnagctctcctgtgcagcgtctggattcagtttcgctacacatggcatgcacgtgggtcccnccagtctccgaggccaaggggctgcgtaggtggggtgcctttagtcgaagcgatgggactnatgaaacatatgacagactcgngaaggtcattcatcatctacagacgacaactccaaacacacactagatcacgaatcgaatacgacgtagagagtacgagaccacgcctagnttactggtntccgtgtacttactagngta

SEQ ID NO: 405545 - DNA, 639 bp, Homo sapiens
  misc_feature: GZ8MTXP02HXC12.3.48.E04.1.454.CMB.2.raw
  modified_base (243)..(243): a, c, t, g, unknown or other
  modified_base (255)..(255): a, c, t, g, unknown or other
  modified_base (316)..(316): a, c, t, g, unknown or other
  modified_base (522)..(522): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcgggggagcgtggcccagcctgggacgtcccnagctctcctgtncagcgtctggattctagtttccgactacacagtcggcagtcgccgtacggttcgggtcccncctagtccgtaccgagggacgaaggggtctggcgtagggtggggtcgtccgtttagtcggaagtcggtaagtcgggactcgaagtagaaactaagtagtcgacaggacctaccggtaggaacggtccgtattactagtactactcctacacgaacaaccacctaaccaaacctaacacctacgtacgtaactacctaaacctaaanacgaaaccagtacccgtaaggacgacggtacggaaacggaccgtaaccggtacgttaacttacgtttacgttaacggttaccgttacccgttagttaactttacttaagtacgtaag

SEQ ID NO: 405546 - DNA, 540 bp, Homo sapiens
  misc_feature: GZ8MTXP02IUE0Y.3.48.E04.1.454.CMB.2.raw
  modified_base (245)..(245): a, c, t, g, unknown or other
  modified_base (303)..(303): a, c, t, g, unknown or other
  modified_base (405)..(405): a, c, t, g, unknown or other
  modified_base (410)..(410): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaaagaggtgtccactgtcagctgcttctagttgaggtcgggggagcgtggcccagccgtgggacgtccctnagctctcctgtgcagctctggattcagtttcgctacacatggcatgcacgtgggtccnccagtctccgaggcaaggggctgcgaggtggggtgtccgtttatcgaagcgatgggactcatgaaacatatgcagactcgtaggaaggccgattcatcatcncaganacaacctacaacaacacactagactctaccaaatacaacacgcgtagaggagtaccggacggaaccgacggtaccgtaattactttagttaacgtccggtaccctttagtacctttaactagtagtaaag

SEQ ID NO: 405547 - DNA, 609 bp, Homo sapiens
  misc_feature: GZ8MTXP02I380U.3.48.E04.1.454.CMB.2.raw
  modified_base (243)..(243): a, c, t, g, unknown or other
  modified_base (391)..(391): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtgggacgtccctnagactctcctgtgcagcgtctggattcagtttcgctacacatggcatgcacgtcgggtcccgccagtcctccgaggccgaaggggcttggcgaggtggggtcggtccgtttagtcggaagcgtagtggggactcgatagaaactaatntgactagactcggtaggaacgggccgtattcgatccgtatcctaccgagtacgaaacctaacctacccaaaccaaccaaccgtacgtacgtaactacctaaccgaaatacgaacctaacgaccctaggaacggacggtaaccggaacgggaaccgaacgggtaccgttaattactttaagttcgtaccgttaccttaggtactttaacgtatagtaag

SEQ ID NO: 405548 - DNA, 528 bp, Homo sapiens
  misc_feature: GZ8MTXP02IYMEK.3.48.E04.1.454.CMB.2.raw
  modified_base (242)..(242): a, c, t, g, unknown or other
  modified_base (384)..(384): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtgggagtccctnagctctcctgtgcagcgtctggattcagtttcgctacacatggcatgcacgtcggggtcccgcctagtcctccaggccaagggggtcctaggcaggtggggtgtcgttttatcgaagcgtagtcgggactcgatgaaacatntgacagtactcggtagaagggccgtattcatcatctaccagagaacaactccaaacacacactacgatactacaatacgaacacgactgaacgcgtacgacgacgacggtctaatacttagtgtcgccttgacttactatgtaa

SEQ ID NO: 405549 - DNA, 533 bp, Homo sapiens
  misc_feature: GZ8MTXP02JAYDJ.3.48.E04.1.454.CMB.2.raw
  modified_base (245)..(245): a, c, t, g, unknown or other
  modified_base (529)..(529): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttggaggtcgggggagcgtggcccagccgtgggacgtccctnagctctcctgtgcagcgtctggattcagtttcgctacacatggcatgcacgtcgggtccgccacgtcctccgaggccgaaggggctggcgaggtggggtggtcccgtttagtacgaagcgagtcggggactcgatgaaacatatgacagtactccgtaggacgggcatcatcatctacagacacaactaccaacaacacactagactacacaaatacgaacacgactacgacgagtagaacgacgaccggactactagttactgtacgtccttagtactactangtaa

SEQ ID NO: 405550 - DNA, 594 bp, Homo sapiens
  misc_feature: GZ8MTXP02FYQMX.3.48.E04.1.454.CMB.2.raw
  modified_base (243)..(243): a, c, t, g, unknown or other
  modified_base (314)..(314): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttaaggtcgggggagcgtggcccagccgtgggagtcccctnagctctcctgtgcagcgtctggattcagtttcgctacacatggccatgcacgtgggtcccgcagtctccgnggcaaggggctggcaggtggggtgcgttttagtcgaagcgtatcggggacttcgatgaaacgatagtgcaagtacctccgtagaacggggcctagttccatacgattcctacagacgaccaactaccaaacaacacgactaggactacctaccaaagtcgaaacgacgtaccgtagaggtacggtacggaacggaaccacgggtaccgttaagttaacgtttagttacggttaacggtacccctttaaggtactttaaccgttagtaacggtattaaacg

SEQ ID NO: 405551 - DNA, 583 bp, Homo sapiens
  misc_feature: GZ8MTXP02G626O.3.48.E04.1.454.CMB.2.raw
  modified_base (241)..(241): a, c, t, g, unknown or other
  modified_base (302)..(302): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagcctgggagtccctnagactctcctgtgcagcgtctggattcagtttcgctacacatggcatgcacgtcgggtccnccagtcctccgaggcgaaggggctgcgaggtcgggtggtccgtttatcgaagcgagtcggggactcatagaaactaatatgacagactccgtagaacggcgattcatcatctacagacaacaacacaaacaacacacgtagactactaccaaaatcgaaacgacgaccgtaggaacgtaacggtaccggaaacggaacccgaaccgggtacccgttaaaattaacgtttaagtcggttacctacccgtttacgtaagtttaaccgtaacttacggtaaacg

SEQ ID NO: 405552 - DNA, 552 bp, Homo sapiens
  misc_feature: GZ8MTXP02JPV55.3.48.E04.1.454.CMB.2.raw
  modified_base (244)..(244): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccaggcctgggagtcccctnagactctcctgtgcagcgtctggattcagtttcgctacacatggcatgccacgtcgggtcccgccagtcctccgaggacgaaggggctggcgaggtggggtgtccgtttagtcgaagcgagtggactgagtgaaacaatatgacagtaccgtcgtaggaggccgtattcatcatccgcagaacgaccaactaccaaacacacactagactacaacaaatcgaaccacgactagaacgagtacgaacggtaccgacggtaccgtaacttattagtgttcgtacccgttatacgttactaagtacgtaag

SEQ ID NO: 405553 - DNA, 594 bp, Homo sapiens
  misc_feature: GZ8MTXP02I6MLI.3.48.E04.1.454.CMB.2.raw
  modified_base (259)..(259): a, c, t, g, unknown or other
  modified_base (308)..(308): a, c, t, g, unknown or other
  modified_base (354)..(354): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagttgggctgtagttgggttttcctcgttgcttcttttaagaggtgtccactgtcagctgcttctagttggaggtcgggggagcgtggcccagccgtgggacgtccctgagacctctcctgtncagcgtctggattctagtttcgctacacagtgcatgcacgtcgggtccnccagtcctcgaggcgaggggctggcgtaggtgggtccgtgttttanacgaagtcgagtcgggactgactaggaaactaatagtcgacgacgtaccgtcggtacggaaacgggcctagttacatccaacttccgacacgagaaaccaaccctaaccaaacctaaacaaccactaacgacttaccgaactaaagtacaaacacgctacggaagtacgacggaacggaccgacggtacctaatacgtttactaacggtcctaaccgttcgaatttacgtaagtcttaag

SEQ ID NO: 405554 - DNA, 538 bp, Homo sapiens
  misc_feature: GZ8MTXP02HNT03.3.48.E04.1.454.CMB.2.raw
  modified_base (244)..(244): a, c, t, g, unknown or other
  modified_base (255)..(255): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgctcttttaagaggtgtccactgtcagctgctttctagttgaggtcgggggagcgtggcccagcctgggacgtccctnagctctcctgngcagcgtctggattcagtttcgctacacatggcatgcacgtcgggtccgccagtctccgaggcaaggggctgcaggtggtggtcgtttatcgagcgagtcggactcatagaaacatatgcagactcgagaacggtcgattcgatcatctccagacgacaactaccaacaacacactagatacctacaaatcgaaacacgacctaggaacgacgtacggaacggaaccgacggtaccgtattacgttattcgttcgtaccgttacgtacttactagttagtaag

SEQ ID NO: 405555 - DNA, 697 bp, Homo sapiens
  misc_feature: GZ8MTXP02H8CRU.3.48.E04.1.454.CMB.2.raw
  modified_base (252)..(252): a, c, t, g, unknown or other
  modified_base (276)..(276): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttggttttcctcgttgctcttttaagaggtgtccactgtcagctgcttctagtgagtcgggggagcgtggccagcctgggacgtcctcagactctcctgtgcngcgtctggtattctagttcgctanacacgtggacatgaccgtacgttcgggccccaccgtagtcctacccgagggaccgaacggggtctggacgtaggtggggtcgtccgtttagtccggaagtcgtagtggactcgagtacgaactaaagtactggaacctagtacccgtaccgacggtaaacggggccctaatttccaactccaacgttaccgacccgaggtaaaccaaacctaaaccctaaacccaaaacgaacctaaacctacgtacggtaacctaacccgtaaaccgtaaaactaacggtaaaccaacgtacccggtaaggaaacgggacggtaaaccgggaaccggtaaacggaaacccgggttaccgtaaagttttaaacgttcgtttaaccgcggttaacccctttaggtaaactttaacttaagtttacggtaaag

SEQ ID NO: 405556 - DNA, 571 bp, Homo sapiens
  misc_feature: GZ8MTXP02JB3NW.3.48.E04.1.454.CMB.2.raw
  modified_base (243)..(243): a, c, t, g, unknown or other
  modified_base (256)..(256): a, c, t, g, unknown or other
  modified_base (286)..(286): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacgtcctnagactctcctgtncgagcgtctggtattctagttcgctacacngtggcagtgcacgtcgggtccgccgtagtcctccgaggaccgaaggggctggcgtagggtggggtcggtacgtttagtcgaagcgtagtggactcgatagaaacatagtgacagactcggtagacggcgatcatcactcacgagacaactaaccacaaacacacacgtacgactacctaacaaatacgaacacgtcgtaacaacggacgtaggaacggaaacgaccggtactaacgttacttacgtcggtacgtacccgtttagaacttacgttagtacgtaaag

SEQ ID NO: 405557 - DNA, 787 bp, Homo sapiens
  misc_feature: GZ8MTXP02G0FVE.3.48.E04.1.454.CMB.2.raw
  modified_base (198)..(198): a, c, t, g, unknown or other
  modified_base (240)..(240): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttggctgagttgggttttcctcgttgcttcttttaagaggtgtccatgtcagctgcttntagtggaggtcgggggagcgtggccagccgtgggacgtcctnagactctctgtgcagcgtctggtacttcgtagtttcgactacacagtcggcagtcgacctacggtcgggtcccgcctacgtcctcgacggcgaacggggctcggacgtagggtggggtggtacccgtttagtaccggtaagcggtaagtcggggactcgaagttacggaaactatagtacgactaacggtaccgttaccggtaaggggaacgggtacccggttagtttacccgtaacgttcccgtaaacttaccccgtaaccgggtaaacgtaaacccggtaaaaccccaaaaccccgttaaaccccgaaaaaacccctaaaccgaaacccgttaaaccggttaaacgggttaaacccttaacccttaaaacccgtaaaacgttaaccggaaacccgaaacgtacccgttaagggaaacggtaacggaaccggggttaaaccggaaacggtaaacccggtacccggtttaaaattaacgttttaacgttccggttaaccgttacccgtttaaaggttaactttaaccgttacgttaacgttaaacgg

SEQ ID NO: 405558 - DNA, 575 bp, Homo sapiens
  misc_feature: GZ8MTXP02JUVGU.3.48.E04.1.454.CMB.2.raw
  modified_base (244)..(244): a, c, t, g, unknown or other
  modified_base (278)..(278): a, c, t, g, unknown or other
  modified_base (306)..(306): a, c, t, g, unknown or other
  modified_base (385)..(385): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagttcgggctgagttgggttttcctcgttgctcttttaagaggtgtccactgtcagctgcttctagttgaggtcgggggagcgtggcccagccgtgggacggtccctnagactctcctgtgcagcgtctggattcagtttcnctacacatggcatgcacgtcgggtcccncagtcctccgaggcgaaggggctggcgtaggtggggtgtccgtttagtcgaagtcgagtgggactcaagtgaaacaatntcgacagaccgtcgaggaacggcctattcatcatctacgagacgaaccaacctaccaaacaacacacgtagactaccaaccaaatacgaacacgaccgtagagtacggtacggacggaaccgtaccgggtacctaacttaagtttacgttcggtacccgttaccgttagtactttaacgtagttagtaag

SEQ ID NO: 405559 - DNA, 568 bp, Homo sapiens
  misc_feature: GZ8MTXP02F3OLH.3.48.E04.1.454.CMB.2.raw
  modified_base (241)..(241): a, c, t, g, unknown or other
  modified_base (304)..(304): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctggggagtccctnagactctcctgtgcagcgtctggattcagtttcgctacacagtggcatgcacgtcgggtcccnccacgtcctccgaggcgaaaggggctgacgaggtggggtgtccgtttagtcgaagcgtagtggactcatacgaaacaatagtgcagactccgtaggaagggccgattcagtcactctcagagaacaactaccaaacaacacactagactactaccaaaatacgaaacgaacgaccgtagaacgacggtacgacgggaaccgaccggtaccgttaaattacgtttagttaacgtcgtacccgttaagtacttaactagtacgtaa

SEQ ID NO: 405560 - DNA, 603 bp, Homo sapiens
  misc_feature: GZ8MTXP02HXZRT.3.48.E04.1.454.CMB.2.raw
  modified_base (241)..(241): a, c, t, g, unknown or other
  modified_base (276)..(276): a, c, t, g, unknown or other
  modified_base (300)..(300): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttggctgagtttgggttttcctcgttgctcttttaagaggtgtccatgtcagctgcttctagttgaggtcgggggagcgtggcccagccgtgggagtccctnagactctcctgtgcagcgtctggattctagtttcnctacacatggcatgcacgtggccncagtctcgaggcaaggggctgcgaggtgggtgtcgtttagtacgaagcgtatcgggactcatagaaactatagtgactaacgacctaccggtaggaacgggccgtaatttaccacgttaccattacctaccaaggaactaaacctaacctaaacccaaaacctaaaccgaaccctaacttacgggaaactaccttaacccaaaagtacgaaaccgacgaccgtagaacgagtacggaacggacgacggtaccgtaattacgttacgttcgtacgtaccctttagtaactttacttatagtaag

SEQ ID NO: 405561 - DNA, 582 bp, Homo sapiens
  misc_feature: GZ8MTXP02HBWPW.3.48.E04.1.454.CMB.2.raw
  modified_base (243)..(243): a, c, t, g, unknown or other
  modified_base (306)..(306): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgagtcgggggagcgtggcccagccgtgggacgtccctnagcctctcctgtgcagcgtctggattcagtttcgctacacagtggcatgcacgtcgggtcccnccagtcctaccgaggccgaaggggctggcgtaggtggggtggtccgttttagtcgaagcgagtgggactcgatagaaactatatgacagtaccgtcgaggaacggccgtattcatcactcctacgagacgaaccaacctaccaaacaacactacgtacgactacctacaaatacgaacacgtacctaggaacgacgtacggacggaaccgacggtaccgtaagttaactttacgttcgtccgttaccgtttagtaacgtttacctagtacgtaacg

SEQ ID NO: 405562 - DNA, 525 bp, Homo sapiens
  misc_feature: GZ8MTXP02FOM1B.3.48.E04.1.454.CMB.2.raw
  modified_base (177)..(177): a, c, t, g, unknown or other
  modified_base (240)..(240): a, c, t, g, unknown or other
  modified_base (301)..(301): a, c, t, g, unknown or other
  modified_base (393)..(393): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagnggtgtccactgtcagctgcttctagttgagtcgggggagcgtggcccagcctgggagtccctnagactctcctgtgcagcgtctggattcagtttcgctacacatggcatgcacgtgggtcccncagtctccgaggcaaggggctggcaggtggggtgcccgtttatcgaagcgagtgggactcatgaaacatatgacagactcgagaggcatcancatctcagacgacaactccaacacacactgactctaccaaatcgaacacgcctagaacgacgtacgaacggtacacgggtaccttaagtatttaacgtgttactacccgttagtactttactagtacgtaag

SEQ ID NO: 405563 - DNA, 636 bp, Homo sapiens
  misc_feature: GZ8MTXP02HXZ0V.3.48.E04.1.454.CMB.2.raw
  modified_base (177)..(177): a, c, t, g, unknown or other
  modified_base (243)..(243): a, c, t, g, unknown or other
  modified_base (276)..(276): a, c, t, g, unknown or other
  modified_base (280)..(280): a, c, t, g, unknown or other
  modified_base (298)..(298): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagnggtgtccactgtcagctgcttctagttgaggtcgggggagcgtcggccaggcctgggacgtccctnagactctcctgtgcagcgtctggattcagttcnctancatgcatgcagtcggccncagtctcgaggcgaggggctgcgtaggtggtgtccgtttatacgagcgtagtcggactcgagtagaaactagtatacggactacgtaccgttaccggagggaaaccgggtcctaagttacctaactacgtacttacccgaacgaacgaaccgaaacctaaaccctaaaccaaaaccctaaaccgacctaacgtaccggtaaactacccgtaaacgtaaacgtaacgaaccgtaacgccgtaaggtaacgacggtaacggaaacggacccgtaacggtaccgtttaaattcgtttaacgtcgttcccgtacttacgttaactttaacgtagtacgtaag

SEQ ID NO: 405564 - DNA, 508 bp, Homo sapiens
  misc_feature: GZ8MTXP02FPQ84.3.48.E04.1.454.CMB.2.raw
  modified_base (242)..(242): a, c, t, g, unknown or other
  modified_base (332)..(332): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaaagaggtgtccactgtcagctgcttctagttgaggtcgggggagcgtggcccagcctgggagtccctnagactctcctgtgcagcgtctggattcagtttcgctacacatggcatgcacgtgggtccgccagtctccaggcaaggggctgcagtgggngccgtttatcgaagcgatggactcatgaaacaatatgcagactccgtaggaagggccgattcatcaatctccagacgaacaactaccaaacaacacactagactctacaaatgaacacgctagagagtcgagacacggaccgtatattatgtcgtaccttagacttactatagtaa

SEQ ID NO: 405565 - DNA, 573 bp, Homo sapiens
  misc_feature: GZ8MTXP02F8TKJ.3.48.E04.1.454.CMB.2.raw
  modified_base (240)..(240): a, c, t, g, unknown or other
  modified_base (307)..(307): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagttgggctgagttgggttttcctcgttgctcttttaagaggtgtccactgtcagctgcttctagttgagtcgggggagcgtggcccagcctgggacgtccctnagactctcctgtgcagcgtctggacttcagtttcgctacacagtggctatgctacgtcggggtcccncctagtctccgaggcgaaggggctcggcgaggtgggtggtccgtttagttcgaagcgtagtcgggactcgataggaaactaatatcgactagacgtccgtaggaacgggccgtaattaccgactactaacgtccctacaagacgaaacctaaacctaccaaacaaacacacgtacgaactacctaacaaatacgaacacgccgtagacgagtacggacgtacgacggtactatattagtgtcgtaccttagtacttacgtatagta

SEQ ID NO: 405566 - DNA, 563 bp, Homo sapiens
  misc_feature: GZ8MTXP02IESP6.3.48.E04.1.454.CMB.2.raw
  modified_base (169)..(169): a, c, t, g, unknown or other
  modified_base (177)..(177): a, c, t, g, unknown or other
  modified_base (245)..(245): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctnttttaagnggtgtccactgtcagctgcttctagttggaggtcggggggagcgtggcccagccgtgggacgtccctnagactctcctgtcgcagcgtctggattctagtttcgctacacatggcatgcacgtcggtcccgcctagtcctccgaggcgaggggctggcgtaggtggggtgtccgtttagtgaagcgagtggactgatagaaactaatatcgacacgtacgtcggaggaacggcgtattcatctactcgacagaacacaacctacaacaacacacacgactaccacgtaaacacgaacgacgacgtagaacgtacgacggaacggaccgaacggtaccgttaattagtttacgttcgtaccgttactttacgatttactagtagtaa

SEQ ID NO: 405567 - DNA, 583 bp, Homo sapiens
  misc_feature: GZ8MTXP02IPD8G.3.48.E04.1.454.CMB.2.raw
  modified_base (243)..(243): a, c, t, g, unknown or other
  modified_base (385)..(385): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtgggagtcccctnagacctctcctgtgcagtcgtctggtattcgtagtttcgactacacagtggcatcgcacgtcggtccgccagtcctccgaggccgaggggctgcgtaggtggtcgtcgtttagtcgagcgtatgggactcatacgaaacatntgcaacgtactcgtaggacggctatacatcactctacgagacgaaccaacctaccaaactaaccacacgtacgactaccgtaaccaaatacgaacacgaccgtaggtaacggacgtacggaacggtaaccgacggtaaccgttattaagtttacgttcgttacgttacccgtttagtaactttacgttacgtagtaag

SEQ ID NO: 405568 - DNA, 591 bp, Homo sapiens
  misc_feature: GZ8MTXP02F01GS.3.48.E04.1.454.CMB.2.raw
  modified_base (201)..(201): a, c, t, g, unknown or other
  modified_base (245)..(245): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttntagttgaggtcgggggagcgtggcccagccgtgggacgtccctnagcctctcctgtgcagcgtctggattcagtttcgctacacagtggcatgcacgtgggtcccgccagtcctccgaggcgaaggggctgcgaggtggggtgtcgtttagtcgaagcgagtgggactcgatagaaactaatagtgacaagtacctcggtaggaacggccgtattacgatccaactcctaccaagacgaaacctaaacctacaaaaccaacaacacgtagactactaaccaaatacgaacacgaccgtagaacgtacggtacggaacggaaccgaacgggtaccgttaataacgtttaagttcgtacgtacccgtttagtaacttactaagtacgtaaag

SEQ ID NO: 405569 - DNA, 625 bp, Homo sapiens
  misc_feature: GZ8MTXP02JDXVQ.3.48.E04.1.454.CMB.2.raw
  modified_base (243)..(243): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgaggtcgggggagcgtggcccagccgtgggacgtccctnagactctcctgtgcagcgtctggatcagtttcgctacacatggcatgcacgtcgggtcccgcctagtcctcgaggacgacggggctggcaggtgggtgtccgtttagtcgaagcgagtggactgatagaaactatactgacaacgacgtccgtaggaacgggccgtattacgactaccaatcctaccgtacgacgaaacctaaacctaccaaaaccaaccaactacgtaggaacctccgtaacctaaagtacgaaacctagacctaggacggaacggtacggaaccgggaccggtaaaccgggtacccgttaaagtttaacgtttaacgttcggttacccgttaccccgtttaggtaactttaacgttacgtacggttaacg

SEQ ID NO: 405570 - DNA, 575 bp, Homo sapiens
  misc_feature: GZ8MTXP02IBFIX.3.48.E04.1.454.CMB.2.raw
  modified_base (245)..(245): a, c, t, g, unknown or other
  modified_base (307)..(307): a, c, t, g, unknown or other
  modified_base (372)..(372): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctctttttaagaggtgtccatgtcagctgcttctagttgaggtcggggggagcgtggcccagcctggggaggtcccctnagactctcctgtcgcagcgtctggattcagtttccgctacacatggcatgcacgtgggtccnccagtctccgaggcgaaggggctgcgtaggtggggtggtccgtttagtcgaagcgatggggactnactgaacaatatcgacacgaccgtccggagtaaacggggccgtaatccaatctaactcgtacccagacgaaccaaacctaccaaacaaaccacacttacggactacctaaccaaatacgaaacacgtacctagacgaacgacgaacggacgacggtaccgtattaattattcggtctacccgttagtacttacttatagtaag

SEQ ID NO: 405571 - DNA, 592 bp, Homo sapiens
  misc_feature: GZ8MTXP02HTKV7.3.48.E04.1.454.CMB.2.raw
  modified_base (241)..(241): a, c, t, g, unknown or other
  modified_base (307)..(307): a, c, t, g, unknown or other
  modified_base (387)..(387): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgctcttttaagaggtgtccactgtcagctgcttctagttgagtcgggggagcgtggcccagcctgggacgtccctnagactctcctgtgcagcgtctggtattcgtagtttccgctacacatggctatgctacgtgggcccncagtctccgaggcgaggggctgcgaggtgggtgtccgtttagtccgaagcgagtcgggactcgaatagaaactaattagngacgtagaccgttccggaggtaacgggacctattacgatcctaatccgtacgagaacgaaacctaaacctaccaaaacaacctaactaacgtacggtaactacctaaaccgaaatacgaaacacgaccgtaggaacgtacggtacgaacggtacgaacggtaccgtattaattgtaacgtctaccgttagatttacagttagtaa

SEQ ID NO: 405572 - DNA, 647 bp, Homo sapiens
  misc_feature: GZ8MTXP02HTTJB.3.48.E04.1.454.CMB.2.raw
tcagagacgcactccacgaccggtgctcgatttagagagcgtcacagagagaaggggctgggagaggagcccagcactagaagtcggcggtgttccattcggtgatcagcactgaacacagaggactcaccatggagtttgggctgagttgggttttcctcgttgctcttttaagaggtgtccactgtcagctgcttctagttgaggtcggggggagcgtggcccagcctggggacggtccctcagacctctcctgtgcagcgtctggattcagttcgctacacatggcagtcgacacgttcgggcccgcctacgtcctccgagggacgaaaggggtctggcgtaaggggttggggtacgggttaccgttttagttaccgggaacgccggtaagtcggggtactccgaagtacggtaaactaaagttaagtcgacgtacggaccgttaccggtaaggacgggtacccgtattcctatcctattcccacgtacggaacacccaaactaccaaaacaacacacgtacgtactacctaaccgaaatacgaaacacgaccgtaggacgtacggtaccgggaacgaccggtaacggaccgttatacgttagttaaccgtcgtacccgtttagtaacctacgttagttcgtaa

SEQ ID NO: 405573 - DNA, 663 bp, Homo sapiens
  misc_feature: GZ8MTXP02JGC0J.3.48.E04.1.454.CMB.2.raw
  modified_base (249)..(249): a, c, t, g, unknown or other
  modified_base (317)..(317): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcggggggagcgtcggcccaggccgtggggacggtccctnagacctctcctgtgcagcgtctggtattctagtttcgctacactatggctagtgcacgttcgggcccnctagtctaccgaggcgaggggctgcgtaggtggggtgtccgtttagtacgagtcgagtcgggactcgatagaaactatgtcgacagtaccgtacggtagaacgggtccgtatacgtactacctaactacctaccgaacgtacgtaaaccaaaccgtaaccaaaccaacaaccgtacgtaccgtaactaaccgtaacctaaaagtacgaaaccgtacgacccgttaaggaacggtacggtaaccggaaaccgggtaaccgtaaaccgggttacccgttaaagttaacgtttaacgttccggttacgttaaccccgtttaggtaactttaacgtagttacggttaaag

SEQ ID NO: 405574 - DNA, 629 bp, Homo sapiens
  misc_feature: GZ8MTXP02F3D54.3.48.E04.1.454.CMB.2.raw
  modified_base (244)..(244): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagttgggttttcctcgttgcttcttttaagaggtgtccactgtcagctgcttctagttgaggtcgggggagcgtggcccagccgtgggacgtccctnagactctcctgtgcagcgtctggattcagtttcgctacacatggcatgcacgtcggtcccgccagtcctccgaggcgaagggctgacgagtgggtggtcgtttatcgaagcgagtgggactcatagaaacgtaatatcgacagacgttaccggtaggaacggggccctaagtttcaaactcaacttcccgtaccaaagacgaaccaaaaccctacccaaaaccaaccaacctaacgtacgaacctactaaccaaacttacgaaaccaccgtaccgtacggaaacgacggttaaccggaacgggaccgaaacggggtaccttaacgttaagtttacgttaaggtccgttacccttaggtaacttttaaccgtagtacggttaaacg

SEQ ID NO: 405575 - DNA, 572 bp, Homo sapiens
  misc_feature: GZ8MTXP02F5SST.3.48.E04.1.454.CMB.2.raw
  modified_base (246)..(246): a, c, t, g, unknown or other
  modified_base (307)..(307): a, c, t, g, unknown or other
  modified_base (370)..(370): a, c, t, g, unknown or other
  modified_base (393)..(393): a, c, t, g, unknown or other
  modified_base (399)..(399): a, c, t, g, unknown or other
tcagagacgcactccacgaccggtgctcgatttagagagcgtcacagagagaaggggctgggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttgaggtcggggggagcgtggcccagccgtgggacgtccctnagactctcctgtgcagcgtctggattcagtttcgctacacatggcatgcacgtgggtcccnccagtcctcaggcaaggggctgcaggtggtgcgttatcgaagcgagtggactgatgaaacatngacagactcgtagacggcatcancagtcncagacaacaactaccaaacaacacgactgaactacctaaccaaagtacgaaacgacgcccgtaaggtacgaacggttacggaaacgggaccgtaaccgggtaccgtttaaattaacgtttacgtttaacggtaccgttacccgttaaggttaactttaagtaactaggttaaa

SEQ ID NO: 405576 - DNA, 602 bp, Homo sapiens
  misc_feature: GZ8MTXP02FL0ZV.3.48.E04.1.454.CMB.2.raw
  modified_base (248)..(248): a, c, t, g, unknown or other
  modified_base (308)..(308): a, c, t, g, unknown or other
  modified_base (386)..(386): a, c, t, g, unknown or other
tcagagacgcactccacgaccggtgctcgatttagagagcgtcacagagagaagggggctggggagaggagcccagcactagaagtcggcggtgtttccattcggtgatcagcactgaacacagaggactcaccatggagtttgggctgagtttgggttttcctcgttgcttcttttaagaggtgtccactgtcagctgcttctagttggaggtcgggggagcgtggcccagccgtgggacgtccctnagactctcctgtcgcagctctggattcagtttcgctacacatggcatgcacgtcggtccncagtctaccaggcgaaggggctgcgagtgggtgtccgtttatcgaagcgagtcgggactcaatacgaaactaagttancgacagtaccgtacccgtagggaacggggacctaagttcagtccctaatcctaccgaagtaactaaccaaacctaccaaacaacacctacgtaggaacctacctaaccgaaatacaaacgtacgaccgtagaacggtacgtaccggaaacgaaccgaacggtacgttaagttacttagttaacggtctacccttagaactttacgtatacgtaaag

SEQ ID NO: 405577 - DNA, 425 bp, Homo sapiens
  misc_feature: GZ8MTXP01D2M4B.9.11.A11.1.454.CMB.2.raw
  modified_base (241)..(241): a, c, t, g, unknown or other
  modified_base (415)..(415): a, c, t, g, unknown or other
  modified_base (418)..(418): a, c, t, g, unknown or other
  modified_base (420)..(425): a, c, t, g, unknown or other
tcagtgatacgtctcacgaccggtgctcgatttagctacgactgcaggggagagagccaccctctcttgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggancctgaagtattttgctagtttatactgtcagcagtatggtagctcaccgtactacgttttggccgaggggaccaaggctggagatacaaacgaactgtcgctgcaccatctgtctcatccttcccgcctatctagaacgtacgtaatcactggagcgggctgggacaaggcganatngnnnnnn

SEQ ID NO: 405578 - DNA, 415 bp, Homo sapiens
  misc_feature: GZ8MTXP01E0A75.9.11.A11.1.454.CMB.2.raw
  modified_base (410)..(415): a, c, t, g, unknown or other
tcagtgatacgtctcacgaccggtgctcgatttagctacgactgcaggggagagagccaccctctcttgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggagcctgaagatttgcagtttatactgtcagcagtatggtagctcaccgtacacttttggcctaggggaccaagctggagatcaaacgaactgtcggctgcaccatctgtcttcatccttccccgcctatctgaagacgtatcactgagcgggctgggcaaggcgcataggnnnnnn

SEQ ID NO: 405579 - DNA, 507 bp, Homo sapiens
  misc_feature: GZ8MTXP01DKY5U.9.11.A11.1.454.CMB.2.raw
  modified_base (217)..(217): a, c, t, g, unknown or other
  modified_base (236)..(236): a, c, t, g, unknown or other
  modified_base (245)..(245): a, c, t, g, unknown or other
  modified_base (278)..(278): a, c, t, g, unknown or other
  modified_base (486)..(486): a, c, t, g, unknown or other
  modified_base (489)..(507): a, c, t, g, unknown or other
tcagtgatacgtctcacgaccggtgctcgatttagctacgactgcagggaagggcctggagtacattggggacatctatgccactgggagcaccgactacaacccgtccctcgagagtcgactctccatgtcccttgacacgtctaagaaccagtattccctgcaactgagctccgtgactgccgctgacacggtcctttattactgtgccataacngcctgtattacactagttnctatcatcngacgtccggacagctacttgtctccgtgggccngggttaaccctggtccaccgtctcctcacgccctccaccgaacgggccccagtcggtcccctttcccccgtggccacccctccctaccaacgacgcctacctcggtcgggggcaacgacggccggcccgtggggcctcgtccgtggtacgaaacggacttaccttccgagacgtatcaacgtgacggcgggcaggcaaggccgaaganagnnnnnnnnnnnnnnnnnnn

SEQ ID NO: 405580 - DNA, 436 bp, Homo sapiens
  misc_feature: GZ8MTXP01AJQHU.9.11.A11.1.454.CMB.2.raw
  modified_base (241)..(241): a, c, t, g, unknown or other
  modified_base (424)..(424): a, c, t, g, unknown or other
  modified_base (426)..(436): a, c, t, g, unknown or other
tcagtgatacgtctcacgaccggtgctcgatttagctacgactgcaggggagagagccaccctctcttgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggancctagaagtatttgctagtttatactgtcagcagtagtggtagctcaccgtactacttttggccgaggggaccaagcgtggagatacaaacgactgtcggctgacacctatctgtcttcacttccttccccgctatctagacgtacgtactcacgtgacgcgggctgggcaaggcgacatagngnnnnnnnnnnn

SEQ ID NO: 405581 - DNA, 414 bp, Homo sapiens
  misc_feature: GZ8MTXP01ENBT4.9.11.A11.1.454.CMB.2.raw
  modified_base (242)..(242): a, c, t, g, unknown or other
  modified_base (370)..(370): a, c, t, g, unknown or other
  modified_base (375)..(375): a, c, t, g, unknown or other
  modified_base (403)..(403): a, c, t, g, unknown or other
  modified_base (405)..(414): a, c, t, g, unknown or other
tcagtgatacgtctcacgaccggtgctcgatttagctacgactgcaggggagagagccaccctctcttgcaggaccagtctgcatattcccagcacctacgtagcctggtaccagcagaaacctggccagtctcccaggctcctcatctatggtgcgtccaccagggccactggcatccccagaccgcttcagttccagtgggtctgggacagacttcactctcaccatccgcggactggancctgaagatttgcagtttatactgtcagcagtatggtagctcaccgtacacttttggccaggggaccaagctggagatacaaacgaactgtggctgcaccatctgtcttcatcctcccgcatctgaancgtancactgagcgggctggcaaggcgcatagngnnnnnnnnnn

SEQ ID NO: 405582 - DNA, 396 bp, Homo sapiens
  misc_feature: GZ8MTXP02H032K.9.11.A11.1.454.CMB.2.raw
  modified_base (231)..(231): a, c, t, g, unknown or other
  modified_base (240)..(240): a, c, t, g, unknown or other
  modified_base (263)..(263): a, c, t, g, unknown or other
  modified_base (346)..(346): a, c, t, g, unknown or other
  modified_base (349)..(349): a, c, t, g, unknown or other
  modified_base (351)..(351): a, c, t, g, unknown or other
  modified_base (357)..(357): a, c, t, g, unknown or other
  modified_base (361)..(361): a, c, t, g, unknown or other
  modified_base (363)..(363): a, c, t, g, unknown or other
  modified_base (365)..(365): a, c, t, g, unknown or other
  modified_base (369)..(370): a, c, t, g, unknown or other
  modified_base (372)..(372): a, c, t, g, unknown or other
  modified_base (374)..(374): a, c, t, g, unknown or other
  modified_base (376)..(376): a, c, t, g, unknown or other
  modified_base (378)..(378): a, c, t, g, unknown or other
  modified_base (380)..(380): a, c, t, g, unknown or other
  modified_base (382)..(382): a, c, t, g, unknown or other
  modified_base (388)..(388): a, c, t, g, unknown or other
  modified_base (390)..(390): a, c, t, g, unknown or other
  modified_base (392)..(396): a, c, t, g, unknown or other
tcagtgatacgtctcacgaccggtgctcgatttagctacgactgcaggggagagagccaccctctcttgcaggaccagtctgcatattcccagcacctacgtagcctggtaccagcagaaacctggccagtctcccaggctcctcatctatggtgcgtccaccagggccactggcatcccagaccgcttcagttccagtggtctgggacagacttcactctcaccatccgnggactggancctgaagatttgcagttattacngtcagcagtatggtagctcacgtacactttggccaggggaccaagctaggagatacaaaacgaactgtaggctgcacatcttnttntntctccncatnananatannangngngngngngagcgnanannnnn

SEQ ID NO: 405583 - DNA, 410 bp, Homo sapiens
  misc_feature: GZ8MTXP02HNW1D.9.11.A11.1.454.CMB.2.raw
  modified_base (404)..(410): a, c, t, g, unknown or other
tcagtgatacgtctcacgaccggtgctcgatttagctacgactgcaggggagagagccaccctctcttgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggagcctgaagatttgcagttattactgtcagcagtatggtagctcaccgtactacttttcggctaggggaccaagctaggagatacaaacgaactgcggctgcacatctgtcttcatctcccgactatctgagacgtatcactgagcgggctggcaagcgcatagnnnnnnn

SEQ ID NO: 405584 - DNA, 425 bp, Homo sapiens
  misc_feature: GZ8MTXP02JOR8C.9.11.A11.1.454.CMB.2.raw
  modified_base (419)..(425): a, c, t, g, unknown or other
tcagtgatacgtctcacgaccggtgctcgatttagctacgactgcaggggagagagccaccctctcttgcaggaccagtctgcatattcccagcacctacgtagcctggtaccagcagaaacctggccagtctcccaggctcctcatctatggtgcgtccaccagggccactggcatcccagaccgcttcagttccagtgggtctgggacagacttcactctcaccatccgcggactggagcctgaagtattttgctagtttattactgtcagcagtatggtagctcaccgtactacgtttggccaggggaccaagctggagatacaaacgaactgtcggctgcaccatctgttcttcattccttcccgcatctagaaagtcgtatcactggagcgggctgggacaaggcgacagtagnnnnnnn

SEQ ID NO: 405585 - DNA, 438 bp, Homo sapiens
  misc_feature: GZ8MTXP02FHSEB.9.11.A11.1.454.CMB.2.raw
  modified_base (186)..(186): a, c, t, g, unknown or other
  modified_base (225)..(225): a, c, t, g, unknown or other
  modified_base (396)..(396): a, c, t, g, unknown or other
  modified_base (415)..(415): a, c, t, g, unknown or other
  modified_base (421)..(438): a, c, t, g, unknown or other
tcagtgatacgtctcacgaccggtgctcgatttagctacgactgcagggaatactggttcttagacgtgtcaagggacatggagagtcgactctccatgtcccttgacacgtctaagaaccagtattccctgcaactgagctccgtgactgccgctgacacggccgttttatactgtgccataacngcctgtattactaccagttgctatcatctgagtccgganagcttactttgctcctggggcctggggaaccctggtcaccgtctcctcagcctccaccaagggccccatccggtctttcccccctggcacccctcctccaagagcacctctggggcacgagcggccctggggcctgcctggtcaaggactcttccagacctatcactgagngggcctgggccaaagggcncagtannnnnnnnnnnnnnnnnn

SEQ ID NO: 405586 - DNA, 574 bp, Homo sapiens
  misc_feature: GZ8MTXP01C0LSE.21.67.G01.1.454.CMB.2.raw
  modified_base (386)..(386): a, c, t, g, unknown or other
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggggcctctggttacagtttttccgactatagtatcagttgggtgcgacaggccccttggacaagggcttgagtggatgggatggggccgaccttcgcaacgggaaagatgggagtatggtcaggatttcagggcagatacttgaaccangactcatccacggggcacagcctacttggaactgaggaacctgagaatggacgacacggccacgatacttagttgtagcgcggaggtgggggctagttgtagacgtactaactattattacttcgttggtacgttcgttgggggacaaaggggaccgaacgggtcaccggttctccccgaagtccccg

SEQ ID NO: 405587 - DNA, 562 bp, Homo sapiens
  misc_feature: GZ8MTXP01DD1TU.21.67.G01.1.454.CMB.2.raw
  modified_base (390)..(390): a, c, t, g, unknown or other
  modified_base (397)..(397): a, c, t, g, unknown or other
  modified_base (438)..(438): a, c, t, g, unknown or other
  modified_base (452)..(452): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcaggggcctctggttacagtttttccgactatagtatcagttgggtgcgacaggcccttggacaagggcttgagtggagtgggatggggccgacttcgcaaacggaaagagtgggagtagtggtacaggatttcgagggcagaattactgaaccanaagactnactccgacgggcacagctacttggaactgagaactagaganggacgacacggcanagtattatgtgcgcgagtggggctagttgtagtactataactattattacttgttaggcttcgttgggacgaaagggccaacgggtccaccggttcctccccgcgtcccc

SEQ ID NO: 405588 - DNA, 544 bp, Homo sapiens
  misc_feature: GZ8MTXP01C25IO.21.67.G01.1.454.CMB.2.raw
  modified_base (380)..(380): a, c, t, g, unknown or other
  modified_base (481)..(481): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggctcggtgaaggtctcctgcagggcctctggttacagtttttccgactatagtatcagttggggtgcgacaggccccttggacaagggcttgagtggatgggatgggcgacttcgcaacggaaagatggagtatggtcaggatttcagggcagattacctgtaccangactcatccagggcacagcctactggaactgaggaactagagaatggagacacggacacataattatgtgacgcgagtgggggcatttgagactataactnttattacttcgttggacgttcgttggggcaaagggtaccaaggtcacgttctccccaagtccc

SEQ ID NO: 405589 - DNA, 605 bp, Homo sapiens
  misc_feature: GZ8MTXP01AW09D.21.67.G01.1.454.CMB.2.raw
  modified_base (400)..(400): a, c, t, g, unknown or other
  modified_base (422)..(422): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgactatagtatcagttgggtgcgacaggcccttggacaagggcttgagtggagtgggatggggccgacgttcgacgaaacggaaagagtggagtagtggtacaggtaatttcgaggacaggtaacttacctagaaccanaagactcatcccgagggcaacngcctataggaactgagactagagaatggacacgacgacacatattagtgtgcgcggaggtggggctagttggtacgtactactaagttaatttattacgtttcgttagggtacgttcggttcggggacgtaaaggggcccgtaacggtcccgaacccggttcctccccgaacggtaacccccg

SEQ ID NO: 405590 - DNA, 699 bp, Homo sapiens
  misc_feature: GZ8MTXP01C7286.21.67.G01.1.454.CMB.2.raw
  modified_base (389)..(389): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggggcctctggttacagtttttccgacttatagtatcaggttgggtgcgacaggccccttggacaagggcttgagtggatgggatggggccgacttcgcaacggaaagatggagtatggtcaggatttcgagggcagtaattacctgaaccacngactcatccacgggcacgacgccttactggaactggaacggaacctagaacgaagtacgggaacgaacgaccgggaccaacgaattaacgtttaagttacggtaggaccggtaccgggtaagggtggggggtacctaaggttttagggtaacgtaaccgttaaacttaaccgtttaatttaaagttttaaccgtttacgtttacgggtaaccggtttcggttcgggggttaaccgaaaaacgggggtaccccgtaaccgggttacccgtaaccccggttacccgttaaccccccgaacgttaaccccccg

SEQ ID NO: 405591 - DNA, 596 bp, Homo sapiens
  misc_feature: GZ8MTXP01DXVFP.21.67.G01.1.454.CMB.2.raw
  modified_base (386)..(386): a, c, t, g, unknown or other
  modified_base (467)..(467): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactccccagactcaactggtgcagtctggacctgaggtgaagaagcctgggggcctcggtgaaggtctcctgcagggcctctggttacagtttttccgactatagtatcagttgggtgcgacaggcccttggacaagggcttgagtggatgggatggggccgacttcgcaacggaaagatgggagtatggtcaggatttcgagggcagattacctgaacccangactcatccacgggcacagcctattggaactgagaacctagagaatggacgacacggacacgatacttagttcgtagccgngaggtgggggactagtttgtagtacgtactaacttagttattacgtttgttacggtaacgttcgttcgggggacgtaaacggggaacctaacgggttccacccggttaccgttccccgaacggtccccg

SEQ ID NO: 405592 - DNA, 670 bp, Homo sapiens
  misc_feature: GZ8MTXP01BC60I.21.67.G01.1.454.CMB.2.raw
  modified_base (243)..(243): a, c, t, g, unknown or other
  modified_base (391)..(391): a, c, t, g, unknown or other
  modified_base (396)..(396): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctntggttactagtttttccgactatagtatcagttgggtgcgacaggccctggacaagggcttgagtggatgggatgggccacgttcgacgaaacggaagagtgggagtagtggtacaaggtatttcgagggacagattacctgaaccangactnactccgacgggcacgacgacctacgttggaactaggaacggaaccctagaacgaagtacgggaaccgaacgacggaccaacgtaattaacgtttagttaggtcgacggtacgggtacggtggggggtactaagtttaggtaaggtaaccttaacgttaacttaagtttaacgtttacgtttccgttagggtacgttacggttacgggggacgtaaaacggggtacccgtaacgggttaccgtacccggttaccctccccgttaacgtaaccccg

SEQ ID NO: 405593 - DNA, 653 bp, Homo sapiens
  misc_feature: GZ8MTXP01A77AT.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttggagtggatggggatggggccgaccttcggacaaacgggaaagagtggagtagtggtacaaggtaatttcgaggggcagtaacgttaccttgaaacccacaagactcaacgtaccgacgggacacgagccctagttacggaacgtggtaacggaacctaggaagaagtagggaacgacgacggaccaacattaagtttagttgtacggcgacggtagggtgggggtactagtttggtaagtacgttaacttaacttaatttactttacttcgtttagggtacgttcgttcggggacgtaaacggggaccctaacgggtccgtacccgttcctccccgaacgtaaccccg

SEQ ID NO: 405594 - DNA, 591 bp, Homo sapiens
  misc_feature: GZ8MTXP01EQNIB.21.67.G01.1.454.CMB.2.raw
  modified_base (393)..(393): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggagtgggatggggccgtacttcgacaaacggaaagagtgggagtagtggtcaggaatttcgagggcagaattacctgaaccacngactcatccgacgggcacagcctattggactgagacctagagaatgacgacacggacacagtattatgtgcgcgaggtgggggactagttgtagacgttactaacttaatttattaactttcgttagggtacgttcgttggggacgtaaacggggacccaacgggttccaacccggttcctaaccccgcgtaaccccg

SEQ ID NO: 405595 - DNA, 601 bp, Homo sapiens
  misc_feature: GZ8MTXP01C9094.21.67.G01.1.454.CMB.2.raw
  modified_base (396)..(396): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttacagtttttccgactatagtatcagttgggtgcgacaggccccttggacaagggcttgagtggatgggatggggccaccgttcgacaaacggaaagatgggagtagtggtcaggtaatttcgagggcagtaacttacctggaaaccanaagactcactccgacgggcacacgcctacgtggaactgagaacctgagaatggacacacggaccacagtattatgtgcgcggaggtgggggactagtttgagtacgttataacttaattatttacttcgttagggtacgttcgttgggggactaaagggggaccctaacgggtccaacccggttcctccccgaacgtaacccccg

SEQ ID NO: 405596 - DNA, 573 bp, Homo sapiens
  misc_feature: GZ8MTXP01BN9H3.21.67.G01.1.454.CMB.2.raw
  modified_base (387)..(387): a, c, t, g, unknown or other
  modified_base (431)..(431): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggggcctctggttacagtttttccgactatagtatcagttgggtgcgacaggccctggacaagggcttgagtggatgggatggggccacttcgcgaaacggaagatgggagtatggtcaggaatttcgagggcaggaattacctgaaccacngactcatccgacgggcacagctactggaactgagaactagaganggacacacggacacatattatgtagcgcgaggtgggggactagtttgtagtactaacgtaacttattattacttcgttaggtacgttcgttggggactaaaggggaccaacggtcacccgttccgtccccaacggtaacccc

SEQ ID NO: 405597 - DNA, 589 bp, Homo sapiens
  misc_feature: GZ8MTXP01CF09L.21.67.G01.1.454.CMB.2.raw
  modified_base (388)..(388): a, c, t, g, unknown or other
  modified_base (469)..(469): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggggcctctggttactagtttttccgactatagtatcagttgggtgcgacaggcccttggacaagggcttgagtggatgggatgggcacttcgacgaacggaagagtgggagtatggtcaggaatttcgacgggcagaattacctgaaccacngactcatccgacgggcacgagcctacgttggaactgaggaaccgtagagaagtggacgacgacggaccacagtattattgngcgcggaggtgggggctagtttgtagtacgtactaactattattacttcgttggtacgttcgttggggacgtaaagggaccgtaacggtccgtacccggttctccccgttcgtaaccccg

SEQ ID NO: 405598 - DNA, 584 bp, Homo sapiens
  misc_feature: GZ8MTXP01BT9RX.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggggcctctggttacagtttttccgactatagtatcagttgggtgcgacaggccccttggacaagggcttgagtggatgggatggggccgaccttcgcaaacgggaaagatgggagtatggtcaggaatttcgagggcagaattaccttgaacccacaagactcatccacgggcacagcctacttggaactgaggaacctagagaatggacgacacggacacagtattattgagcgcgaggtgggggctagtttgtagtacttaacgtaactatttatttacttcgttggtacgttgttggggacgtaaacgggaccgaacgggtcacccgttctccccgaacgtcccc

SEQ ID NO: 405599 - DNA, 666 bp, Homo sapiens
  misc_feature: GZ8MTXP01CX8ZM.21.67.G01.1.454.CMB.2.raw
  modified_base (580)..(580): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtgttactagtttttcgactatagtatcgtagttgggtgcgacaggccctggacaagggcttgagtggagtgggatcgggccgacgttcgacgaaaggaagagtgggagtagtggtacgaaggtaatttcgaaggggacaaggtaactttaccgttaggaaacccacgaacgtactacaacgtacccgaacggggacaacgacgtacccgtaacgttaggggaaacctgggaacggtaaacctaaggaacgtaaagtcggggaaacaacgaaccgggaccctaaataagttaatttaagtgtacggcgtacggaggtgggggactaagtttggtaanactacttaatatttattacttgtacggtcttcggttgggacgtaaagggacctaacggtcaccggttcctaacccgcgtaaccccg

SEQ ID NO: 405600 - DNA, 610 bp, Homo sapiens
  misc_feature: GZ8MTXP01EY7QW.21.67.G01.1.454.CMB.2.raw
  modified_base (388)..(388): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagctggggcctcggtgaggtctcctgcagggcctctggttactagtttttccgactatagtatcagttgggtgcgacaggcccttggacaagggcttgagtggatgggatggggccgacttcgcaaacgggaaagagtgggagtagtggtcaggaatttcgagggcagaattacctgaacccangactcatccgacgggcacagcctagttggaactgagactagagaatggaacgacacggaccacgaattaactttagttgtacgcggacggagggtcgggggtatagttggtaagacttaataacttatttattaactttcgtagggtacgttcggttcgggggttacaaacggggacctaacgggtaccgtacccggttaccctccccgaacggtaaccccg

SEQ ID NO: 405601 - DNA, 828 bp, Homo sapiens
  misc_feature: GZ8MTXP01DY7MO.21.67.G01.1.454.CMB.2.raw
  modified_base (406)..(406): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcaggttgggtgcgacaggcccttggacaagggctgagtggatgggatggggccgacgttcgacgaaacggaaagagtgggagtagtggtacgaggtaatttcgagggccaagtaactttaccttagaaacccaanaacgactacgacgttacccgaacggggcaaacgacgtacccgttaacgtttacgggaaacttagggaaacggtaaacccgttagggaaacggtaaaagttcggggaaaacccggaaccgaaacccggggaacccctaaaccggtaaacgtttaaaacgttttaacgtttagggttaccgggtacccgggaccggggttaaagggggttacgggggggggtaacctttaaggttttaaggggttaaacggttaaacccgtttaaaccgtttaaacccgttttaatttttaaacgttttaaacccgttttcggtttaacggggtaaccggttaccgggtttacgggggaaccgtaaaaacgggggtacccgtaaccgggttacccgaaccccgttcccgtaaccccccgaacgttaaccccccg

SEQ ID NO: 405602 - DNA, 652 bp, Homo sapiens
  misc_feature: GZ8MTXP01DKGKI.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagctggggcctcggtgaaggtctctgcagggcctctggttacagtttttccgactatagtatcagttgggtgcgacaggcccttggacaagggcttgagtggatgggatggggccgacgttcgacgaaacggaaagagtgggaagtagtggtacaggtaaatttcgaaggggcaaggtaaatttacccgttagaaaccctaacaaggactacgaacttacccgaaccggggcaacgacggtacccttaacgtttagggaaactggaacggaaacccgttaggaagaaatcgggaaccgacgaaccggaccaacattaatttaagttgtacgcgcggaggtgggggactagtttagtagtactattaacgtaattattacttcgttaggtacgttcgttggggacgtaaagggccgtaacggtccaccgttcctccccgcgtaacccc

SEQ ID NO: 405603 - DNA, 775 bp, Homo sapiens
  misc_feature: GZ8MTXP01COFUX.21.67.G01.1.454.CMB.2.raw
  modified_base (278)..(278): a, c, t, g, unknown or other
  modified_base (315)..(315): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggncgacaggcccttggacaagggcttagaggtgagtggngcgggacctacgtcgaacgaaacggaagagtaggtagtagtgtacgagttaacttacggacggactaagtaacttacgtacgaaaccacaacgtactacaccgtacccggacggacacgtacgtacccttaaggtacggaacgtagggaaaccgtaacgtagggaaacgtaacggacgggaaaccgaaccgaaccgggaacctaacgttaagtttaacgttttaacggtcggtacgggtaccggacggggttaagggggtcggggttaacctttaggtttaacggtaaccggttaaaccctttaacggtttaaacttttaacgtttaaacgtttttaccgttaccgggtttaacgggttacggtttacggggacgggggttaaaaccgtaaacccgggggtacccgttaacccgggttacccgtaaccccgttccccgtaaccccgcccgttaacccccg

SEQ ID NO: 405604 - DNA, 564 bp, Homo sapiens
  misc_feature: GZ8MTXP01C06SU.21.67.G01.1.454.CMB.2.raw
  modified_base (384)..(384): a, c, t, g, unknown or other
  modified_base (455)..(455): a, c, t, g, unknown or other
  modified_base (555)..(555): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgacttcgcaaacggaaagatgggagtatggtcaggatttcgagggcagaatacctgaaccangactcatccacgggcacagctacgtggaactgagaactagagaatggacgacgacggacacatatagttgngtcgcgagtgggggctagttgagtactataacttattattacttcgtttaggcgttcgttggggacaaaaggggccaacggttcaccggttcctccccgngtaaccccg

SEQ ID NO: 405605 - DNA, 781 bp, Homo sapiens
  misc_feature: GZ8MTXP01DRRCT.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttacagtttttccgactatagtatcagttgggtgcgacaggcccttggacaagggctgagtggagtgggatggggccgaccgttcgacgaaacggaaagagtagggaagtagtggtacaaggtaaatttcgaaggggcaaggtaaactttacccgttaggaaacccaacgaaggaaccttaccgaacgtaccccgaaccggggacaacgaacgtacccttaacgttacggaaacgtaggaaacggtaaacccgtaggaacgtaaagtacgggaaaccgaaccgaaccgggacccaaaccgtaagtttaaagtttaaacgtttggttacggaccggtaccggtaaggggtcggggggtaaccttaaggttttacggtaacggtaaacctttaaacggttaaactttaagttttaaagtttaaccgttttacgtttaacggggtacggttacggtttgggggaaccgtaaaacgggggtaccccgtaacgggttaccccgtacccggttacccgtaacccccgaacggtaacccccg

SEQ ID NO: 405606 - DNA, 628 bp, Homo sapiens
  misc_feature: GZ8MTXP01CX67E.21.67.G01.1.454.CMB.2.raw
  modified_base (407)..(407): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactccccagactcaactggtgcagtctggacctgaggtgaagaagccgtggggcctcggtgaaggtctcctgcagggcctctggttactagtttttccgactatagtatcagttgggtgcgacaggcccttggacaagggcttggagtggatgggagtggggcccgtaccgttcgacgaaacggaaagagtagggagtagtggtacaaggtaatttcgagggcaagtaacttacctgaaaccangactcactccgacgggcacgacgacctacgtaggaactgaacggaaccgtagagaagtggaacgacgacggacaacgattattaagttgagcgcgaggtggggactagttgtagtacgttactaacttattatttacttcgtttaggtacgttacgttggggacgaaaggggtacccgtaacgggtccacccggttcccgtaaccccgaacggtaaccccg

SEQ ID NO: 405607 - DNA, 599 bp, Homo sapiens
  misc_feature: GZ8MTXP01C8275.21.67.G01.1.454.CMB.2.raw
  modified_base (400)..(400): a, c, t, g, unknown or other
  modified_base (594)..(594): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttgggtgcgacaggcccttggacaagggcttgagtggatgggatggggccgtaccgttcgacgaaacggaaagagtgggagtagtggtacaggtaatttcgagggcaagtaattacctgaaaccangactcactcccgacgggcacacgccttacgtaggaactggaaggaaacctaggaagaaagtgggaaccgaacgaccggaccaactaattaattagttgtgcgcgaggtgggggactagtttgagactataactatttattacgttgttggcgttcgttggggacaaagggaccaacggtcaccgttcctcccgngtccc

SEQ ID NO: 405608 - DNA, 609 bp, Homo sapiens
  misc_feature: GZ8MTXP01C5YD4.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgacgttcgacgaaacggaagagtgggagtagtggtcaggtaatttcgagggcagtaattaccttgaaaccacaagactcatccgacgggcacagcctacgtaggaactgagaacctagacgaagtggacgacgacggacaacagtattattggtgcgcggaggtgggggactagtttaggtagtacttaacttaactaatttattacgttcgttagggtcgttcgttggggttaccgaaaggggacccgtaacgggtccacccgttacctccccgaacgtaaccccg

SEQ ID NO: 405609 - DNA, 603 bp, Homo sapiens
  misc_feature: GZ8MTXP01B97SN.21.67.G01.1.454.CMB.2.raw
  modified_base (394)..(394): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggccccttggacaagggcttgagtggatgggatggggccaccgttcgacaaacggaaagatgggagtagtggtcaggaatttcgaggggcagaattaccttgaaaccangactcatccgacgggcacagcctattggaactgagaacctagagaatggacgacacggacacgattaattaagttgtgcgcggaggtgggggctagtttgtagtacttaacgtaactatttagttacttcgttaggtacgttcgttgggggactaaagggggtaccctaacgggttaccaccgggttccctccccgaacggtaaccccg

SEQ ID NO: 405610 - DNA, 610 bp, Homo sapiens
  misc_feature: GZ8MTXP01EMQUH.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgacttcgacgaaacggaagagtgggagtagtggtcaggaatttcgagggcaagaattacctgaaccactgactcactaccgacgggcaacgacgacctattaggaactgaacgaacctagaagaagtggacgacgacggaccaactagtaatttaagttgtagcgcgaaggtgggggatagtttagagtacttaactaacttaatttattaacttcgttaggtaccgttgttggggacgaaaggggacccgtaacggtacacccggttcctccccgaacgtaaccccg

SEQ ID NO: 405611 - DNA, 597 bp, Homo sapiens
  misc_feature: GZ8MTXP01DJF7X.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggccccttggacaagggcttggagtggatgggatggggccgaccttcgacaacggaaagatgggagtatggtcaggatttcgagggcagaattaccttgaacccacaagactcaatcccgacggggcacgacgcctacgttggaactgaggaacctgagaatggacgacgacggaccaacataactttagttgtaggcgcggaaggtgggggactagtttgtagacgttactaacttatttattacttcgtttggcgttcgttggggacaaaggggaccaacgggtccaccggttcctccccgcgaacccccg

SEQ ID NO: 405612 - DNA, 562 bp, Homo sapiens
  misc_feature: GZ8MTXP01A7PGC.21.67.G01.1.454.CMB.2.raw
  modified_base (386)..(386): a, c, t, g, unknown or other
  modified_base (462)..(462): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggccccttggacaagggcttgagtggatgggatggggccgacttcgcgaacggaaagatgggagtatggtcaggatttcgagggcagaattacctgaaccangactcatccacgggcacagcctacttggaactgaggacctagagatggacgacgacggcacatattatgtgcgcgnggtggggctagttgtagactactaactattattacttcgttggtacgttcgttgggacgtaaagggaccaacgggtcaccgttcctcccgaacgtccccg

SEQ ID NO: 405613 - DNA, 579 bp, Homo sapiens
  misc_feature: GZ8MTXP01B7GD6.21.67.G01.1.454.CMB.2.raw
  modified_base (390)..(390): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttgggtgcgacaggccccttggacaagggcttggagtggatgggatggggccgacttcgcaacggaagatgggagtagtggtcaggatttcgagggcagaattaccttgaaccacngactcatccgacgggcacacgcctatggaactgaggaacctagagatggacgacgacggcacagtattattgtcgcgcgaggtgggggctagtttgtagacgttactaactatttattacttcgttgggtcgttcgttggggacgtaaacggggccaacgggtccaccgttcctccccgaacgtccccg

SEQ ID NO: 405614 - DNA, 546 bp, Homo sapiens
  misc_feature: GZ8MTXP01D3YDN.21.67.G01.1.454.CMB.2.raw
  modified_base (278)..(278): a, c, t, g, unknown or other
  modified_base (282)..(282): a, c, t, g, unknown or other
  modified_base (384)..(384): a, c, t, g, unknown or other
  modified_base (510)..(510): a, c, t, g, unknown or other
  modified_base (542)..(542): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttcgactatagtatcagttgggtncganaggccctggacagggctgagtggatgggatggggccgacttcgcgaaacggaaagatgggagtatggtcaggatttcgagggcagaattacctgaaaccacngactcactccgacgggcacacgcctattggaactgagaacctagagaagtggacgacacggaccacaatattagtgtggcgcggagtgggggctagttgtagactagtaactattattattcgtgnttcgttgggacaaggcaacgtcacgcctcccngccc

SEQ ID NO: 405615 - DNA, 729 bp, Homo sapiens
  misc_feature: GZ8MTXP01D2FA9.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcgtggggcctcggtgaaggtctcctgcagggcctctggttactagtttttccgactatagtatcaggttgggtgcgacaggccccttggacgaagggtcttggagtggagtgggagtcggggccgtaccgttcgacgaaacggaaagagtgggagtagtggtacaggtatttcgagggcaagtaacgttacctagaaacccacaagactacacgtccgacgggcaacgacgtacctacgttacgggaactaggaacggaaccctaggaacgtaaagtcggaaccgacgaccgggaccaacgtaattaagtttagttggtacggccggacggtggggtagggggtactaggtttacggtaacgtaaccgttaacgtttaacctttaagtttaacgttttaaccgttttcgggtttaacgggttaaccggttcgggttacgggggttaaccgtaaaacgggggtaccccgtaaccgggggtttcccaacccgggttccccttaaccccgaacgttaaccccccg

SEQ ID NO: 405616 - DNA, 589 bp, Homo sapiens
  misc_feature: GZ8MTXP01DPCX2.21.67.G01.1.454.CMB.2.raw
  modified_base (394)..(394): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggccccttggacaagggcttggagtggagtgggatggggccgtaccttcgacaaacggaaagatgggagtagtggtacaggaatttcgagggcagattactgaacccangactcactccacgggcacagcctatggaactgaggaactgacgaagtggacgacgacggaccacgattattagttgtgcgcggaggtgggggactagtttgtacgtacgttaactaacttaatttattactttgttaggtacgttcgttggggacaaggggtaccaacggtcacccgttcgtccccaagtccccg

SEQ ID NO: 405617 - DNA, 837 bp, Homo sapiens
  misc_feature: GZ8MTXP01DXD7Y.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcgagttgggtgcgacaggcccttggacaagggcttggagtggatgggagtcggggccaccgttcgacaaacggaaagagtgggaagtagtggtcgaaggtaaatttcgaaggggctaaggtaaactttacccgttaggaaaaccaaacgaaggtaaccttacgaacgttaccccgaacgggggacaacgaacggtcccttaacgtttacgggaaaccttagggaacgggtaaacccgttaggaaaggtaaagtacggggaaaccgaaccgaaccgggaccctaaaccggtaaaggtttaaacttttaaaggtttggttacggaccggtaccgggtaaacgggttgggggggtaaccttaagtttttagggtaaacggttaccgtttaaaccgttaaaccgttttaagttttaaacttttaaccgttttacggtttaacggggtaacccggttttaccggggttaggggggttaaaccgttaaaaccggggggaaccccgtaaccgggggtttaccccaaaccccgggtttccccttaaccccccggttaaccgggttaacccccccg

SEQ ID NO: 405618 - DNA, 738 bp, Homo sapiens
  misc_feature: GZ8MTXP01EBVCI.21.67.G01.1.454.CMB.2.raw
  modified_base (395)..(395): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggccctggacaagggcttgagtggatgggatggggccgacttcgacaacggaaagagtgggagtagtggtacaggtaatttcgagggcagtaacttaccttagaaaccacngactacgactacccgaacggggcaacgacgacccttacgttacggaaacgtggaaggaaacccgttaggaagaaagtacgggaacgaaccgaacgggaccaaccgtaagttaactttaagttacggttacggacggtaccgggtaagggttcggggggtacctaagtttttagggtaacggtaaccttaacgttaaaccgtttaagttttaacttttaaaccgttttacgtttacgggtaacccggtttcggttacgggggttaaccgtaaaacgggggtacccgtaaccggggttacccgtaaccccggttcccgttaaccccccgttaacggtaacccccg

SEQ ID NO: 405619 - DNA, 574 bp, Homo sapiens
  misc_feature: GZ8MTXP01EYG5Q.21.67.G01.1.454.CMB.2.raw
  modified_base (219)..(219): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctggngaggtctctgcagggcctctggttacagtttttccgactatagtatcagttgggtgcgacaggcccttggacagggattgagtggatgggatggggccgacgttcgcaaacggaaagagtgggagtatggtcaggaaatttgacgggcagtaattaccttgaaccacaagactcatccacggggcacacgctattggaactgagactagagagtaggacgacacggacacagtattagtgtagcgcgagtggggctagttgtagactagtaacttatttagttacttcgttggacgttcgttgggggactaaaggggaccaacgggttcaccggttccttccccgaacgtccccg

SEQ ID NO: 405620 - DNA, 595 bp, Homo sapiens
  misc_feature: GZ8MTXP01DA03C.21.67.G01.1.454.CMB.2.raw
  modified_base (394)..(394): a, c, t, g, unknown or other
  modified_base (478)..(478): a, c, t, g, unknown or other
  modified_base (586)..(586): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggggcctctggttacagtttttccgactatagtatcagttgggtgcgacaggccccttggacaaggggcttggagtggatggggatggggccgaccgttcgcaaacggaaagatgggagtatggtcaggaatttcgaggggcaggattacctgaaccangactcatccgacgggcacagcctataggaactgagaacctgacgaatggacgacgacggaccacagttaattacgttagtcggngcggaggtgggggactagttcgtagacttactaactatttattacttcgtttaggacgttcgttgggggactaaaaggggacctaacgggtcacccgttcctccccgngtaaccccg

SEQ ID NO: 405621 - DNA, 584 bp, Homo sapiens
  misc_feature: GZ8MTXP01DWVHN.21.67.G01.1.454.CMB.2.raw
  modified_base (390)..(390): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatggggccgacttcgacaaacggaaagagtgggagtatggtcaggaatttcgagggcagaattacctgaaccacngactcatccgacgggcacgacgcctacttggaactgaggaacctgagaatggacgacacggaccacagtattattgtgcgcgaggtgggggtactagtttgtaagtactactaactatttatttacttgttaggtacgttcgttggggacaaaggggacctaacggtccaccgttcctccccgaagtaaccccg

SEQ ID NO: 405622 - DNA, 629 bp, Homo sapiens
  misc_feature: GZ8MTXP01C77DZ.21.67.G01.1.454.CMB.2.raw
  modified_base (402)..(402): a, c, t, g, unknown or other
  modified_base (428)..(428): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgactatagtatcaggttggtgcgacaggcccttggacgaaggcttgagtggatgggatggggccgtaccttcgacgaaacggaaagagtagggagtagtggtacaaggtaatttcgaggcagtaattacctagaaaccanaagactcacgtacccgagggcaacgngacctacgtggaactgaagaaccgtagaagaagtggacgacgacggaccaactagttactttagtgtacgcgcggaggtggggactagtttaggagtactaacgttaactaattactttacttcgttacggtcgttacggttcggggacgaaaacggggtacctaacgggtccaacccgttcctccccgaaggtaaccccg

SEQ ID NO: 405623 - DNA, 660 bp, Homo sapiens
  misc_feature: GZ8MTXP01DMB3X.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttgggtgcgacaggcccttggacaagggcttgagtggatgggatggggccgaccttcgacgaaacggaaagagtgggagtagtggtacaaggtatttcgaggggcagtaattaccgttgaaacccacaagactcatccgacgggacacgacgcctacgttggaaactgaacggaaccgtaggaagaagtagggaacgaacgaccgggaccaactaagttactttaagttggtacggcggtacggtaggggtcgggggacttagtttggtaagtaccttaacgttaacttaatttatttaaccgtttcgttagggtacgttcgttgggacggtaacgaaaacggggaacccgtaccgggtccgacccgtcccgttccccgtaacccg

SEQ ID NO: 405624 - DNA, 768 bp, Homo sapiens
  misc_feature: GZ8MTXP01CPBX6.21.67.G01.1.454.CMB.2.raw
  modified_base (404)..(404): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgatatagtatcgagttgggtgcgacaggcccttggacaagggcttggagtggatgggatggggccgaccttcggacgaaacggaaagatagggagtagtggacaggaatttcgaggggcaagtaattacccgttgaacccancgactcgaactccgacgggcacacgacctacgttaggaactgaacggaacctaggacgaagtacgggaacgaacgaccgggacctaaccgtattaagtttaagtttcggtacggtaccggaccggtaggggttacgggggggtaccttaggtttttaacgggtaaacggttaaacctttaaaccgggtttaaaccgttttaaatttttaacgttttaaaccgttttccggttttaaacgggggtccggttttaaccgggttacggggggttaaccgtaaaaaccgggggtaccccgttaaccggggtttacccgaaaccccgggtttccccgtaaccccccggttaacggttaaccccccccgg

SEQ ID NO: 405625 - DNA, 669 bp, Homo sapiens
  misc_feature: GZ8MTXP01AT9D8.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagaagccgtggggcctcggtgaaggtctcgtgcgagggcctcgtggttactagtttttccgactatagtatcgaggttgggtgcgacgacggtcccgttaggacgaagggtcttaggaggtggagtgggagtcggggacccgtaccgttcgacgaaacggaaagagtagggagtagtggtacgaaggtaatttcgagggcaagtaacttaccgtgaaaccacaagactcactcccgacgggcaacgacgacccttacgtacggaacgtaggaacggaacctaggaagaacgtggacgacgacggaccaacagttacttagtgtacgcgacggagggtcggggatagttggtaactacttaactaagttaatttaagttacttcgttacgggtacgttcggttcggggaacgtaaacggggtcctaacgggtcctaacccggttccctaacccgaacgtaacccccg

SEQ ID NO: 405626 - DNA, 627 bp, Homo sapiens
  misc_feature: GZ8MTXP01DTV4L.21.67.G01.1.454.CMB.2.raw
  modified_base (243)..(243): a, c, t, g, unknown or other
  modified_base (352)..(352): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctntggttactagtttttccgactatagtatctaggttgggtgcgacacggcccttggacaagggtcttggagtggagtgggagtcgggccgtacttcgacgaaacggaagngtggagtagtggtacgaaggtattcgacggacagtaacttactagaaacccagaagactacactccgacgggacacgacgtcctacgttaggaactggaacggaacctaggaacgaagtcggaacgaacgaccggacaacgtattaattacgtgtcgcgacggtaggtggggactagtttgacgtactacttaattattacttcgttcgtacgtacgttggcggggttacaacgggtaccgcggtccacccggttcctaaccccgcggtaacccc

SEQ ID NO: 405627 - DNA, 556 bp, Homo sapiens
  misc_feature: GZ8MTXP01CAZ0Z.21.67.G01.1.454.CMB.2.raw
  modified_base (384)..(384): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgacttcgacaacggaaagatgggagtatggtcaggattcgaggcagaattacctgaaccacngactcatccgacgggcacacgcctactggactgagaactagagaatggacgacgacgcacagtattatgtgcgcgagtggggactagttgtagactacgtaactatttattacttgttggtcgttcgttgggacaaagggaccaacggtcacgttcctccccgaagtccccg

SEQ ID NO: 405628 - DNA, 645 bp, Homo sapiens
  misc_feature: GZ8MTXP01B0G3J.21.67.G01.1.454.CMB.2.raw
  modified_base (403)..(403): a, c, t, g, unknown or other
  modified_base (426)..(426): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatcggggccgacgttcgacgaaacggaagtagtgggagtagtaggtacaaggtatttcgagggctaagtaattacccttgaaacccanaagactcatccgacgggcacganccttagttaggaactgaggaacctaggaagagtaggaacgacgacggaccaacgattaattagttgcggtacggacggtagggtcgggggatagtttggtacgtacttaactaacttaatttacgtttaacttgttacgggtgttacgggttggggaaccgttaaagggacccgtaaccggtccgtaaccgttcccgttaaccccgaacggtaaccccg

SEQ ID NO: 405629 - DNA, 601 bp, Homo sapiens
  misc_feature: GZ8MTXP01ERCNL.21.67.G01.1.454.CMB.2.raw
  modified_base (395)..(395): a, c, t, g, unknown or other
  modified_base (594)..(594): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgaccgttcgcgaaacggaagagtgggagttagtggtacaggtaatttcgagggcagaattaccttgaacccangactcatccgacggggcacgacgcctacgttaggaaactggaacggaacctaggaagaagtgggaacgacgacggacaacgaattatttaacgttgtgacgcggaggtggggactagttgtagtacgtataacttaattattacttgtcggtacgttcgttggggacaaagggccctaacggtcacccgttctccccgngtccccg

SEQ ID NO: 405630 - DNA, 577 bp, Homo sapiens
  misc_feature: GZ8MTXP01DDQ6L.21.67.G01.1.454.CMB.2.raw
  modified_base (375)..(375): a, c, t, g, unknown or other
  modified_base (391)..(391): a, c, t, g, unknown or other
  modified_base (409)..(409): a, c, t, g, unknown or other
  modified_base (466)..(466): a, c, t, g, unknown or other
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgacttcggacaacggaaagagtgggagtagtggtacaaggtatttcgagggnagattacctgaaccangactcatccacggcacanctatggaactgaggaactagacgaatggacgacgacggaccacagttaattagttgngtcgcggaggtgggggactagtttgtagactactaattaattattacttgttaggcgttcgttggggacgaaagggaccgaacgggtcaccggttcctccccgcgtccccg

SEQ ID NO: 405631 - DNA, 510 bp, Homo sapiens
  misc_feature: GZ8MTXP01EVLLO.21.67.G01.1.454.CMB.2.raw
  modified_base (308)..(308): a, c, t, g, unknown or other
  modified_base (313)..(313): a, c, t, g, unknown or other
  modified_base (481)..(481): a, c, t, g, unknown or other
  modified_base (483)..(483): a, c, t, g, unknown or other
  modified_base (485)..(485): a, c, t, g, unknown or other
  modified_base (487)..(487): a, c, t, g, unknown or other
  modified_base (489)..(489): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctctgcaggcctctgttacagttttcgactattagttagtcgtagtggtgacgacgacgtccgtagacgaggtgtgagtgngtggngtcggcgtacgtacgcgaacgaagagtaggtagtagtagtacgtagtaagttagaggacgagtaacgttacgtacgacacgacgactacacgacgacgggacgacgacgacgtacgtacgacgacgacgacgtagagagagaacgacgacgacacgtatattagttgngngngngnggagttagtaagttaagtaag

SEQ ID NO: 405632 - DNA, 570 bp, Homo sapiens
  misc_feature: GZ8MTXP01B9PIA.21.67.G01.1.454.CMB.2.raw
  modified_base (392)..(392): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggccccttggacaagggcttggagtggatggggatggggccgaccttcgacaacggaaagatgggagtatggtcaggatttcgagggcagaattaccttgaacccacngactcatccacgggcacagcctacttggaactgaaggaacctagacgaatggacgacacgcacatattatgtgcgcgaggtggggctagttgtagactactaatatttattacttcgttggtacgttcgttggggacaaaggggtccaacggtctaccgttcctccccgaagtccccg

SEQ ID NO: 405633 - DNA, 623 bp, Homo sapiens
  misc_feature: GZ8MTXP01CV3BL.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcaggttgggtgcgacaggcccttggacgaagggcttggagtggatgggatcggggccgaccgttcgacgaaacggaaagagtaggagtagtggtacaggtatttcgaggcaagtaattacctacgaaaccacaagactcactccgacgggcacgacgtcctacgtaggaactggaacggaacctaggacgaagtcggacgacgacggaccacagttaacttagttcgcgcgcggaggtcggggactagtttgagtaccttagtaacttattatttacgttgttaggtcgttcggttggggttacaaacgggtacccgtaacggtccacccgttcctccccgaaggtcccccg

SEQ ID NO: 405634 - DNA, 668 bp, Homo sapiens
  misc_feature: GZ8MTXP01DJMR1.21.67.G01.1.454.CMB.2.raw
  modified_base (242)..(242): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctntggttactagtttttccgactatagtatcaggttgggtgcgacaggcccttggacaagggctgagtggatgggatggggccacttcgacaaacggaaagagtgggagtaagtggtacaggtaatttcgaaggggcaaggtaactttaccttaggaaacccaacgaagactcaacgtcccgaacggggcacacgaccctacgttagggaactggaacggaaaccctaggaagaagtaagacgaacgacggaccactattaattagttgtgcgcggaggtagggggactagttgtagtactaacgttaacttaagtttatttacgtttcgttacgggtacgttaccggttgggggttacctaaaacgggggtaccctaaccggggttacccaccccggttaccctaacccccgaacggtaaccccccg

SEQ ID NO: 405635 - DNA, 806 bp, Homo sapiens
  misc_feature: GZ8MTXP01BVWV4.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatctaggttgggtgcgacaggccccttgggacaagggtcttggagtggagtggggagtcggggacccgtaccgttcggacgaaacgggaaagagtagggaggttatgggttacaaggtaatttcgaacgggtctaagtaaactttacccgttacggaaaccctaacgaacggacctaccgaaacgtaccccgaacgggggtaccaaaccgtaccggtacccttaacgttacgggtaaacgtacgggtaaacggtaaacccgttaggaaacggtaacggttaacgggaacccgaaccgtaaccggggacccaaacgtaagttaagtttaacggtttggtacgggtacggtaccggtaaggggttcgggggtaccttaaggtttacggtaacggtaaccttaaacgttaactttaaagtttacgttttaaaccgtttcggttagggtaccggtttaccggttacgggggttacgtaaaacgggggtacccgtaacgggttacccgacccggttacccgtccccgttaacgtaacccccg

SEQ ID NO: 405636 - DNA, 577 bp, Homo sapiens
  misc_feature: GZ8MTXP01BN605.21.67.G01.1.454.CMB.2.raw
  modified_base (385)..(385): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcatggcctctggttacagtttttccgactatagtatcagttgggtgcgacaggcccttggacaagggcttgagtggatgggatgggccgaccttcgacaacggaagagtggagtagtggtcaggtatttcgagggcagaattacctagaccncagactcactccgacgggcacacgcctactggaactgaggaacctgagaagtggacgacacgacacgtatagttatgtgcgcgagtgggggctagttgtagacgtaactaacgttattacttacgttcgttggttacgttcgttggggaactaacgggtaaccgacgggtccaccggtccttccccgtaacg

SEQ ID NO: 405637 - DNA, 662 bp, Homo sapiens
  misc_feature: GZ8MTXP01CGD32.21.67.G01.1.454.CMB.2.raw
  modified_base (405)..(405): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgactatagtatcagttgggtgcgacacggcccttggacgaagggcttggagtggagtgggagtcggggccgtacgttcgacgaacggaagagtgggagtagtggtcgaggtatttcgagggcagtaattacctgaaacccacngactacacgtccgacgggcacgacgtcctacgtaggaactaggaacggtaactagaacgaagtcggaacgaacgaaccggaccaacgtagttaatttagttcgtacggacgacggtaggtgggggtactagtttaggtaacgtacttaacgttaacttaatttactttacgttcgttacggtacggttcggttcggggacgtaaacgggtacccgtaacgggttcctacccggttcccttccccgaacgtaaccccg

SEQ ID NO: 405638 - DNA, 635 bp, Homo sapiens
  misc_feature: GZ8MTXP01EV6Z3.21.67.G01.1.454.CMB.2.raw
  modified_base (509)..(509): a, c, t, g, unknown or other
  modified_base (525)..(525): a, c, t, g, unknown or other
  modified_base (531)..(531): a, c, t, g, unknown or other
  modified_base (628)..(628): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggccttcgtggttactagtttttccgacttatagtatcgaggttgggtgcgacaggcccttggacaagggcttgagtggatgggatggggccgaccttcgacgaaacggaaagagtgggagtagtggtacaagggtaaatttcgaaggggtacaaggtaaactttaccgttacgaaacccaacgaagactacactccgaacggggcacgacgtacctacgttaggaacgtgaaggaacctaggaagaagagggaacgaacgacggacctaanaagttatttaagttgngacggnggaaggtgggggatagttgtagtactactaattattattacttgttaggtacgttcgttggggacaaacgggctaacgggtcacccggttcctcccncgaaccc

SEQ ID NO: 405639 - DNA, 730 bp, Homo sapiens
  misc_feature: GZ8MTXP01AE5IV.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcagggcctcgtggttactagtttttccgactatagtatcgaggttgggtgcgacaggcccttggacaagggcttgagtggatgggatgggccgacgttcgacgaaacggaaagtgtggagtagtggtacaggtaatttcgagggacagtaacttacctgaaaccacgaagactacagtcccgacggggcaacgacgtccctagttcggaacgtggaacggaacccgtaggaagtaagtcgggaaccgaacgaccgggaccctaacaacgttaagtttaacgttggtcggtaccggtaccgggtagggtacgggggtacttaaccggtttaggtaacggtaaccgttaacgttaacgtttaactttaacgtttaacgtttaccgtttacggggtaaccggttcgggttcgggggaaccgtaaaaccgggggtaccgtaacccgggttaccgtaccccgggttacccctaacccccgttaaccgggttaaccccccg

SEQ ID NO: 405640 - DNA, 725 bp, Homo sapiens
  misc_feature: GZ8MTXP01B8QAU.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctggtgaaggtctcctgcagggcctgtggttactagtttttccgactatagtatcgagttgggtgcgacaggcccttggacaagggcttggagtggatggggagtcggggacctaccgttcggacgaaacggaaagagtgggagtagtggtacaggtatttcgacgggacagtaacttaccgttagaacccaacgaagactacacgtcccgacgggtacacgacgtccttaacgttaggaacgtaggaacggtaaccgtagaagaacgtacgggaacgacgaaccggaccaaacgtagttaaacgtttagttggtacggcggtagggagggtgggggtaccgttagttttacgggtaaacgttaccttaacgttaaactttaacttttaacgtttaccgtttacggttacgggtacgtttacgggttacgggggttaacggtaaaccggggtacccgtaacgggttacccgtaccccggttccctaaccccggttaaccgtaacccccg

SEQ ID NO: 405641 - DNA, 646 bp, Homo sapiens
  misc_feature: GZ8MTXP01DMDF5.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagaagccgtggggcctcggtgaaggtctcctgcagggcctcgtggttactagtttttccgactatagtatcgtagttgggtgcgacaggcccttaggacgaagggctttaggagtggagtggggatcggggcccgtaccttcggacgaaacgggaaagagtgggaagtagtggtacaggtaatttcgagggcaagtattacctgaaccacaagactcgaactacccgacgggcaacacgtccgttaagttacggaactaggaacggaaaccgtagaagaagtacggacgaaacgacggacctaacattaagttagtagtcgacgcggaggtggggattagtttgtaagtactaacttaattatttatttacttcgttgggtacgttggttggggaacgaaacggggaccgaacggtcacccggttacctccccgaagtccccg

SEQ ID NO: 405642 - DNA, 753 bp, Homo sapiens
  misc_feature: GZ8MTXP01EH69Q.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctctgcagggcctctggttactagtttttccgactatagtatcagttgggtgcgacaggcccttggacaagggcttggagtggagtggggagtcggggcccgtaccgttcggacgaaacggaaagagtagggagtagtggtactaaggtaaatttcggaaggggacaaagtaaactttaccgttaggaaaacccacgaacggaaccttaccgaacttaccccgaacgggggtaccaacgtacggaccctttaacgttacgggaaacttacgggaaacgggaaacccgttaagggaaacggttaaagtacggggaaaccgaaacccgtaaccgggaaccctaaactaacgggtttaaatttaaggttgtacggacggaccggtagggtgggggtaacctagtttaggtaacgtaacttacttaaacttatttagtttacgtttacgttagggtaccgttcggttgggggaacgtaaacggggcctaacggggttccacccggttcctaaccccgaacgtaaccccg

SEQ ID NO: 405643 - DNA, 619 bp, Homo sapiens
  misc_feature: GZ8MTXP01CGBK3.21.67.G01.1.454.CMB.2.raw
  modified_base (407)..(407): a, c, t, g, unknown or other
  modified_base (496)..(496): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatcagttgggtgcgacaggccccttggacaagggcttggagtggagtggggagtcggggccgaccgtttcgacgaaacggaaagagtgggagtatggtacaggtatttcgagggtcagtaattacctgaacccangactcatccgacgggcacagccctacgttaggaactggaacggaaccgtagagaagtggacgacgacggacacgatattagttgtgcgnggacggtggggctagttgtagtactacttaacttatttattacttgttacggtacgttcggttggggacgtaaacgggacccgtaacggtccctaccggttacctccccgaacgtaacccccg

SEQ ID NO: 405644 - DNA, 575 bp, Homo sapiens
  misc_feature: GZ8MTXP01BRVRY.21.67.G01.1.454.CMB.2.raw
  modified_base (386)..(386): a, c, t, g, unknown or other
  modified_base (447)..(447): a, c, t, g, unknown or other
  modified_base (451)..(451): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatggggccgacttcgcaacggaagatggagtagtggtcaggatttcgagggcagtaattacctgaaccacngactcatccagggcacagcctatgactgagactgagatggacgacacgcacgatattatgngcgngaggtggggactagttgtagtactagtaacttagttatttacttcgttaggtacgttcggttggggttacgtaaaggggcccgtaacggtccgaacccggttcctaaccccgaacggtcccccg

SEQ ID NO: 405645 - DNA, 867 bp, Homo sapiens
  misc_feature: GZ8MTXP01AG0KB.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgacttatagtatcgagttgggtgcgacaggcccttggacgagggctggagtggagtgggagtcggggccgaccgttcgacgaaacgggaaagagtagggacgtagtggtacgaaggtaagtttcgaggggtacaggtaactttacccgttagaaaccctaacgaacgacctaccgaacgtaccccgaacgggtaccaaacctacggtacccttaacgttacgggaaaccgttagggaaaccgggtaacccgtagggaaacggtaagttaacggggaaacccgaacccggaacccgggaccctaaaccgttaaacggtttaaagttttacggttacgggtacgggtaccggggtaacggggtacgggggttacggggggttaccgtttaagttttaacgggttaaacggttaaaccctttaaacggttaaaccgtttaaatttttaaacgttttaaccggtttttcggtttaccggggtaaccggggtttaccgggttaggggggttaacccgttaaaacccggggggtaccccgtaacccgggtttaccccgtaaccccgggtttaccccgttaaccccccggttaacccggttaacccccccggg

SEQ ID NO: 405646 - DNA, 719 bp, Homo sapiens
  misc_feature: GZ8MTXP01DMKBH.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgacttatagtatcgagttgggtgcgacaggcccttggacaagggcttgagtggatgggatgggccgtacgttcgacgaaacggaaagagtggagtagtggtacaaggtaatttcgagggactagtaactttacccgtagaaaccctaacaacgtactcaacgtacccgaccggggacaacgacgtacccttaacgttacgggaaactggaaacggtaacccttaggaaagtaagtacgggaaccgaaccgaacccgggacctaacgtaaagttaagtttaacgttaggttcgaccggacggtaaggggttcgggggtaccttagttttaggtaacggtaaccttaacgttaacctttaatttacgtttactttcgttacgggtacggttcgttggggaccgtaaaacggggcccgtaaccggtccgacccgttccctaacccccgaacgtaacccccg

SEQ ID NO: 405647 - DNA, 610 bp, Homo sapiens
  misc_feature: GZ8MTXP01D2HBI.21.67.G01.1.454.CMB.2.raw
  modified_base (395)..(395): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcgagttgggtgcgacaggcccttggacaagggcttgagtggagtgggatggggccgtaccgttcgacgaaacggaaagagtgggagtagtggtcaggtaattcgaggcagtattactgaaccangactcactccgacgggcacgagcctacgtaggaactgagacctagagaatacggacgacgacggcacgatacttagtcgtgcggtcgaggtgggggtactagtttacggtacgtacttaacgttaacttatttagtttactttcgtagggtcgttacggttggggacgtaaacgggaccgtcggtaccgacccgttacctccccgcgtaaccccg

SEQ ID NO: 405648 - DNA, 791 bp, Homo sapiens
  misc_feature: GZ8MTXP01B15WC.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctggaggtagaagaacgccgtggggcctcggtagaaggtctcctgcgagggcctcgtggttactagtttttccgattatagtactacgtaggttggtcgcgacgacggtcccgttaggacgtaagggtcttaggaggtggagtgggagtcgggacccgtacgttcgacgaaacgggaaagtcggtagggtaagtaggtcggtaacgaagggttaactttccggaagggtacctaaagtaaaccgtttacccgtacgtaaacccaacgtaacggtacctacgtaacgtaccccggaacgggaccaacgaccgtcccttaagtacgggaactggaacgtaacgtagaagtaagtcggaaccgacgaccgacaactaagttacgtttaggttacgcggaccggtgggtaaggggttcgggggtaactttaggtttacgggtaaactaacccgtttacttaaactttaacttttaacggtttaccgttttcgggtaagggtaccggtttaccggggttacggggaaacccggtaaacggggttaccccgtaacggttccccgggtaacccttccccgtaaccccggttaacgtaacccccgg

SEQ ID NO: 405649 - DNA, 729 bp, Homo sapiens
  misc_feature: GZ8MTXP01AXRGY.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactccccagactcaactggtgcagtctggacctgaggtgaagaagcctggggcctcggtgaaggtctcctgcagggcctgtggttacttcgttttccgactagtagtatcgtaggttgggtgcgacgacggtcccgtaggaacgaaggtcgttggaggtggaggtgggagtcgggccgtaccgttcgacgaaacggaagagtgggtagtagtggtacgtaggtattggacggactaagtaactttaccgtacgaaacctacgaacgtactacgactcccgacgggacaacgacgtacccttagttacggaacgtggaaacggtaacgtaggaaacgtagtacgggaacgaaccgaccggaccaacgtagttaagtttacgtaggtcggacggtcggtaaggggtggggtacttaggtttagtaacgtaacttaacttaagtttaactttaacgtttaccgtttcggtacgggtaccggtttacgggttccggggttaaacgggtaaaccgggtacccgtaaccggtacccgtacccggttcccgtaaccccgttcggtaacccccg

SEQ ID NO: 405650 - DNA, 772 bp, Homo sapiens
  misc_feature: GZ8MTXP01ERN5A.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctctgcgagggcctcgtggttactagttttccgactatagtatcaggttgggtgcgacaggcccttaggacgaagggcttggaggtggagtgggagtcggggcccgtaccgttcgacgaaacgggaaagagtagggaagtagtggtacgaaggtaactttcggaacgggctaaagtaactttaaccgttacggaaacccaacaacgactacgaacgtacccgacggggaccacgtacgtaccttacgttacggaaactaggaacggtaaccgtaggaaacgaagtacgggaacgaccgaccgggaccaacgtaatttaacgtttagttacggtacgaccggtagggtaacggggtcgggggtaacttagttttacggtaacgtaaccgtttaacgttaaacgtttaattttaacgtttaccgttttacggttacgggttaaccgggtttacgggttacgggggttaaccgtaaaaccgggggtcccgtaaaccggggttcccgtaaccccgggttaccctaacccccgttaacggtaacccccg

SEQ ID NO: 405651 - DNA, 896 bp, Homo sapiens
  misc_feature: GZ8MTXP01B8VG4.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggggcctctggttactgtttttccgactatagtatcagttgggtgcgacaggccccttggacaagggctgagtggatgggatcggggccgacgttcgcgaaacggaaagagtagggagtaagtgggtacgaaggtaaagttttccgaaggggacaaggtaaattttaaccccgttaggaaaccctaaacccgaaggtaaccctttaccgaaacgttccccgaaaccgggggaccaaaccgaacgggacccctttaaacgtttaccgggggaaaacttacgggaaacgggaaaaccccgttaggaaacggaaagttaccgggggaaaccggtaaaccgaacccgggggtaacccaaaccgtaaacggtttaaactttttaaacggttttgggtaacgggtccgggtacccgggaacggggttagggggggggtaccctaacggtttttaagggtaaacgggttaaaccccgttaaagtttaaaccccgttttaaacgttttaaatttttaaaccggtttttacccggtttagggggttaaaaccgggtttccgggtttacggggggggttaaaccaaaaacgggggtaacccccggtaacggggttaccccgtaaacccccggggttccttaacccccccggaaacggttaaccccccccgg

SEQ ID NO: 405652 - DNA, 601 bp, Homo sapiens
  misc_feature: GZ8MTXP01BH5Y5.21.67.G01.1.454.CMB.2.raw
  modified_base (394)..(394): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatggggccgaccttcgacaaacgggaaagagtgggagtagtggtcaggaatttcgagggcagaattaccgtgaaccacngactcatcccgacgggcacgacgcctacgttggaactggaaggaacctagaagaagtaggacgacacggaccacgatattatgtgcgcgaggtggggactagttgtagtactactaacgttattattacgttcgttaggtacgttcggttggggaccgtaaagggccgtaacggtaccgacccgttccgtaaccccgcgtaaccccg

SEQ ID NO: 405653 - DNA, 623 bp, Homo sapiens
  misc_feature: GZ8MTXP01ADQG2.21.67.G01.1.454.CMB.2.raw
  modified_base (468)..(468): a, c, t, g, unknown or other
  modified_base (481)..(481): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaaacaggtgcccactcccagactcaactggtgcagtctggacctgaggtgaagagccgtggggcctcggtgaaggtctccgtgcgagggcctctggttactagtttttccgactatagtatcgagttgggtgcgacaggccccttggacaagggcttgagtggatgggatggggccgacttcgcaacggaagatgggagtatggtacaggtaatttcgagggcaggtaattaccgtgaaaccacaagactcatcccgacgggcacgacgcctacgttggaactggaggacctagagaagtcggacgacacggacanacgttatagttgngcgtcggaggtgggggtactagtttgtacgtaactacgttaactagtttaattacgtttcgttagggtacgttcggttggggacgtaaacggggacctaaccgggtacctacccggttccttaaccccgaacgtaacccccg

SEQ ID NO: 405654 - DNA, 593 bp, Homo sapiens
  misc_feature: GZ8MTXP01BV7B3.21.67.G01.1.454.CMB.2.raw
  modified_base (278)..(278): a, c, t, g, unknown or other
  modified_base (382)..(382): a, c, t, g, unknown or other
  modified_base (460)..(460): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggngcgacaggcccttggacaagggcttgagtggatgggatgggccgaccttcgcaacggaaagatgggagtatggtcaggatttcagggcagaatactgaaccacngactcatccgacgggcacagcctattggaactgagaacctagacgaatggacgacacggcacgatattatgtgcgcgnggtgggggctagtttgtagtactacgtaacttatttattacttcgttacgggtacgttccgttgggggacgtaaaacggggtacccgtaacgggtccgtacccggttccctaaccccgttaacgtaacccccg

SEQ ID NO: 405655 - DNA, 621 bp, Homo sapiens
  misc_feature: GZ8MTXP01EINWP.21.67.G01.1.454.CMB.2.raw
  modified_base (392)..(392): a, c, t, g, unknown or other
  modified_base (406)..(406): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagctggggcctggtgaaggtctcctgcagggcctctggttacagtttttccgactatagtatcagttgggtgcgacaggcccttggacaagggcttgagtggatgggatggggccgacttcgacaaacggaaagagtgggaagtagtggtacaggtaaatttcgagggcagaattacctgaaccacngactcatcacgggnacagctactggaactgaggaactagagaatggacgacgacggacaacgagttaatttaagttgtagcggcgaaggtgggggtactagtttgtaagtaacgttaacttaaacttaatttaaactttaacgtttcgttacgggtaacgttcggttggggacgtaaaaggggacccaacgggttcaacccggttccgttaaccccaacggtaaccccg

SEQ ID NO: 405656 - DNA, 707 bp, Homo sapiens
  misc_feature: GZ8MTXP01EUHUL.21.67.G01.1.454.CMB.2.raw
  modified_base (219)..(219): a, c, t, g, unknown or other
  modified_base (296)..(296): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagagcgtgggcctggngaggtctcgtgcgaggtctgtgttactgtttcgatatagtatgtaggtggtgacgacgcggccgtaggacgtaggtntggagtggaggtgggagtcgggaccgtacgtacgacgaaaggagtagtggtagtagtggtacgtaaggtaagtcggaggtactaaagtacgttaccgtacgaaaccaacgtcgtactaccgtaacgtaccggaccgggacaaccgtaccgtacgttaagtacggaaacgtaggtaaaccgaacgttaaggaacggtaaggaccggaaccaccggtacgaactaagttaggttagtttacggtgggacgcggtgggagggttgtacgttaagttagaacgttaaccttattaacttttaacggtttacttacgttttaggggaccggtaacggttcgggggaacgggttaaacggtaacccgggtacccgttcgtaacccgtcccgttaccctcccgttaacgtaacccccg

SEQ ID NO: 405657 - DNA, 635 bp, Homo sapiens
  misc_feature: GZ8MTXP01EDP3G.21.67.G01.1.454.CMB.2.raw
  modified_base (242)..(242): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctntggttactagtttttccgactatagtatcagttgggtgcgacaggcccttggacaagggcttgagtggatgggatgggccgacgttcgacaacggaaagagtgggagtagtggtcaggtatttcgagggcagtaattaccgttgaaacccacgaagactacagtcccgaacggggcacgagaccctacgttaggaactggacggaacctaggagaagtgggaacgacgacggaccacagttattagttgtagcgcggtaggtgggggactagtttgtagtaacttactaacttatttaatttacgtttcgttagggtacggttcgttgggggacgtaaaaggggtacccgtaacgggtaccctaccggttcctcccccgaacggtaacccccg

SEQ ID NO: 405658 - DNA, 614 bp, Homo sapiens
  misc_feature: GZ8MTXP01D6RWC.21.67.G01.1.454.CMB.2.raw
  modified_base (279)..(279): a, c, t, g, unknown or other
  modified_base (407)..(407): a, c, t, g, unknown or other
  modified_base (607)..(607): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggngcgacaggccccttggacaagggcttggagtggatggggatggggcccaccgttcgacgtaaacggaaagatgggaagtagtggtcaaggtaaatttcgaaggggcaagtaattaccctgaaacccancgactcagtccgacgggcacgagcctagttggaactggaagaacctagacgaagtcggacgacgacggaccaacgattacttagttgtacgcggtacgagggtggggactagtttgaagtacttataacttagttattacttcgttaggacgttcgttggggacctaaaagggcctaacggtcacccgttctaaccccgnggtcccc

SEQ ID NO: 405659 - DNA, 601 bp, Homo sapiens
  misc_feature: GZ8MTXP01A8KJZ.21.67.G01.1.454.CMB.2.raw
  modified_base (387)..(387): a, c, t, g, unknown or other
  modified_base (469)..(469): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggccccttggacaagggcttgagtggatggggatggggccgacttcgcgaacggaaagatgggagtatggtcaggatttcgagggcagaattacctgaaccangactcatccacgggcacagcctacttggaactgaaggacctagagaatggacgacgacggacacgatattagttgtgcgcgnggtgggggctagttgtagtactaataacgtaatttatttaacgttcgttagggtacgttcgttgggggttacgtaaaacgggggacctaaccgggttccaacccggttcctaacccccgaaggtaacccccg

SEQ ID NO: 405660 - DNA, 741 bp, Homo sapiens
  misc_feature: GZ8MTXP01BKD8W.21.67.G01.1.454.CMB.2.raw
  modified_base (218)..(218): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagagcgtgggctggngaggtctcgtgcgaggcctgttggttactagtttttccgattatagtatcgtaggttgggtgcgaacacggcccgttagggacgtaaggggtcttaggaggtggagtggggagtcggggccctacgttcggacgaaacgggaagtagtagggagtagtggtacgaaggtaatttcggaaggggctaaggtaacttccgtaggaaaacaacgaagtactccgaactacccgacgggacctaacgacgtaccttacgttaacggaacgtaggaacggaaaccgtaggaacggtaagtacgggaaccgaacgaccgggacctaacgtaagttaagtttaagttcggtacggacggtaccgggtaggggtaccgggggtacttaggtttacggtaacgttaacttaacgttaactttaacgtttagtttacgtttacgttacgggtaacgttcgggttacggggaacgtaaacgggtaccggtaacggttccgtaccgttacccgtaaccccgttaacgtaaccccg

SEQ ID NO: 405661 - DNA, 816 bp, Homo sapiens
  misc_feature: GZ8MTXP01BN7W2.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttgggtgcgacaggccctggacaagggcttgagtggagtgggatcggggccgaccgttcggacgaaacggaaagagtgggagtagtggtacgaggtaatttcgaaggggcctaaggtaaactttacccgttacgaaacccaacgaagtaacctaccgaagtaccccgaccgggggacaacgacgtacccttaacgttacgggaaacgttacgggaagggtaaacccgtagggaacggaaacgtacggggaacccggaaccgtaaccgggtaacccgaaacctaacgggttaaacttttaagtttacggttcggaccggaccgggtaaggggttacggggggtaccttaaaggttttggtaaacggttaaaccgtttaaccttaaaccgtttaagttttaaacttttaaaccgttttacggtttacggggtaaccggtttacggggttacgggggttaaaccggtaaaacgggggtaccccgtaaccggggttaccccgtaaccccggttcccgttaaccccccgaaccgggttaaccccccg

SEQ ID NO: 405662 - DNA, 704 bp, Homo sapiens
  misc_feature: GZ8MTXP01A724E.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcagggcctgtgtactgttcatatagtatcgtaggttggtgcgacgacggtccgttaggaacgtaagggtcttaggaggtggtagtgggagtccggggacccctacgttcgaacggaaacggaaagtgtagggtagttacggtggtacgaaggttaagttaccggagggactaaaggttaacttaccgttacgaaaacctaacgaacgtactaccgacgtacccggacgggacaacgtaccgtaccttaagttaacgaacgtaggaaaccgtacgtagagaagtcggaacacgacggacaacgtattacttaggttgcggacgtacggagggtcggggtaacttagtttacggtaacgtaacttaacttaagttatttacgtttctttcggtacggtacgttgggttcggggaaaccgtaaccgggtactaaccgggtaccctaccccgttcctaaccccgcgtaacccccg

SEQ ID NO: 405663 - DNA, 656 bp, Homo sapiens
  misc_feature: GZ8MTXP01BS0W1.21.67.G01.1.454.CMB.2.raw
  modified_base (494)..(494): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatcgaggttgggtgcgacaggcccttggacaagggcttgagtggatgggatgggccgtacgttcgacgaaacggaagagtgggagtagtggtacaggtaatttcgaggggacagtaacttaccgtagaaacccacaagactcacgtccgacgggcacgacgtcctagtaggaacgtgaacgactagagagtggacgacgacggacaacgtattattagttgngcgcggagggtggggtactagtttgtaagtacgttactaacgtttatttaactttacgtttcgtttacgggtacgttacgggttacgggggaccgtaaaacggggtaccccgtaacgggttacccgaccccggttacccgtaacccccgaacgtaacccccg

SEQ ID NO: 405664 - DNA, 761 bp, Homo sapiens
  misc_feature: GZ8MTXP01BT0G5.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgccccactcccagactcaactggtgcagtctggacctgaggtgaagaagccgtggggcctcggtgaaggtctcctgcaggggcctctggttacagtttttccgactatagtatcagttgggtgcgacaggcccttggacaagggctgagtggatgggatggggccgacttcgacgaaacggaaagagtgggagtagtggtacaggtaatttcgaaggggcaaggtaacttaccgttgaaacccacaagactacagtcccgaacggggcaacgacgtccctaacgttacggaaacttaggaacggaaacccgttaggaaggtaaacgtagggaaccggaaccgaaccgggaccctaaaccgtaagtttaaacttttaacgtttgggttacggtccgggaccggtaaggggttcggggggtaccttaaggtttcgggttaaacggtaaccctttaacggttaaacctttaattttaacgtttaaaccgttttcgtttacggggtaaccgtttacggtttcggggggaaccgtaaaacgggggtacccgtaaccgggttacccgtaaccccgggttcccttaacccccggaacgttaaccccccg

SEQ ID NO: 405665 - DNA, 572 bp, Homo sapiens
  misc_feature: GZ8MTXP01C6XBH.21.67.G01.1.454.CMB.2.raw
  modified_base (344)..(344): a, c, t, g, unknown or other
  modified_base (386)..(386): a, c, t, g, unknown or other
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggggcctctggttacagtttttccgactatagtatcagttgggtgcgacaggccccttggacaagggcttgagtggatggggatggggccgacttcgcaacggaaagntggagtatggtcaggatttcgagggcagattacctgaaccangactcatccacgggcacagcctactggaactgaggaacctgagaatggacgacacggaccacagtacttattgtgcgcgaggtgggggctagtttgtagactactaactattattaacttgttaggtacgttcgttggggcaaacggggacctaacgggtcaccggttctccccgaacggtccccg

SEQ ID NO: 405666 - DNA, 719 bp, Homo sapiens
  misc_feature: GZ8MTXP01BWK38.21.67.G01.1.454.CMB.2.raw
  modified_base (183)..(183): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtncagtctggacctgagtgaagagcgtggggcctcggtgaagtctctgcgaggtcctgtggtactacgttttccgatagtagtactcgtaggttggtgtacgacgacggtccgttaggaccgtaagggtcttaggaggtggtagtggggagtcggggaccgtaccgttacggaacgtaaacggaagtagtagggtaagtaggtaggtacgtaaggtaacgtttccggaagggtacgaaaggttaaacgtttaccgttacgaaacccgtaacgtaaggacccttaacaccggttaccccggaacggggtaccaaacggaccgttacccttaaggttacgaaacgttggaaacgaaaccgtggaaaggtacgacgggaaccgacgaacgtactaacgtatttaagttagtacgtgccggtaaggacgggtggtacttagttggaactacgttaactaattatttagttacgttgtggtaaccgttggttacgggaacaaacgggtccaacggttacccgacgttacctccgaacgtcccg

SEQ ID NO: 405667 - DNA, 633 bp, Homo sapiens
  misc_feature: GZ8MTXP01AXWHC.21.67.G01.1.454.CMB.2.raw
  modified_base (624)..(624): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcgagttgggtgcgacaggccccttggacaagggcttgagtggatgggatggggccaccgttcgacaaacggaaagagtgggagtagtggtacaggtaatttcgaggggcagtaattacccgttagaaacccacgaagactaccgatacccgacggggacacgacgtacccttacgttaggaacgttgaacggaaccctaggaagaacgtacggaacgacgacgggaccacagttaattagttgtgcgcggtaggtgggggtactagtttgtaagtactacgtaacttatttattacttgtacggtcgttgttcggggacaaagggaccaacgggtccaccggttcctccccgngtaaccccg

SEQ ID NO: 405668 - DNA, 727 bp, Homo sapiens
  misc_feature: GZ8MTXP01DEM32.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcaggttgggtgcgacaggcccgttggacgaagggtcttggagtggagtgggagtcggggcccgtaccgttcgacgaaacgggaaagagtagggagtagtggtacgaaggtaatttcgacgggcaagtaacttaccgtacgaacccacaagtactaccacgtcccgacgggacacgacgtacccttacgttaggaacgtaggaacggtaaccgtaggaagaagtacgggaaccgaacgaccggaccaacgtaagtttaacgttagttggtaggcggtcggtagggtgggggaccttagtttaggtaacggtaacttaacgttaacgttaattttaacgtttaccgtttcgtttacggggtacggtttcgggttacgggggttaaacgtaaaccgggggtaaccctaaccgggttacccgtaccccggttacccgtaacccccgaacgtaaccccccg

SEQ ID NO: 405669 - DNA, 684 bp, Homo sapiens
  misc_feature: GZ8MTXP01EM5GU.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgactatagtatcagttgggtgcgacaggccccttggacaagggcttggagtggatggggatggggcccgtaccttcggacgaaacgggaaagagtgggagtagtggtacaagggtaatttcgaggggcaaggtaattacccgttgaaacccacgaagtacctcaacgtccgaacggggcacgagcccttagtaggaacgtggaacggaaccttaggaagtaagtcgggaacgaccgaaccgggaccaaaccgaatttaagtttaaagtttggtcggaccggaccggagggttgggggactaggtttgtaagtacttaacgtaacttaagtttattacgttttcgttaggtacgttcggttcggggaacgtaaacggggacctaacgggttccacccggttcctaacccccgaaggtaacccccg

SEQ ID NO: 405670 - DNA, 748 bp, Homo sapiens
  misc_feature: GZ8MTXP01EFWWH.21.67.G01.1.454.CMB.2.raw
  modified_base (285)..(285): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcagggccttcgtggttactagtttttccgacttatagtatcaggttgggngcgacgaggcccgttggacgaagggtcttggaggtggagtgggagtcggggccgtaccgttcgacgaaacggaaagagtagggagtagtggtacgaaggtaagtttcgacgggactaaggtaacttacccgttaggaaaccctaacaacggtacctactaacgtcccgaacggggtccaacgacgtaccctaacgttacggaaacgttaggaacggaaccgtaaggacggtaaagtacgggaaccgaccgaaccgggaaccaacgtaagttaattaaggttcgtaggacggacggtaggggttacgggggtacttaggtttaggtaacggtaaccttaacgttaaacttatttaacgtttaaaccgtttcgttacgggttacggttaccggttagggggttaaccgtaaacggggacccgtaacggtaccgtacccggttcctaaccccgaacgtaacccccg

SEQ ID NO: 405671 - DNA, 599 bp, Homo sapiens
  misc_feature: GZ8MTXP01BSHM2.21.67.G01.1.454.CMB.2.raw
  modified_base (338)..(338): a, c, t, g, unknown or other
  modified_base (591)..(591): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagctggggctggtgaggtctctgcagggcctctggttactagtttttccgactatagtatcagttgggtgcgacaggcccttggacaagggcttgagtggatgggatggggccgacgttcgacaaacggaaagngtgggagtagtggtcaggtatttcgagggcagtaattaccttgaaccacgaagactcgaatccgaacggggcacgacgtcctacgttaggaactggaaggaacctaggaagtaagtagggacgacgacggacaacagtacttagttgtcgacgcggaggtgggggactagttgtagtactagtaattactttagttacttgttggacgttcggttggggacgtaagggaccaacgggtcaccgttctccccgngtaacccc

SEQ ID NO: 405672 - DNA, 726 bp, Homo sapiens
  misc_feature: GZ8MTXP01DC05E.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagaagccgtggggcctggtgaggtctcctgcgagggtcctgtggttactagttttccgattatagtatcgaggttgggtgcgacaggccccttggaacgaagggtcttggaggtggatggggatcggggacctaccgttcgacgaaacgggaaagagtgggaagtagttggtacgaaggtaatttcgaagggactaagtaacttaccgttgaaacccacgaagactacaagtcccgaacggggacaacgacgtaccgttaacgtaggaaacgtgggaacggaaaccgtagaagtaagtacgggaacgaccgaacggaccaacgtaattaagtttagttcggtcgacggcggtaggggtcgggggtaatagttttagggtaactaacgttaacttaaactttaatttaacgttttaccgtttacggttacggtacggttcggttacgggggttaaaccgtaaaacgggggaacccgtaaccgggttaccctaccccggttaccctccccgaacggtaacccccg

SEQ ID NO: 405673 - DNA, 708 bp, Homo sapiens
  misc_feature: GZ8MTXP01D7D3L.21.67.G01.1.454.CMB.2.raw
  modified_base (396)..(396): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctgtggttactagtttttccgactatagtatcagttgggtgcgacaggccccttggacaagggcttggagtggatgggatggggccacttcgacaaacggaagatgggagtagtggtacaggtaatttcgagggcagtaattaccttgaaacccanaagactcactccgacggggtacacgacgtaccttagttacgggaactcgggaacggtaaacccgttaggaacggtaaagttacgggaaccgaaccgaaccgggacccaacgtaaggtttaatttaacggtttgacggtacggacgtaggggttgggggaccttagtttggtaaacggttaccttaacgttaactttaatttaacgtttaccgtttcggttacgggtacgttaccggttgggggaacccgtaaaaggggcccgtaacgggttcccgaacccgggttccctaaccccggttaacgtaacccccg

SEQ ID NO: 405674 - DNA, 708 bp, Homo sapiens
  misc_feature: GZ8MTXP01B5GDL.21.67.G01.1.454.CMB.2.raw
  modified_base (286)..(286): a, c, t, g, unknown or other
  modified_base (640)..(640): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctcggtgaaggtctcgtgcgagggcctcgtggttactagtttttccgatatagtatcaggttggtgcgacnggccccttaggacaagggtcttggagtggatgggatggggcccgtacgttcgacgaaacggaaagtagtagggaagtagtggtacaaggtaagtttcgaaggactaagtaaacgtttacccgttaggaaaccctaacgaacggtaacctacgtaaacgtaccccgaacggggaccaaacgacgtacccgttacgttacggaaaccgtaggaacgggtaacctaggaagaagtacggaacgacaaccggaccaagtaattaagtttaagtcggtgaccgaggaggtggggtactagtttcgaagtacctaagttaactagtttaactttacgttcgttacggacgtttaccgggngggaaaccgtaaagggggtacccctaagggtacccgtaccggttcccctaaccccggccgtaaccccg

SEQ ID NO: 405675 - DNA, 576 bp, Homo sapiens
  misc_feature: GZ8MTXP01A9A60.21.67.G01.1.454.CMB.2.raw
  modified_base (568)..(568): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttacagtttttccgactatagtatcagttgggtgcgacaggcccttggacaagggcttgagtggatgggatggggccgacttcgcaacggaaagatggagtatggtcaggatttcgagggcagaattacctgaaacccacaagactcatcccgacggggcacgtagccctacttcggaactggaggaaccctagaagaatagggacgacgacgggaccaacagtattagttgtcgcgcgaggtgggggcattgagactataactattattacttgttggacttcgttgggacaaggggaccaacggtcaccgttctccccgngaaccccg

SEQ ID NO: 405676 - DNA, 617 bp, Homo sapiens
  misc_feature: GZ8MTXP01EFDKB.21.67.G01.1.454.CMB.2.raw
  modified_base (610)..(610): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgacttatagtatcgaggttgggtgcgacaggcccttggacaagggcttggagtggatgggatggggccgaccttcgacgaaacggaaagagtagggagtagtggtacgaggtaatttcgagggcaagtaacttacctgaaaccacaagactcatccgacgggcacacgacctacgttaggaacgtgaacggaaccgtagagaagtggaacgacgacggaccacgtaattaagtttacgttggtcgcggacggaggtgggggtctagtttgtagtactattaacgttattatttacgttcgtggtcgttcgttgggactaaagggccaacggtccgaccgttcctcccgngtccccg

SEQ ID NO: 405677 - DNA, 653 bp, Homo sapiens
  misc_feature: GZ8MTXP01AHK86.21.67.G01.1.454.CMB.2.raw
  modified_base (409)..(409): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttggagtggatggggagtggggccgtaccgtttcgacgaaacggaaagacgtagggagtagtggtacgaagggtaatttcgacgggtcagtaattaccttgaacccangactcgatccgacgggcacgacgacctattcggaactgaacggaacctagaagaacgtagggacgaacgacggaccacgaacttagttagttgtacggtcgacgtaggtggggactagtttggtacgtaccgttacttaaccttatttaacgtttacgttacgttgggaacgttcgttcggggttacggaaacgggtacccgtaacggttacccgacccgggttcctccccgaacgtaaccccg

SEQ ID NO: 405678 - DNA, 619 bp, Homo sapiens
  misc_feature: GZ8MTXP01DKD82.21.67.G01.1.454.CMB.2.raw
  modified_base (398)..(398): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttggagtggatgggatcggggccgaccttcgacgaaacggaaagagtgggagtagtggtacaggtaatttcgagggcagtaattacctgaacccangactcatccgacgggcacacgacctacgtggaactgaggaacctagaagtaagtaggacgacgacggaccaaccgaattattaacgttgtacgtcggccggtaggtgggggtactagtttagtagtacttacgtaacttaattatttacttcgttacggtacgttcggttgggacgtaagggaccgaacggtaccgaccggttcctccccgcgtaaccccg

SEQ ID NO: 405679 - DNA, 786 bp, Homo sapiens
  misc_feature: GZ8MTXP01DDV1C.21.67.G01.1.454.CMB.2.raw
  modified_base (286)..(286): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgatatagtatcgagttgggtgcganaggcccttggacaagggcttgagtggatgggatgggccgacgttcgacaaacggaaagtagtagggtagtagtggtacaggtaatttacgacgggacagtaaattaccgttgaaaacccaacgaacggacttacgaaacttaccccgaaccggggactaaaccgacgggtacccttaacgtttacgggaaaccttagggaaacggtaaaccccgttagggaaacgtaaacgtacgggaaccgaacgaccgggacctaaccgtaagttatttaaagttgtacgggtaccggaccggtaagggtacggggggttacctagttttacggtaaacgtaacgttaaccggtttaaaccttaaagttttaacgtttaaacccgtttgtttaacggggtaaccggtttacgggttcgggggttaaacccggtaaaagggggtaccccgtaaaccgggtcccgtaaaccccggtttccccgtaacccccgttaaccgtaaccccccgg

SEQ ID NO: 405680 - DNA, 619 bp, Homo sapiens
  misc_feature: GZ8MTXP01C78SK.21.67.G01.1.454.CMB.2.raw
  modified_base (394)..(394): a, c, t, g, unknown or other
  modified_base (412)..(412): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctgtggttactagtttttccgactatagtatcagttgggtgcgacaggcccttggacgaagggcttgagtggagtgggatggggccgaccgttcgacgaacggaagagtgggagtagtggtcaggtatttcgaggcagtaattacgtgaaccagngactcgatccacgggcanacgctacgttaggaacgtgaggaactagagagtaggacgacgacggacactagtatttacttaggtcgcgcggagggtgggggactagtttcggtagtacgttactaacttaagtttactttacgtttcgttaggtacgttacggttggggaacgtaaacgggtaccgtaacggtccgacccgttaccgtccccgaagtaacccccg

SEQ ID NO: 405681 - DNA, 781 bp, Homo sapiens
  misc_feature: GZ8MTXP01ASLTZ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctctgcagggcctcgtggttactagtttttccgactatagtatcagttgggtgcgacaggcccgttggacgaagggtcttggaggtggagtgggagtcggggcccgtaccgttcggacgaaacgggaaagagtagggagttagtggtacaggtaatttcgacgggactaggtaacttaccgtgaaacctacaagacctacactccgacgggcaacgacgcccttacgtacggaactaggaacggaaccgttaggaacgtaagtacggaacggaccgaccgggacctaaccgtaagggttaatttacggtttacgtcgggtaccggtaccgggtaggggttacggggggtaccttaacggttttaggtaacggttaaaccgtttaaacccgttaaagtttaaactttttaagttttaaacccgttttcggtttaaccggggtaacgggtttaccggttacggggggttaaaccgtaaaaccggggggtaccccgttaaccggggtacccgttaaccccgggttacccctccccccggttaacgtaacccccccgg

SEQ ID NO: 405682 - DNA, 765 bp, Homo sapiens
  misc_feature: GZ8MTXP01CVTE5.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttgggtgcgacaggcccttggacaagggcttggagtggatgggatcggggccgtaccgttcgacgaaacggaaagagtagggagtagtggtacgaaggtaatttcgagggctaagtaacttaccgttagaaacccaacaagactacaacgtacccgacgggacaacgacgtacccttaacgtaggaaactggaacggtaaacccgtaggaacgtaagtacgggaaccgacgaaccggacctaacgtaagttaacgtttaggttcggtacggtaccggtaccgggtaaggggttacggggggtaccttaaggttttacggtaacgttaaaccgttaacgtttaaaccgtttaattttaaacgttttacgtttacggtttaagggtaccggtttacgggttacgggggttaaaccgtaaaacgggggtaaccccgtaaccgggttacccgtaaccccggttacccgtaacccccgttaacggttaaccccccg

SEQ ID NO: 405683 - DNA, 686 bp, Homo sapiens
  misc_feature: GZ8MTXP01AOTH7.21.67.G01.1.454.CMB.2.raw
  modified_base (417)..(417): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatcgagttgggtgcgacaggcccttggacgaagggcttggagtggagtggggagtcggggcccgtaccgttcgacgtaaacggaaagagtagggagtagtggtacaaggtaatttcgaggcaagtaattacctagaaacccacgngacctcactcccgacgggacacgacgccctaagttacggaacgtggaacggtaaccgaggaagaacgtacgggaaccgaccgaacggaccaacgattaagtttaagtgtacggtcgacggtaggtgggggtactagtttagacgtaacgtaactaacttaatttacgttaacctttgttacgggtaacgttcgggttacggggaacgtaaacggggtaccgtaaccgggttccgaacccggttccccttaaccccgaacggtccccccg

SEQ ID NO: 405684 - DNA, 827 bp, Homo sapiens
  misc_feature: GZ8MTXP01BVJMO.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcgagttggtgcgacaggccccttggacaagggcttggaggtggagtgggagtcggggcccgtaccgttcgacgtaaacgggaaagagtagggaagtagtggtacgaggtaagtttaccgagggactaagtaactttacccgttacggaaacccaacgaacggacctacctacgtacccgaaccggggacaacgacgtacccttaacgttagggaaaccgtaggaacggtaaacccgtaggaaagtaaaggtacgggaaaccgaaccgaaccgggacctaaaccggtaagtttaaagttttaacgtttacggttacgggacccggtacgggtaagggggttacggggggtaaccttagttttaacgggtaacggtaacctttaacgtttaaaccgtttaagttttaaacgttttaaaccgtttcggtttaaccgggttaaccgggttacgggttaacgggggttaacccgttaaaaaccgggggtaccccgttaacggggttaccccggtaccccggttaccccgttaaccccccggttaaccgttaacccccccgg

SEQ ID NO: 405685 - DNA, 582 bp, Homo sapiens
  misc_feature: GZ8MTXP01DESQJ.21.67.G01.1.454.CMB.2.raw
  modified_base (398)..(398): a, c, t, g, unknown or other
  modified_base (470)..(470): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactccccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgaccttcgacgaaacggaaagagtagggagtagtggtacagggaatttcgagggcagtaattacctgaaaccacngactcaatccacgggcacacgcctactaggaactgaggaactagagatgacgacacgacacatattagtagngcgcgaggtggggactagttgtaagactaacgtaacttaattagtttacttcgtttaggacgttcgttggggacaaagggacctaacggtccaccgttctccccgaagtccc

SEQ ID NO: 405686 - DNA, 673 bp, Homo sapiens
  misc_feature: GZ8MTXP01CZO9C.21.67.G01.1.454.CMB.2.raw
  modified_base (287)..(287): a, c, t, g, unknown or other
  modified_base (402)..(402): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctctggttactagtttttccgactatagtatcaggttggtgcgacnggcccttggacaagggcttgagtggagtgggatggggccgtacgttcgacgaaacgggaaagtagtaggagtagtggtacaggtatttcgagggcaagtattacctagaacccanaagactcatccgacggcacacgccttaagttggaacgtgaacggaaacccgtaggaagtaagtacgggaaccgacgaaccgggaccaacgtaagttaacttagttaggtacggacggtcggtaaggtgggggtactagtttaggtaagtacttaacgtaacttaagtttactttacttcgtttagggtcgttacggttcgggggaacgtaaaagggggtaccctaaccgggttccctaacccggttcccttaaccccgaacgtaacccccg

SEQ ID NO: 405687 - DNA, 639 bp, Homo sapiens
  misc_feature: GZ8MTXP01CCU4X.21.67.G01.1.454.CMB.2.raw
  modified_base (391)..(391): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggggcctctggttacagtttttccgactatagtatcagttgggtgcgacaggcccttggacaagggcttgagtggatgggatggggccgaccttcgacaacggaaagatgggagtatggtcaaggaatttcgacgggacagaattacctgaaccangactcactccgacggggtacacgacgcctacgttaggaactggaacggaaccgtaggagaagtcgggaacgaccgacgggaccaacgtagttaatttagttgtagcgaggtacggtgggggtacctagtttggtacgtacttaactaacgtttaattactttacgttcgttaggtacgttcggttggggacgtaaacggggacccgtaacggtccgacccggttacctccccgttaacggtaaccccg

SEQ ID NO: 405688 - DNA, 763 bp, Homo sapiens
  misc_feature: GZ8MTXP01ECFCQ.21.67.G01.1.454.CMB.2.raw
  modified_base (286)..(286): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcagggcctcgtggttactagtttttccgacttatagtatcgagttggtgcgacnggccctggacgaaggctgagtggatgggatggggccgtacgttcgacgaaacggaaagtagtgggaagtagtggtacaaggtaatttcgaggggactaaggtaactttaccgttcgaaacccaacgaacggtaactcaaacgtcccgaacggggaccacgtaacgtacccttaacgttacggtaaaccgtaggaacggtaaacccgttaggaaacgaaagttacgggaaccgaaccgaaccgggtacctaaacctaaggtttaactttaagttggttacggaccggtaccgggtaagggttcggggggtaccttaaggttttaccggtaaaggtaaccttaacgttaaaccgtttaagttttaaactttaaccgttttcgttacgggttaacggttccggttacgggggaccgtaaacggggacccgtaaccgggtacccgtacccggttaccctaaccccgttaacgtaacccccg

SEQ ID NO: 405689 - DNA, 858 bp, Homo sapiens
  misc_feature: GZ8MTXP01BBHCP.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgatatagtatcaggttggtgcgacaggcccttggacaagggcttggagtggatgggagtggggccacgttcgacgaacggaagtagtgggagtagtggtacgaggtaaatttcgaggggactaaggtaaacttacccgttacgaaaccctaacaacggtactaccgaacgttaccccgggaaccgggggaccaaaccgtaacggtacccccgtttaaacggttacgggtaaaaccgttacgggaaaaccggggtaaacccgtttaacggggaaaaggttaaaaccgggtaacggggtaaaccccggaaacccgggtaacccggggaaaccccttaaaccggtaaacgttttaaacgttttaaggttttacgggttaacgggacggggtacccggggtaaagggggttcggggggtaaccttaggtttttagggtaaacggttaaccgttaaacgtttaaacttaacgttttaacgttttaacctttcggtttacggggtaccggtttacgggttcgggggttaaccgtaaaaccgggggtcccgtaaccggggttaccctaccccggggttacccttccccggaacgttaaccccccg

SEQ ID NO: 405690 - DNA, 691 bp, Homo sapiens
  misc_feature: GZ8MTXP01C0R9A.21.67.G01.1.454.CMB.2.raw
  modified_base (392)..(392): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgatatagtatcagttggtgcgacaggcccttggacgaagggcttgagtggatgggatggggccgaccttcgacgaacggaaagatggagtagtggtcaggatttcgagggacagaattacctagaacccacngactacgacaccgttttacgggcacgacgtaccgtacttaggaaacgtggacggtaacccgtagacgaaagtacgggacggaaccgaaccggaccgaacctaattaatttaagtttaggttggtaccggtccggaggtcgggggtaccgtagtttaggtagtaacgttaacttaaccttaatttaaatttaccgtttcgtttaggttacgttcggttcgggggttaccgtaaaacggggtaacccgtaaccgggttcccgtaacccggttccctaaccccgttaacccggtaacccccg

SEQ ID NO: 405691 - DNA, 679 bp, Homo sapiens
  misc_feature: GZ8MTXP01AF90X.21.67.G01.1.454.CMB.2.raw
  modified_base (346)..(346): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttggtgcgacaggcccttggacaagggcttggagtggatgggatggggccgaccttcgacgaaacggaaagngtgggagtagtggtcaggtattcgaggcagtaattaccgtgaaaccacaagactacgactccgacgggcacgacgaccctatacggaaacgtggaacggtaacccgtaggaagtaaacgtcgggaaccgaacgaaccggaccaaacgtagttaacgtttagttagtcggaccggtacggtagggtgggggtacctagtttaggtacgtaaccgttacttaacgttaattttaacgtttacgttcgtttagggacggttcggttagggggttaccgtaaaacggggtacccgaacgggttacccgacccgttccgtccccgaacgtaacccccg

SEQ ID NO: 405692 - DNA, 681 bp, Homo sapiens
  misc_feature: GZ8MTXP01CABZR.21.67.G01.1.454.CMB.2.raw
  modified_base (536)..(536): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgacttatagtatcaggttgggtgcgacaggccccttggacaagggcttggaggtggagtggggatcggggccgaccgttcggacgaaacggaaagagtagggagttagtgggtacaaggtaatttcgaaggggaccaaggtaaactttaacccgttggaaacccaacaaggaacctacgacttaccccgaacgggcaaacgacgtacccttacgttagggaacgtggaacggaaccgtagagaagtggacgacgacggacacgattattagttgngcgcggaggtggggtctagtttgtagtacgttaacttaacgttatttatttaaccgtttgttacgggtacgttcggttacggggacgtaaacggggtacccgtaacgggttaccctacccggttccctcccccgaaggtcccccg

SEQ ID NO: 405693 - DNA, 683 bp, Homo sapiens
  misc_feature: GZ8MTXP01EE09X.21.67.G01.1.454.CMB.2.raw
  modified_base (277)..(277): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagaagcgtggggcctcggtgaaggtctctgcaggctgtggttactagttttccgatatagtatcgaggttgggngcgacgacggcccgttggacaagggtcttaggagtggagtgggagtcgggccgtacgttcgacgaaacggaagtagtggtagtagtggtacaggtaattcgaggactaagtaacttaccgtagaaacccagaagactacacgtaccgacgggtcacgtacgtaccttacgttaggaactaggaacggaactaggaagtaacgtacggaaccgacgaaccggacaacgtaagttatttagtagtcgaccggaggtagggtggggtaacttagtttacgtacgtaacttacgtaatttactttagttaacgtttcggttaacggtacgttcggttagggggaaaccgtaacgggtaccccgtaacggttacccgacccggttcccgtaaccccgaacggtaacccccg

SEQ ID NO: 405694 - DNA, 832 bp, Homo sapiens
  misc_feature: GZ8MTXP01CMK1W.21.67.G01.1.454.CMB.2.raw
  modified_base (280)..(280): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggactgaggtagaagaagccgtggggcctcggtgaaggtctctgcgaggcctgtggtactagttttccgatatagtatcagtggtgcgancggcctggacaaggtctgagtggatgggagtcgggccgtactcgacgaaacggaaagagtagggagtagtggtacgaaggtaatttacggacggacaagtaaacgttaccgttacgaaaccaacgtaacgactacaaacgttccccgaacgggacaacgtacgtacccttaacgttaacgggtaaaccgtaggtaaaccgggtaaacccgtaaggtaaacggtaaaggtaaccggggaaaaccgtaaaccggtaaaccccgggaaccccttaaaacgtaaacggggtttttaaactttaacggtttaagggttaccggggtaacccggacgggggttaaacggggttcgggggggttaaactttaagggttttaacgggttaaacggttaaaccgttaaaccgtttaaaccgtttaaacttttaaagttttaaccgtttaccggtttacggggttaaccggttacccgggttagggggaaaccggttaaaaccggggaccgtaacccggtcccggtaaaccggttcccctaaccccgttccgttaacccccg

SEQ ID NO: 405695 - DNA, 777 bp, Homo sapiens
  misc_feature: GZ8MTXP01AXDY4.21.67.G01.1.454.CMB.2.raw
  modified_base (281)..(281): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttgggtncgacaggcccttggacaagggcttgagtggatgggatcggggccgaccgttcgacgaaacggaagagtgggaagttagtggtacgaaggtatttcgaacgggacaagtaaacgttacccttaggaaaccctaacgaaggtaaccctcgaacgttccccgacgggggaccaacgaacggtacccttaacgttacgggaaacgttacggaaacgggtaacccttaggaaaggtaaagtacggggaaaccgaaccgaaccgggaccgtaacctaagtttaaacgtttaacgtttcgggtacgggccggtacgggtaaggggttcggggggaccttaaggttttgtaaacggtaccttaacgttaaacttaattttaacgtttaccgtttcgttacgggtaacggtttccgggttcgggggaaacccgtaaaacgggggtacccgtaaccggggtaccctacccggttaccccgtaacccccgttaaccggtaacccccg

SEQ ID NO: 405696 - DNA, 617 bp, Homo sapiens
  misc_feature: GZ8MTXP01DQ3GJ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactacgtttttccgacttatagtatcgagttgggtgcgacaggcccttggacaagggcttggagtggatgggatggggccaccttcgacaaacggaagagtgggagtagtggtacaggtaatttcgagggcaagtaattaccttgaaccacaagactacatccgacgggcacagcctatggactgagaactagagagtgacgacacgacacagttattattgtacgcgcggaggttgggggactagtttggtacgaacttacgttaacttagtttaatttacgttacgttgggtaccgttcgttagggggttacgaaacggggtaccctaacggggttccacccgttacctccccgaacgtaacccccg

SEQ ID NO: 405697 - DNA, 629 bp, Homo sapiens
  misc_feature: GZ8MTXP01DCW2B.21.67.G01.1.454.CMB.2.raw
  modified_base (291)..(291): a, c, t, g, unknown or other
  modified_base (419)..(419): a, c, t, g, unknown or other
  modified_base (442)..(442): a, c, t, g, unknown or other
  modified_base (504)..(504): a, c, t, g, unknown or other
  modified_base (546)..(546): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactacgtttttccgactatagtatcgaggttgggtgcgacncggcccttggacgaagggcttggagtggagtgggagtcggggcccgtaccgttcggacgaaacggaaagtagtagggaagtagtggttacaaggtaatttcgaggcaagtaacttacgtcgaaaccancgactcactccgacgggcacgancctagtagaacgtgaacgactagagaatggaacgacgacgtacatattagttaagttgacgngcggaggtggggtactagttgacgtactactaattaagtttntttacgttcgttacggtacgttcggttgggaccgtaaagggaccgtaacggtcctaacccggttctccccgaacgtaaccccg

SEQ ID NO: 405698 - DNA, 666 bp, Homo sapiens
  misc_feature: GZ8MTXP01EBZKD.21.67.G01.1.454.CMB.2.raw
  modified_base (402)..(402): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcgtgggcctcggtgaaggtctcctgcagggcctctggttactagtttttccgactatagtatcgagttgggtgcgacaggcccttggacaagggcttggagtggagtgggatggggccgtacgttcgacgaaacggaaagagtgggaagtagtggtcaggtaatttcgaggacagtaattaccttagaaacccanaagactcgactaccacggggacacgacgtacctacttaggaacttaggaacggaaccgtagaagtaacgtaggaacgacgaccggaccaaccgattaatttagtgtgtccgcggaggtggggctagtttggtaagtaccgtacttaactttaagtttaactttacgtttcgttacgggtacggtttcgggttcgggttaacggtaaacgggtaccggtaaccggttccgaacccggttcccgttccccgttaacgtaacccccg

SEQ ID NO: 405699 - DNA, 753 bp, Homo sapiens
  misc_feature: GZ8MTXP01C7VBJ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagttttccgactatagtatcaggttgggtgcgacaggcccgttaggacgaagggtcttggaggtggagtggggaagtcggggacccgtaccgttcggaccgaaacgggaaaggtagtagggtaagtagttgggtacagggtaatttcgaagggctaagtaacgtttaaccttacgaaacccaacgaacggtactacgaactccgacggggtacacgacgtacccttacgttaggaaacgtggacggaaaccgtagaaggaagtcggaaccgacgacgggacctaacgtaagtttaactttaagttcggtacggtacggtacgggacggggttggggggtaacttaacggtttaggttaacgtaaccgttacgttaaaccgtttaagtttaaacttttaccgtttacgtttaggggtaccggtttacggttcgggggttaaaccgaaacgggggtaaccctcgggttacccacccggttccctaaccccgaacgtaaccccgg

SEQ ID NO: 405700 - DNA, 633 bp, Homo sapiens
  misc_feature: GZ8MTXP01DF0PE.21.67.G01.1.454.CMB.2.raw
  modified_base (398)..(398): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttgggtgcgacaggccccttggacaagggcttggagtggatgggatggggccgaccttcgacaacgggaaagagtgggagtagtggtcaggtatttcgaggggcagtaattacctgaaacccangactcatccgacgggcacgacgcctacgttggaactgaacgaacctaggagaagtgggaacacgacgggaccaacgattattaacgttgacggcgcggagggtcgggggactagtttggtagtaaccgtaacttaactaagtttatttacgttcgtttaggtacggttcgttgggggacctaaacgggggaccctaacgggttccgacccgttcccgtccccgaacgtaaccccg

SEQ ID NO: 405701 - DNA, 569 bp, Homo sapiens
  misc_feature: GZ8MTXP01BLBUE.21.67.G01.1.454.CMB.2.raw
  modified_base (392)..(392): a, c, t, g, unknown or other
  modified_base (465)..(465): a, c, t, g, unknown or other
  modified_base (469)..(469): a, c, t, g, unknown or other
  modified_base (546)..(546): a, c, t, g, unknown or other
  modified_base (560)..(560): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgactatagtatcagttgggtgcgacaggcccttggacaagggcttgagtggatgggatggggccgacttcgacaacggaaagagtggagtagtggtcgaggaatttcgagggcagtaattacttgaacccangactcatccgacggcacgagcctatggaactgacggactgagaagtggacgacgacggcacgatattagttgngcgngaggtggggctagtttgagtactacgtaatactttattactttgtgtcgttcgttggggacaagggccaaggtcccnccgttcctccccgngtaaccccg

SEQ ID NO: 405702 - DNA, 571 bp, Homo sapiens
  misc_feature: GZ8MTXP01CUSOS.21.67.G01.1.454.CMB.2.raw
  modified_base (443)..(443): a, c, t, g, unknown or other
  modified_base (460)..(460): a, c, t, g, unknown or other
  modified_base (469)..(469): a, c, t, g, unknown or other
  modified_base (473)..(473): a, c, t, g, unknown or other
  modified_base (475)..(475): a, c, t, g, unknown or other
  modified_base (521)..(521): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggattgagtggagtgggatcggggccgaccgttcgacgaacggaaagagtagggagtagtggtctaaggtaagtttcgagggctagtaattaccgtagaaaccacaagactcatccgacgggcacagctactaggactgacgaacngagatcgagacacgcanatatgttgngcgngnggtggggctagttgtagactacgtaatattatttacttcgttaggngttcgttgggacgaagggaccaaggtccaccgttctccccgaacgtcccg

SEQ ID NO: 405703 - DNA, 641 bp, Homo sapiens
  misc_feature: GZ8MTXP01ER5I8.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgagagcgtgggctcggtgagtctctgcaggctctggttactagttttcgactatagtatcgagttgggtgcgacaggcccttggacgaagggcttggaggtggagtgggagtcggggccgtacgttcggacgaaacgggaaagagtagggtaagtagtggtacgaggtaaagtttcgagggactaaggtaacttaccgtacgaaacccacaacgtactacacgtcccgacggggtacaacgtacgtacccgttagttacggaacgtaggaacggaaaccttaggaagtaagtggaacgacgacggacacgtatattacgtgtagcgcgaggtggggactagttgtagtactagtaacttatttatctttgtcggtacgttggttcgggacgtaacgggaccgtaacggtccgtacccgttaccgtaacccgcgtaaccccg

SEQ ID NO: 405704 - DNA, 874 bp, Homo sapiens
  misc_feature: GZ8MTXP01D5Y5G.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcgtggggcctggtgaaggtctcctgcagggcctctggttactagtttttccgactatagtatcgagttgggtgcgacacggcccttggacaagggcttggagtggagtgggagtcggggccgaccgttcgacgaaacggaaagtagtgggagtatgggtacaggtaatttcggaacggggactaaaggtaaactttacccgttaggaaaaccccaaacgtaacggtaaccttaccgaaaccgttaccccgaaccgggggaccaaaccgaacggtacccgttaacgtttaacgggaaaccgttaggaaaccgggtaaacccgttaagggaaagggttaaaacgtaccggggaaaaccggtaaacccgaaccggggaaccctaaacccgttaaagggtttaaacgttttaaacggtttagggttacggtaccgggaccgggttaagggggttacggggggtaacctttaaggttttacgggttaaacggtaaacgttaaacccgtttaaatttaacgttttaacgtttttaaaccgtttcggtttaaccgggttaaccgggttaccgggttacgggggttaaaccggttaaaaccgggggaaccccgttaaccggggttaccccgtaaccccgggttacccttaaccccccgaaacggttaaccccccg

SEQ ID NO: 405705 - DNA, 719 bp, Homo sapiens
  misc_feature: GZ8MTXP01CCHI5.21.67.G01.1.454.CMB.2.raw
  modified_base (419)..(419): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctgtggttactagtttttccgactatagtattcgtagttgggtgcgacgacggccccgttggacgaagggtcttaggaggtggagtgggatcggggccctactcggacgaaacggaagagtggagtagtggtacgaggtatttcggaggacaagtaattacccgtagaaacccaacgngtacctacaacgtcccgaaccggggacaacgacgtacccgttaacgttacgggaactacggaacggtaaccgtaggaaagaacggtagggaaccgaaccgaaccggacctaacgtaaagtttacgtttaagttcggtacggacggtacggtacggggtgggggtaccttagtttagtacgtaacgtaacttaacgttaatttacgttacgttaggttacgggtacgttacgggttcggggaacgtaaacggggacctaaccggtaccgtacccgttacccgtaaccccgcggtaaccccg

SEQ ID NO: 405706 - DNA, 687 bp, Homo sapiens
  misc_feature: GZ8MTXP01BC059.21.67.G01.1.454.CMB.2.raw
  modified_base (260)..(260): a, c, t, g, unknown or other
  modified_base (310)..(310): a, c, t, g, unknown or other
  modified_base (576)..(576): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctctgcagggcctgtgtatcgtttcgatatagtngtaggttggtgcgagcggccgtaggaacgaaggtctggagtggagtgggngtcgggccgtacgtcgaacgaaacggaagtgtagggtataggtggtacgaaggtagttcggaacgggtacaaagtaacttaccgtcgaaacccaagaacgactccgaacgtacccgacgggacaacgtaccgtacccgttagttacggaacgtacggaaacggaaccgtagggaaagacgtacgggaaacgaccgtaccggacctaatagttacgtttagtggacggccgagggtagggtcgggaatttagttggaactaaccttnttaacttagtttacgtttccgttggttacgggtacgttcgggttcgggaaacgtaaaccgggccgtaacggtcccgtacccggttcctaaccccgttaacggtaacccccg

SEQ ID NO: 405707 - DNA, 685 bp, Homo sapiens
  misc_feature: GZ8MTXP01CTAKF.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgttggttactagtttttccgactatagtatcgaggttgggtgcgacaggcccttggacgaagggcttggagtggagtgggagtcggggccgtaccgttcggacgaaacggaaagagtagggaggtagtggtacgaaggtaatttcgaagggactaagtagtttacctgaaaccctacgaagtacctacacgtacccgacgggtaccaacgacgtacccgttaacgttacgggaacgtaggaacggaacccgttaggaaacgtaagtacgggaacgaaccgaaccggaccaaactagtttaactttagttcgagcggacggtaagggtgggtactagttagtagtactactaagttattattacgttgttacggtcgttcggttgggaccgtaaagggacccgtcgggtaccctacccggttcctccccgaacgtaaccccg

SEQ ID NO: 405708 - DNA, 630 bp, Homo sapiens
  misc_feature: GZ8MTXP01AOWIV.21.67.G01.1.454.CMB.2.raw
  modified_base (411)..(411): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactacgtttttccgacttatagtatcgaggttgggtgcgacaggcccttggacaagggcttggagtggagtgggagtcggggccgtaccgttcgacgtaaacggaaagagtggagtagtggtcaggtatttcgagggactagtaattaccgtgaaacccanaagactcactccgacgggcacgacaccctagttaggaacgtgaacggaactacggaagaagtacggacgaacgacggaccaacgattaattagtgtgacgcggaggtgggggcttagttgtacgtactagtaattaagtttattcgttgttcgacggttcgttcggggaacgaacgggaccgtaacggtccgtaccgttccctaacccgcgtaaccccg

SEQ ID NO: 405709 - DNA, 664 bp, Homo sapiens
  misc_feature: GZ8MTXP01ETSGR.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctctgcagggcctgtggttactgttttcgactatagtatcagttgggtgcgacaggccccttaggacgaagggcttaggaggtggagtggggagtcggggccgtacttcggacgaaacggaagagtagggagtagtggtacaaggtaatttcgaggcagtaactttacgtcgaaaccacgaagactacactccgaacgggcacgacgtcctacgtaggaacgtggaacggaccgtaggaagaacgtcggaacgaccgacgggacacgtattaagtttagttgtacggccgcggtagggtgggggtactagtttgtaagtaccgttaactaacgtttaatttatttactttgttacgggtacgttcggttacgggggttactaaacggggacccgtaacgggtaccgacccggttaccctccccgaacggtaacccccg

SEQ ID NO: 405710 - DNA, 579 bp, Homo sapiens
  misc_feature: GZ8MTXP01ASOGQ.21.67.G01.1.454.CMB.2.raw
  modified_base (390)..(390): a, c, t, g, unknown or other
  modified_base (436)..(436): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttggagtggatgggatggggccgaccttcgcaaacggaaagagtgggagtatggtcaggaatttcgagggcagaattacctgaaccangactcatccacgggcacagcctacttggaactgaggaactgagaanggacgacacggcacatattattgtgcgcgaggtgggggactagtttgtagtactactaacttaatttaatttacttcgtttgggtacgttcgttggggacaaacgggaccaacgggtccaccggttcctccccgaacgccccg

SEQ ID NO: 405711 - DNA, 643 bp, Homo sapiens
  misc_feature: GZ8MTXP01EGOH3.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatcagttgggtgcgacaggcccttggacaagggctgagtggagtgggagtgggccgacgttcgacgaaacggaaagagtgggagtagtggtacaaggtaatttcgagggactaagtaacttaccgtagaaaccacaagtactcgaagtccgtaacgggacacgtacgtcccttaacgtaggaacgtaggaacgaacgtagaagtaagtcggaacgacgacggaccacgtattattagttgagcgcggtaggtggggtactagttagagtaccgtaataacgttaatttacttacgtttcgttacggtacgttcggttcgggacgtaaacgggccgtaacggtaccgaccgttcctccccgaagtaaccccg

SEQ ID NO: 405712 - DNA, 731 bp, Homo sapiens
  misc_feature: GZ8MTXP01AW1UP.21.67.G01.1.454.CMB.2.raw
  modified_base (350)..(350): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctctggttactagtttttccgactatagtatcagttgggtgcgacaggcccttggacaagggcttgagtggagtgggagtggggccgtaccgttcgacgaaacggaaagngtgggagtagtggtacgaaggtaatttcgagggcaagtaacttaccgttagaaacccacgaagactacacgtcccgacgggacaacgacgtaccctacgttacggaacgtacggaacggaaccgtaggaaacggtaaagtcggggaaaccgaaccgaaccgggacccaaacgtaacttaagtttaagtttggtacgtaccggtaccgggtaggggttcgggggtacctagtttaggtaacggtaaccttaacgttaacctttaatttaacgtttaccgtttcggttaggtaccggttcggttacgggggaccgtaaacggggtacccgtaaccgggtccctacccggttccctaacccccgttaaccggtaaccccccccg

SEQ ID NO: 405713 - DNA, 671 bp, Homo sapiens
  misc_feature: GZ8MTXP01DH50N.21.67.G01.1.454.CMB.2.raw
  modified_base (407)..(407): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagtttttccgactatagtatcgagttgggtgcgaacgaggcccttggacaagggcttgagtggatgggatggggccacgttcgacgaaacggaagtagtgggagtagtggtacgaggtaatttcgagggtacagtaacgttacctgaacccanaagactcaacgtcccgacgggcacgagtacctattaggaacgtggaacggaaccgttagaagtaagtcggaacgacgaccggacacgattatttaagttggtaggcggcgtgggttggggacttagtttaggagtaaccgttacgtaatttaacgtttatttacgttttcgttagggtaccggttacgttgggggaaccgtaaacggggaccgtaaccgggtacccgtaccccgttaccgttaaccccgaacggtaaccccccg

SEQ ID NO: 405714 - DNA, 771 bp, Homo sapiens
  misc_feature: GZ8MTXP01CQ2WO.21.67.G01.1.454.CMB.2.raw
  modified_base (425)..(425): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcgggtgaaggtctccgtgcgagggcctcgttggttactagtttttccgactatagtatctagttggtgcgacgacggcccttaggacgaagggtcttggagtggagtggggagtcggggcctaccgttcggacgaaacggaaagagtagggagtagtggtcgaaggtaatttcgaacgggctaagtaactttaccgtagaaacccanaacgtactcaacgtcccgaacggggtacaacgacgacccttaagttacggaaacgtaggtaaacggaaacccgttagaacggtaaacgtacgggaaccgaacgaaccggacctaaacgtaagttaacgtttaagttggtacgtccgggacgtaggggtgggggtacctaggttttacgaacgttaacttaaccggttaatttaacgttttaaacgttttaccgttacggtttacgggtaaccggttacggggttacgggggttaaaccgtaaaaccgggggtacccctaacggggttaccccggtaacccgttccccggttaaccccccgaacggttaaccccccg

SEQ ID NO: 405715 - DNA, 639 bp, Homo sapiens
  misc_feature: GZ8MTXP01B7CC5.21.67.G01.1.454.CMB.2.raw
  modified_base (289)..(289): a, c, t, g, unknown or other
  modified_base (426)..(426): a, c, t, g, unknown or other
  modified_base (431)..(431): a, c, t, g, unknown or other
  modified_base (511)..(511): a, c, t, g, unknown or other
  modified_base (515)..(515): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgttggttactagtttttccgaacttatagtatcgaggtttggggngcggacgaggccccttggacgaagggcttggagtggagtgggagtcggggcccgtaccgtttcgacgaaacgggaaagagtagggaagttacgtggtacaggtaatttcgacgggcagtaattacctagaaccacgngactnactccgacgggcacagtcctattggaactggaacgaacctagagaagtggacgacacggacacgagttacttagtgacgngcgnggtggggtctagttgtaacgtactacgttaacttatttacttactttcgttaggtacgttcggttacgggacgaaacgggtaccgtaacggtaccgaccgttccctccccgaacgtaacccccg

SEQ ID NO: 405716 - DNA, 587 bp, Homo sapiens
  misc_feature: GZ8MTXP01CQM4D.21.67.G01.1.454.CMB.2.raw
  modified_base (278)..(278): a, c, t, g, unknown or other
  modified_base (411)..(411): a, c, t, g, unknown or other
  modified_base (423)..(423): a, c, t, g, unknown or other
  modified_base (444)..(444): a, c, t, g, unknown or other
  modified_base (459)..(459): a, c, t, g, unknown or other
  modified_base (464)..(464): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttacagtttttcgatatagtatcagttgggtncgacaggcccttggacaagggcttgagtggatgggatgggcactgacaaacggaagatggagtatgtcaggaattcgaggcagaacttactgaaacacaagactcaatccaacgggcacagcctaatggaacngaggaaactganaaatggacgacacgtaccaanagttaattagttggngacgngaggagggtagtagttagtagtactaactaacttaattattacgttacgttacggtacggttacggttcgggttacggaaacggaacgtaaccgtaccgtaccgttacccgtcccgccgtccg

SEQ ID NO: 405717 - DNA, 722 bp, Homo sapiens
  misc_feature: GZ8MTXP01AZ0SW.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggccccttaggacaagggcttggagtggatggggatggggcccgtacgttcggacaaacggaaagagtaggagttagtggtacaaggtaatttcgaggtcaagtaattacctaggaaacccagcgactacgatcccgacggcacgacgaccctagttaggaactaggaacgtaaccgtaggaagtaatacggacgaacgaccggacctaacgtaattacgttaacgttggtacgtaccggtacgggtaggtgggggtacctagtttaggtaaggtaaccttaacgttaaccttaattttaacggtttaacctttcggttttacggtaaccggggtttacgttcggggggttaaacccgtaaaacgggggtaccccgttaaccgggttcccgtaaacccccggttcccgtttaacccccgaaccgggtaacccccccg

SEQ ID NO: 405718 - DNA, 612 bp, Homo sapiens
  misc_feature: GZ8MTXP01AFL19.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggccccttggacaagggcttgagtggatggggatggggccgaccgttcgcgaaacggaaagagtgggagtagtggtacaggtaatttcgagggcaggtaattaccttagaaacccacaagactcatccgacgggcacacgcctacgtggaactgaggaacctgagaatggacgacgacggacacatattagtgtgcgcgaggtggggctagtttgacgtacgtactaacttatttagttactttcgttagggtacgttcggttggggaccgtaaaggggacccgtaaccgggttaccacccggttcccgtcccccgaacggtcccccg

SEQ ID NO: 405719 - DNA, 703 bp, Homo sapiens
  misc_feature: GZ8MTXP01DPPJZ.21.67.G01.1.454.CMB.2.raw
  modified_base (244)..(244): a, c, t, g, unknown or other
  modified_base (414)..(414): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactccccagactcaactggtgcagtctggacctgaggtgaagaagcctggggcctcggtgaaggtctcctgcgagggcctntggttactagtttttccgactatagtatcgagttgggtgcgacacggcccttggacgaagggtcttggagtggatggggagtcggggacccacgttcggacaaacggaaagacgtgggagtagtggtacaaggtaatttcgagggctaagtaacttacctgaaacccaangactcaacgtccgacgggacacacgtcctagttaggaactgaacggaacctagaagaacgtaggacgacgacggaccacgtattaattagttaggtcgcgcggtagggtcggggacttagtttacgtaacgtacgttaacttaacttacgtttaagttttaccgtttcgttaacgggttacccggttcggtttacgggggaaacccggttaaaacggggggtacccctaaccgggttaccccgtaaccccgggttccccttaaccccccggttaacgtaacccccccgg

SEQ ID NO: 405720 - DNA, 864 bp, Homo sapiens
  misc_feature: GZ8MTXP01A9WG9.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctggtgaaggtctcgtgcgagggtcctcgtggttactagttttccgactatagtatcgaggttggtgcgacgtacggcccgttaggaacgtaagggtcttaggaggtggagtgggagtcggggacccgtaccgttcggacgaaacgggaagtagtagggtaagtagtggtacgaaggtaacgtttcggaacggggtactaaagtaacgtttaacccgtacggaaaaccctaacgaacggtaaccctaccgtaaaccgttaccccgggtaaccggggtaccaaacggtacccggttaccccgtttaaacgggtttaacgggaaaccgttaacgggaaaccgggtaaacccgttaagggaaacggtaaacggtacgggaaacccgtaaccggaaccgggtaaccctaaacgttaaggtttaagtttaacggttcggacggacggtacggggtaggggttacggggtacttaggttttacggaacgttaaccgttaattaacgtttaattttaacgtttaccggtttacggttacgggtaacccggtttgggttaacgggggttaaacccgtaaaaccgggggtccccgttaaccgggttaccccgtaaccccggttaccccgttaacccccgggaaccgtttaaccccccgg

SEQ ID NO: 405721 - DNA, 678 bp, Homo sapiens
  misc_feature: GZ8MTXP01BMGRZ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggcctctggttactagtttttccgactatagtatcgaggttgggtgcgacgacggccgttggacgaagggtcttggagtggagtggggagtcggggaccgtaccgttcggacgaaacggaaagtagtagggagtagtggtacgaggtaattcgaggcagtattacgtcgaaaccacaagctacgagtacccgacgggacacgacgtaccttagttacggaacgttggaacggtaaccgtaggaacgtaagtcggaacgaccgacggactaacgtaattagttagttgcggacgtcggagggttggggacttagttcggtaataccttaacgtaatttagtttacgtttacgttggttacgggtacggttcgggcggggttaaccgaacggggtaccgtaaccgggtcctaccgggttccctcccggttaacgtaacccccg

SEQ ID NO: 405722 - DNA, 643 bp, Homo sapiens
  misc_feature: GZ8MTXP01EZWQB.21.67.G01.1.454.CMB.2.raw
  modified_base (403)..(403): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgactatagtatcagttgggtgcgacaggcccttggacaagggcttggagtggatgggatggggccgacgttcgacgaaacggaaagagtggagtagtaggttacaggtatttcgagggcagtaatttacctgaacccacgngactcactccgacgggcacgagtcctacgttaggaacgtgaacggaacctaggagtaagtcggaacgacgaccggacaactaagttactttagttgtacggacgcgggtaggtgggggtactagtttagtaaggtaacttacttaacgttaatttagtttactttcgttaggtacgttcggttaggggacgaaacgggaccgtaaccggtccgtacccggttcctccccgaacgtccccg

SEQ ID NO: 405723 - DNA, 790 bp, Homo sapiens
  misc_feature: GZ8MTXP01AHQI6.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgttggttactagtttttccgactatagtatcgaggttgggtgcgacacggccccttaggacgaagggtcttaggaggtggagtggggacgtcggggtcccgtaccgttcggacgaaacggaaaggtgtagggagtagtggtacgaaggtaactttcgacgggactaagtaacgtttaccctagtaaacccgactaacggtactaccgacgtacccggaccgggtacacgacgtacccttacgttacggtaaacgttaggaacggtaaccgtaggaacgtaaagtacgggaaaccgaccgaccggaaccgaactaacgtttaacgtttacggttacggtacgggtaccgggtacggggtaacgggttacggggggtaccttaagggtttacggtaaccggttaaaccgttaaccttaaccgtttaagtttaacgttttaaccgttcggtttacgggtaccggttacgggttacggggttaccgtaaaacggggtcccgtaacgggtaccccgtacccggttacccgttaaccccgaacggtcccccg

SEQ ID NO: 405724 - DNA, 712 bp, Homo sapiens
  misc_feature: GZ8MTXP01BBIRD.21.67.G01.1.454.CMB.2.raw
  modified_base (278)..(278): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctctgcagggcctcgtggttactgtttttcgactatagtatcgagttggngcgacaggccttggacaagggcttggagtggagtgggagtcggggccgtaccgttcgacgaaacggaaagagtaggagtagtggtacgaaggtaagtttcgagggtactaaaggtaaacgtttacccgttaggaaaacccaacgaacgtaacctacgtaacgttaccccgaaccggggacaacgaacgtcccgttaaacgtttacgggaaacgttacggaacggtaaacccgtaggaaacgtaaagacgggaaaccgacgaacggacaactaagttatttaagtgtagccgtaggacgggtggggactagtttaggtaacgtaacttaagttaacttaagtttacttacgttgttacgggtacgttacgttggggaaacgtaacgggtacccgaacggtcccgaacccgttccgtaaccccgaaggtaaccccg

SEQ ID NO: 405725 - DNA, 687 bp, Homo sapiens
  misc_feature: GZ8MTXP01BUWDT.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctggtgaaggtctcctgcaggcctcgtggttactagtttttccgacttatagtatcgaggttgggtgcgacgacggcccttggacgaagggcttggagtggagtgggatggggcccgtaccgttcggacgaaacggaaagagtagggagtagtggtacaggtaatttcgaagggtactagtaactttacccgtagaaacccacgaagacctcgactcccgacgggcacgacgtacctacgtacggaacgtaggaacggaacctaggagtaagtcggaacgacgacggaccactagttaattagttcgagcggcggtagggtggggtactagtttgtaacgtacgttattaacttaagtttacgtttacgtttacgtttcgggaccgttcgggttacggggttaacggtaaaccggggtacccgtaaccgggtaccgtaccccggttaccctccccgaaccggtaacccccg

SEQ ID NO: 405726 - DNA, 573 bp, Homo sapiens
  misc_feature: GZ8MTXP01BCQGQ.21.67.G01.1.454.CMB.2.raw
  modified_base (395)..(395): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcagggcctctggttactagtttttccgactatagtatcagttgggtgcgacaggcccttggacaagggcttgagtggatgggatggggccgaccgttcgcgaaacggaaagagtgggagtagtggtacaggatttcgagggcagtaattacctgaaccangactcatccgacgggcacgacgcctactggaactgagactagacgatggacgacacggacacatatatgtagcgcgaggtgggggctagttgtagactactaacttattattacttgttggtacgttcgttggggacaaagggccgaacggtccgaccggttcctccccgcgtccccg

SEQ ID NO: 405727 - DNA, 771 bp, Homo sapiens
  misc_feature: GZ8MTXP01CRK8S.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggtcctgttggttactagtttttccgactatagtatcgtaggttggtgcgacaggcccttggacaagggtcttggagtggagtggggatcggggacccgtaccgttcgacgaaacggaaagagtagggagtagtggtacgaaggtaatttcgaagggtcaaaggtaactttaccgttacgaaacccgtaactaacggaccttacgaaacgttccccgaacggggtaccaacgaccgtacccgttaacgtttacgggaaacgttagggaaacggtaaacccgttaggaaagggtaaacgtaacgggaacggaaaccgaaccgggtaccaaccgtaatttaagtttacgttaggtcgacggtacggtagggttgggggtaaccttagtttacggtaacgtaaacttaaccgttaacgtttaagttttaacttttaccgtttagtttaacgggtacggtttacgttcgggggttaacgtaaaacgggacccgtaacggttacccgacccggttccctccccgttaacgtaaccccg

SEQ ID NO: 405728 - DNA, 754 bp, Homo sapiens
  misc_feature: GZ8MTXP01E133L.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcgtgcgaggtcctcgtggttactagttttccgacttatagtatcgtaggttgggtgcgacgacggtccccgttaggaacgtaagggtcttaggaggtgggagtgggagtcggggacccgtacgttacgacgaaacggaagtagtagggaagtagtggtacgaggtagtttcgacggtactaagtaacttaccgtacgaaaccacgtaacgacctacgtacgtacccggaaccgggacaaccgtacgtacccgttaacgtacgggtaaacgtagggaaaccggtaacgtacggaaggtaaacgtacgggaaaccgacccgaaccggtaacctaacgtaaggtttaacgtttagttggtacggccggtacgggtagggtacggggtacttaaggtttagtaacgtaacgttaacgtaactttaagtttactttaccgtttgtacgggtcgttacgggttcgggaacggtaaaccgggtacccgtaaccgggtacctacccggttccctaaccccgcgtaacccccg

SEQ ID NO: 405729 - DNA, 827 bp, Homo sapiens
  misc_feature: GZ8MTXP01ESYYS.21.67.G01.1.454.CMB.2.raw
  modified_base (244)..(244): a, c, t, g, unknown or other
  modified_base (418)..(418): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctntggttactagtttttccgatatagtatcagttggtgcgacaggccctaggacaaggcttggagtggagtgggatcggggcccgacgttcgacgaaacggaaagtagtagggagtagtggtcgaaggtaagtttcgaacggggcaagtaaacgtttaccgttacgaaacccgaanaacggacctacgacgttacccgaacggggaccacgacggtacccttaacgttacggaaacgtaggaacggaaacccgttaggaaagtaaacgtacgggaaaccggaaccgaaccggggaacctaaccgtaaacgtttaagttttaaacggtttcggtacgggtaccgggtacgggtaaaggggttcggggggtaacctttaaggttttacgggttaacggtaaacccgtttaaactttaaaccgttttaaagttttaacgttttaccgtttttaaccggttacggggttaacccggtttcggggttacgggggttaaacccggtaaaaccgggggtaacccgttaaccccggggtttaccgtacccccggttacccgttaaccccccgttaacccggttaaccccccgg

SEQ ID NO: 405730 - DNA, 824 bp, Homo sapiens
  misc_feature: GZ8MTXP01DDJ89.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctgtggttactagttttccgactatagtatcgaggttggtgcgacacggccctggacgaagggcttggagtggagtgggatcggggcccgtaccgttcggacgaaacgggaaagagtagggtaagtagttaggtacgtaagggtaatttcgaagggggtacctaaaggttaacgtttaaccccgttacggaaaacccctaacgaacgtaccgtaccgtaaaccgttccccgggaaccggggtaccaaccggtaacccgtacccgtttaaccggttaacgggaaaccgttacgggaaaccgggtaaacccgtagggtaaacggtaaacggttaccggggaaaaccggaacccgaaccgggaaccctaaaccgtaaaggtttaacgttttagttacgggttcggaccggtacgggtacggggtagggggtacctttaaggtttacggtaacgtaaccgttaaacgtttaacgttaacttttagtttacgttcggtttacgggtacgttcgggttacggggaacgtaaaccggggtacccgtaaccggttcccgacccggttaccctccccgaacgtaacccccg

SEQ ID NO: 405731 - DNA, 755 bp, Homo sapiens
  misc_feature: GZ8MTXP01DF9YF.21.67.G01.1.454.CMB.2.raw
  modified_base (430)..(430): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaagtggtgcagtctggacctgaggtgaagaagccgtggggcctcggtgaggtctcctgcgagggcctcgtggttactagttttccgactatagtatcgtaggttgggtgcggacaggccccttagggacgaagggtcttggaggtgggatggggagtcgggggcccgtaccgtttcggacgaaacgggaaagagtgggtagtagtggtcgaagggtaatttcgacggggactagtaacgtttacctgaaacccanaacgactacacgtaccgacgggactacgacgtacctttaacgtacgggaacgtacgggaacggtaaacccgtaggaagtaaagtcgggaaccgaccgaaccggaccgaactaagttagtttacgtaggttcgacgggtccggaggggttagggggtaccttaggtttggtaacgtaacgtttaacgttaaccgtttaaattttacgtttacgtttcggtttaacggggtaccgttacgggttacgggggaaccggtaaaaccggggtaccggtaaccgggttaccctacccggttaccccgtaaccccgttaaccgtaacccccg

SEQ ID NO: 405732 - DNA, 811 bp, Homo sapiens
  misc_feature: GZ8MTXP01EM0HP.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagtttttccgacttatagtatcgtaggttgggtgcgacaggcccttaggacgaagggcttggagtggagtgggagtcggggcccgtaccgttcgacgaaacggaaagagtagggaagtagtggtacgaggtaatttcgacgggctaagtaactttaccgtacgaaacccaacgaacggtacctcgaacgtacccgaacggggaccaacgtacgtacccttaacgttacgggaaacgtaggaaaccggtaacccgttaggaagtaaacggtacgggaaccgaaccggaaccgggtacccaaagttacggtttaaagttttagttacgggtacggaccgggtacgggtaggggttacggggggtaccttaaggttttacggtaaacggtaacctttaaacggttaacctttaaaggtttttaactttaccggttttcggttaacggggttaacccggttcgggtttaacgggggaaaccggtaaaaccgggggtaccccgtaaccggggttacccgtaccccggttaccccgtaaccccccgttaacggtcccccccgg

SEQ ID NO: 405733 - DNA, 636 bp, Homo sapiens
  misc_feature: GZ8MTXP01ECT6A.21.67.G01.1.454.CMB.2.raw
  modified_base (242)..(242): a, c, t, g, unknown or other
  modified_base (396)..(396): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctntggttactagttttccgatatagtatcgaggttggtgcgacaggcccttggacaagggcttgagtggagtgggagtcggggccgtacttcgacgaaacggaagatgggagtacgtggactaggatttcgagggcagtaacttacgtagaaccangactcactccgacggacacgacgctacgtagaacgtgacgaacctagagtaagtcggaacgaccgacggaccaacgtaagttatttagtggtacgccgtggagggtcggggacttagtttacgggtataacgttacttaaacttatttaacgttactttcggtaggtacgttcggttagggttaaccgaaaggggtcccctaacgggtccaccggttccctaaccccgaacgtaaccccg

SEQ ID NO: 405734 - DNA, 580 bp, Homo sapiens
  misc_feature: GZ8MTXP01AWHHE.21.67.G01.1.454.CMB.2.raw
  modified_base (344)..(344): a, c, t, g, unknown or other
  modified_base (371)..(371): a, c, t, g, unknown or other
  modified_base (385)..(385): a, c, t, g, unknown or other
  modified_base (389)..(389): a, c, t, g, unknown or other
  modified_base (401)..(401): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctctggttactagtttttccgatatagtatcagttgggtgcgacaggcccttggacaagggcttgagtggatgggatggggccgacttcgcgaacggaaagntgggagtatggtcaggatttcgagggnagatacctgaacangacnactcacgggcanacgctactgactgaggacctagagaagtggacgacacggaccacatattagtgtagcggcgaggtgggggactagttgtacggtactactaactaatttattacttcgttgggaacgttcggttgggaccgtaaaggggtaccaacggggttacacccgttccgtccccaacgtccccg

SEQ ID NO: 405735 - DNA, 639 bp, Homo sapiens
  misc_feature: GZ8MTXP01CLZ5I.21.67.G01.1.454.CMB.2.raw
  modified_base (401)..(401): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgccccactccccagactcaactggtgcagtctggacctgaggtgaagaagcctggggcctcggtgaaggtctcctgcgagggcctctggttactagtttttccgactatagtatcagttgggtgcgacaggcccttggacaagggcttgagtggagtgggagtcggggccgaccttcgacgaacggaaagagtgggagtagtggtcgaaggatttcgagggctagtaattaccgtgaaccanaagactacatccgacgggcacgagtccctagttcggaactggaacggaacctaggaagaagtcggaacgaccgaacggaccaacgtaattattattgtgtcgcggaagggtggggtactagttgtaagtaacttactaactaagtttattacgttcgttagggtacgttccgttgggggaccgtaaaaggggtcccctaacgggtcgtacccgttcctaacccccgaagtaacccccg

SEQ ID NO: 405736 - DNA, 709 bp, Homo sapiens
  misc_feature: GZ8MTXP01A68XT.21.67.G01.1.454.CMB.2.raw
  modified_base (363)..(363): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgactatagtatcgtaggttgggtgcgacacggcccttggacaaggggcttggaggtggagtggggagtcggggccccgaccgttcgacgaaacgggaaagngtgggagtagtggtacaaggtaatttcgacggggctaagtaacttacccgttagaaacccacgaagacctcacgtacccgacggggtcacgacgtcccttaacgttagggaactgggaacgtaaccttaggaagtaagtcgggaaccgacgaaccggccaacgtattaacgttagttgacggcgacggtaggggtggggtacttagtttggaacgtaaccttaacggttaaccttaattttacgtttaaccttcggttagggtacccggttcggttgggggaaccctaaaggggtccccgtaaccggtccccggacccgttccccgtccccgttaacggtcccccg

SEQ ID NO: 405737 - DNA, 723 bp, Homo sapiens
  misc_feature: GZ8MTXP01BCVBU.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgagtgaagagcgtgggcctggtgaggtctcgtgcgaggcctcgtggttactagtttttccgacttatagtatcgaggttgggtgcgacgacggccccttaggacgaagggtcttggagtggagtggggagtcggggaccgtaccgttcggacgaaacgggaaagtagtagggtaagttacgtaggtcgtaaaggtatttacggaggggacaaggtaactttacccgttagaaacccacgtaagacctcgacgtaccgaacggggcaccgacgtcccttagtacggaacgtgggaacgtaccgaggtaagacgtagggacgaaccgacgggaccaaacgtattaacgtttagttcggacggcggtacggtaggggtacgggggtacttagtttacgggtaacgtaaccgttacgttaaactttaagtttacgtttaacctttcggtaacggtcggttacgttagggggttacgaaacggggtaccctaaccgggttacccacccggttccctaacccgccgtaaccccg

SEQ ID NO: 405738 - DNA, 811 bp, Homo sapiens
  misc_feature: GZ8MTXP01DULAK.21.67.G01.1.454.CMB.2.raw
  modified_base (340)..(340): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtggggcctggtgaggtctctgcgaggcctgtggttactagtttttccgatatagtatcgagttgggtgcgacaggcccttggacaagggcttgagtggatggagtggggccgacgttcgacgaaacggaagngtagggagttagtggtacaaggtactttcgagggactaagtaactttaccgttcgaaaccctaagcgtacttaccgaacgtcccgaaccggggccaacgacgtacccttaacgtttacggaaacgttggaaacggtaaccgtaaggtaaaggtaaacgttacggggaaaccgaaccggaaaccgggaccctaaaccgttaaacgtttaaagtttttaagtttccgggtacggaccgggtaccggggtaagggggttacggggggtacctttaagggttttaacggtaaccggttaaacctttaaaccggtttaaaccttttaaatttttaaacgtttttaaccgttttacggtttaccgggtaaccggtttacgggttacgggggttaaccgtaaaacgggggtacccgttaacccgggttacccgtaaccccggtttccccgtaacccccgttaaccgggtaaccccccg

SEQ ID NO: 405739 - DNA, 737 bp, Homo sapiens
  misc_feature: GZ8MTXP01B31NH.21.67.G01.1.454.CMB.2.raw
  modified_base (362)..(362): a, c, t, g, unknown or other
  modified_base (416)..(416): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagagccgtgggcctggtgaggtctcgtgcgaggtcctgtggttactagttttccgattatagtatcgtaggttggtgcgacgacggccccgttaggaacgaagggtctaggaggtggagtgggagtcggggacccgtacgttcgacgtaaacggaaagngtaggagtagtggtacgaaggtattcgaggtacaagtaactacgtgaaaccacngactcacgtaccgacgggtacacacgtaccctacgttaaggaacgtagggaaacggtaacccgtaggaaacgtaacgtacggggaaacgacccggaacggaaccccgaaattaaggttaagtttaacgttcgggacggtacccggaggtaaaggggtcgggggtaattaggtttaacggtaacgttaaaccttaagtttaaaccttaagttttacgtttaaccgtttggtacggttaccgttagggttaccggggaacgtaaaaccgggggtccctaaccgggttcccgacccgttaccctaaccccgaacgtaacccccg

SEQ ID NO: 405740 - DNA, 742 bp, Homo sapiens
  misc_feature: GZ8MTXP01BOU6Y.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctctgcgagggcctcgtggttactagtttttccgattatagtatcgagttgggtgcgacaggccccttggacgaagggtcttaggaggtggagtgggagtggggcccgtacgttcgacgaaacggaagtagtggagtagtggtacaggtaattcgaggctagaactttacgtagaaacccactaagaccttacacgtacccgaacggggtaccaaacgtacgacccgttaacgttacggtaaacgtaggtaaacggtaaacccgttaggaaacggtaaacgtacgggaaaccggaaccgtaaccgggacctaaaccgaagttaaactttaaggtttcgtcggtacgacggtacgggtcgggggtacttaaggtttaggtaacgttacgtaacttaacgttaactttaacgtttactttcggttacggttaacgttcgggttacggggttacgtaaaacggggtcgtaacccgggtcctacccggttaccctaaccccgttaaccgtaacccccg

SEQ ID NO: 405741 - DNA, 708 bp, Homo sapiens
  misc_feature: GZ8MTXP01DZEA6.21.67.G01.1.454.CMB.2.raw
  modified_base (287)..(287): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtattcagttgggtgcgacnggccctggacaagggcttgagtggagtgggagtggggcccgtacgttcggacgaaacggaaagagtagggagttagtggtacaaggtaagtttcgacggggactaagtaactttaccttggaaacccacaaggtacctacaacgttcccgaaccggggacaacgagtacccttaacgttggaacctaggaacggaaaccgtgaacgaagtcggaacgaacgaccgggaccaacgtaattaacgttagtttaggacgcgtacggtagggtgggggtaactagtttagggtaactacgtttaactaacttagtttatttaacctttcgttaaggtaccggttcggtttacggggaaccgtaaaacggggtacccctaacgggtttcccgaaccccggttccgtcccccgaagttaaccccccg

SEQ ID NO: 405742 - DNA, 657 bp, Homo sapiens
  misc_feature: GZ8MTXP01BLC2J.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctctgcaggcctctggttactagtttttccgacttatagtatcgagttgggtgcgacaggcccttggacaagggcttggagtggatggggatggggcccgtaccgttcgacgaaacggaagagtaggagtagtggtacaggtatttcgaacgggtcagtaacttaccgtagaaacccacgaagactacacgtaccgacgggcacgacgacctagtaggaacctaggaacgtaccgtagaacgaagtacgggaacgaccgacggacctagaacgttaattagttcgacgcggcgtaggggtggggtacttagttagggtaactacgtaacgttaattaacgtttaagtttaccgttgttacggtacgttcggttcgggaacgtaaacggggccctaacggtccgacccgttcctccccggaagtaaccccg

SEQ ID NO: 405743 - DNA, 790 bp, Homo sapiens
  misc_feature: GZ8MTXP01A3JA3.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctgtggttactagttttccgactatagtatcgaggttgggtgcgacacggccccgttaggacgaagggtcttaggaggtggagtggggagtcggggcccgtaccgttcgacgtaaacggaagtagtagggagtagtggtacgaaggtaatttacggaagggtactaagtaacgtttaaccgttacgaaacccgtaacgaacggtaacctaccgtaacgtaccccgaacggggaccaaaccgtacggtacccttaacgttaacgggaaacgttacgggaaacggtaaacccgtagggaacgtaaacgtacgggaaaccgaaccgaacccggaccgtaaactaacggtttaacgtttagttggtacggtaccggtaccggtaggggttacgggggtaccttaaggttttacggtaacgtaacgttaacgttaacgtttaatttactttaccgttcgttacgggtacgttacggttacggggttaaccggtaaacggggacccgttaacgggttccctaccggttacccctccccgttaaccgtaacccccg

SEQ ID NO: 405744 - DNA, 827 bp, Homo sapiens
  misc_feature: GZ8MTXP01EVFFK.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagagccgtggggcctcggtgaaggtctccgtgcgagggccttgtggttactagtttttccgatatagtatcaggttgggtgcgacacggccctggacaagggtcttaggagtggagtgggagtcggggccgtaccgttcgacgaaacggaaagagtagggaagtacgtggtacgaaggtaatttaccgaggggtactaaaggtaaactttacccgttacgaaaacccgtaacgaacggtaacctacccgtaaacttaccccggaaccgggggaccaaaccgtaaccgtacccgtttaaccggtttaacgggaaaccgttacgggaaacgggtaaacccggttaaggaaacgggtaaacgttacgggggaaaccgaacccgaaccgggaaccctaaaccgtaagtttaacgtttaagtttacggtacggacggtaccggggtagggttacggggggtaacttaaggtttagggtaacggtaaacttaaaccttaacgtttaacttttaacgtttaaacgttttcgttacggtaacgggttcggttacggggttaaaccggtaaaggggtacccgtaaccggttacccgtaccccgttacccgttaacccccgaacgtaacccccg

SEQ ID NO: 405745 - DNA, 940 bp, Homo sapiens
  misc_feature: GZ8MTXP01DDXQL.21.67.G01.1.454.CMB.2.raw
  modified_base (282)..(282): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaggtctcctgcaggcctctggttactagttttccgatatagtatcgaggttggtgcgacncggcccgttaggacgtagggtcttggaggtggagtgggagtcggggacccgtaccgttacgacgaaacgggaaagagtagggtaaggtagtaggtacgtaaggtaacgtttcggaacggggtacctaaagggttaactttaaccccgttacggtaaaaccccaacgtaacgtaaccgttacccgtaaaccgttaccccggaaccggggactaaacccggtaacgttaccccgtttaaaccggtttaccggggtaaaaccgttacgggtaaaccgggtaaaacccgtagggtaaaccgggtaaacggttaccggggaaacccggtaaacccgggtaacccgggaaaccccgtaaaccgttaagggtttttaaaacgtttacggttttaaccgggtaccgggaccgggttaacccgggggtaagggggtttaccgggggggttaaccctttaaggtttttaacgggtaacggttaaacccgtttaaacctttaaacggttttaaactttttacggtttttaaacccgtttcggtttaacgggggttacccggttaccgggttcggggggttaaaacccggtaaaccgggggtaccccgttaaccgggttaccccgtaccccggttaccccgtaacccccgttaaccgggttaaccccccg

SEQ ID NO: 405746 - DNA, 583 bp, Homo sapiens
  misc_feature: GZ8MTXP01AJA9H.21.67.G01.1.454.CMB.2.raw
  modified_base (347)..(347): a, c, t, g, unknown or other
  modified_base (397)..(397): a, c, t, g, unknown or other
tcagtcgtcgctcgcacgaccggtgctcgatttagagtatacatattggggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttggtgcgacaggcccttggacaagggcttgagtggatggggatggggccgaccttcgacgtaaacggaaagngtggagtagtggtacaggtaatttcgaggcagtaattaccgtgaaccacngactcatccgagggcacacgacctagttaggactgaggacctagagagtagacgacacggcacgatattagtgtagcgcggaggtgggggtctagttgagtactacgtaatagtttattcgttacgttggacgttcgttggggacaaagggcctaacggtaccacccggttcctcccgcgtccccg

SEQ ID NO: 405747 - DNA, 794 bp, Homo sapiens
  misc_feature: GZ8MTXP01BMF1M.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgactatagtatcagttgggtgcgacaggcccttggacaagggcttggagtggagtgggagtggggccgtaccgttcgacgaaacggaagagtgggagtagtggtacaaggtaatttcgagggtcagtaacttaccgttgaaacccaacgaacgactacgactacccgaacggggcaacgacgtacccttacgttacggaaacgttaggaacggtaaacccgtaggaacgtaaagttacggggaaccgaaccgaccgggacccaaaccgtaagtttaagtttaacgtttacggttacgggaccggtccgggtaaggggttacggggggtacctttaaggttttacgggttaaacggtaaccgtttaaaccgtttaaaccttttaaagttttaaccgttttaaaccgttttacggtttacgggttaaccggtttacgggttcgggggttaaccgtaaaacgggggtaccccgtaaccggggttacccgtaccccgggttaccccgttaaccccccgttaacggttaaccccccg

SEQ ID NO: 405748 - DNA, 716 bp, Homo sapiens
  misc_feature: GZ8MTXP01DWKP6.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtggggcctcggtgaaggtctctgcagggcctgtggttactagtttttccgacttatagtatcgaggttgggtcgcgacaggccccttaggactaagggcttggagtggagtggggatcggggcccgtacgttcgacgaaacgggaaagagtgggagtagtggttacaagggtaatttcgacgggcaaggtaacttaccgtaggaaacccacaaggactacacgtacccgacggggacaacgacgtacccttaacgttacggaaacgtaggaacggaaacccgttaggaaacggaaagtacgggaaaccgaccgaaccgggaccaacgtaattaagttagtttacggaggaccggacgggtagggtcgggggtacttaagtttaggtaacgtacttacttaacttaagtttactttaacgtttcgtagggtacgttacggttcggggaacgtaaacggggacccgtaaccggtccgacccggttacccgtccccgttaacggtcccccg

SEQ ID NO: 405749 - DNA, 671 bp, Homo sapiens
  misc_feature: GZ8MTXP01DNKLQ.21.67.G01.1.454.CMB.2.raw
  modified_base (261)..(261): a, c, t, g, unknown or other
  modified_base (273)..(273): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggcctggtgagtctctgcgaggcctgtggttactagttttccgatatagtntcgaggttggtncgacacggccttggacgaagggtcttggagtggagtggggagtcggggccctacgttcggacgaaacggaagagtgggaagtagtggtacgaggtaatttcgaaggactaagtaacttactgaaacccagcgactcaacgtccgacgggacaacgacgtcctagttaggaacgtggaacgacgtagaagagtacggaacgacgacggactaactaagttaattagttggtacgcggtacgggtaggggtacgggggtacttagtttagaacgtaaccttaacgtaactttagtttaactttacgtttcgttaagggtccgttagggttcggggaacggtaaaccgggtaccgtaacggtacccgtacccgttcccgtaacccgttaaccgtaaccccg

SEQ ID NO: 405750 - DNA, 610 bp, Homo sapiens
  misc_feature: GZ8MTXP01BR9O4.21.67.G01.1.454.CMB.2.raw
  modified_base (287)..(287): a, c, t, g, unknown or other
  modified_base (589)..(589): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctctggttactagtttttccgactatagtatcagttgggtgcgacnggcccttggacaagggcttgagtggatgggatggggccacgttcgagaaacggaagagtgggagtagtggtacaggtaatttcgagggacagtaacttaccgtgaacccacaagactcgatccgacggggcacacgccctacgttcggaactggacggaacctaggaagtaagtggacgacgacgggaccaacgatacttagttgtgcgtcggaggttgggggctagtttgtaagtacgtactaacgttatttattacttcgtggtacgttcgttggggacgtaaagggacccgtcggtccnccgttccgtcccgcgtccccg

SEQ ID NO: 405751 - DNA, 743 bp, Homo sapiens
  misc_feature: GZ8MTXP01EEN6G.21.67.G01.1.454.CMB.2.raw
  modified_base (288)..(288): a, c, t, g, unknown or other
  modified_base (357)..(357): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcagggcctcgtggttactagtttttccgacttatagtatcgagttgggtgcgacnggccctggacgaagggtcttaggagtggagtggggatcggggcccgtaccgttcgacgaaacggaaagngtagggagttagtaggtacaaggtaatttcgaacggggactaaggtaactttacccttagaaacccaacgtaaggtacctacgaacgtcccgaacggggcaacgacgtacccttaacgttacggaaacgtaggaacgggtaaaccctaggtaaacgggaaacgttacggggaaccgaaaccggacccggggtaaccctaaacgttaaggttaaagttttaacggtttgggacggtacgggaccgggtaaagggtcgggggtaccttaaggtttacggtaaacgtacttaacgttaattagtttacttacgtttgtacggtacggttcggttaggggacgtaaacgggcctaacgggtcccaccggttcctccccgaagtaaccccg

SEQ ID NO: 405752 - DNA, 271 bp, Homo sapiens
  misc_feature: GZ8MTXP01ADBYZ.21.67.G01.1.454.CMB.2.raw
  modified_base (266)..(271): a, c, t, g, unknown or other
tcagtcgtcgctcgcacgaccggtgctcgatttagagtatacatattgggtttgggggcatttgtagactactactattattacttcttggacgtctggggcaaagggaccacggtcaccgtctccccagcctccaccaagggcccatcggtcttccccctggcgccctgctccaggagcacctccgagagcacagcggccctgggctgcctggtcaaggactacttcccgagcgacgactgagcgggctggcaaaggcgcatagnnnnnn

SEQ ID NO: 405753 - DNA, 713 bp, Homo sapiens
  misc_feature: GZ8MTXP01DF0IS.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcagggcctcgttggttactacgtttttccgacttatagttatcgaggttgggtgcgacgacggccccgttggacgaagggtcttaggagtggatgggagtggggcccgaccgttcggacgaaacggaaagagtgggagtagtggtacgaaggtatttcgagggacagtaacttacgtgaaacccagaagactacacgtccgacgggtcacgacgcctaagtggaacgtggaacgaaccgtaggacgtaagtacgggaacgacgaccggaccaacgtattaagttagttggtacggcggtacggtaggggtcgggggtacttagtttacggtagtaaccgttaacttaaccgttaaattttacgtttacgtttcgtttacgggtacgggttccggttgggggttaaaccgtaaaaccgggggtaccgtaacccggggttaccgtaacccgggttccctaacccccgttccggtaacccccg

SEQ ID NO: 405754 - DNA, 730 bp, Homo sapiens
  misc_feature: GZ8MTXP01B8TAM.21.67.G01.1.454.CMB.2.raw
  modified_base (356)..(356): a, c, t, g, unknown or other
  modified_base (720)..(720): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctctggttactagtttttccgactatagtatcgagttgggtgcgacaggcccttggacgaagggtcttggagtggagtgggatggggcccgtaccgttcgacgaaacggaaagngtagggagtagtggtacgaaggtaagtttcgaaggggacaaggtaaactttacccgttaggaaaccctaacaaggtacctaccgaacgttacccgacgggtacaccgtacgaccgttaacgttacggaacgtacggaacggaaccgttaggaagtaacgtacgggaaccgacgaccgggaccaacgtattaattacgttagtcgacggtacgagggttgggggacttaggtttagtaacgtacttacgtttaacttaagttttaacgtttacgttacgtttacggtaaccggtttacggttggggaaccggtaaacgggtaccccgtaaccgggttacctacccggttcccgttaacccccggngtaacccccg

SEQ ID NO: 405755 - DNA, 672 bp, Homo sapiens
  misc_feature: GZ8MTXP01D6P8Z.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgacttcgacaaacggaaagatgggagtagtggtcaggtaatttcgaggcagtaattacctgaaccacaagactcatccgacgggcacgacgcctacttggaactggaacgaacgtagagaagtggacgacgacggaccacgtagttaatttacgttagtcggtcggaccggtaggggttacggggggtactaaggttttcgggtaaacgttaaccgttaaccttaaagtttaacgtttaactttaacgttttcgttacgggtaccggttcggttacgggggttacgaaaacgggggtacccgtaaccgggttcccgtacccggttacccttcccccgaacgtaacccccg

SEQ ID NO: 405756 - DNA, 712 bp, Homo sapiens
  misc_feature: GZ8MTXP01EJY39.21.67.G01.1.454.CMB.2.raw
  modified_base (429)..(429): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcagggcctcgtggttactagtttttccgactatagtatcgaggttgggtgcgacacggccccttggacgaagggtcttggaggtggagtgggagtcggggccgtaccgttcggacgtaaacgggaaagagtgggaagtagtggtacgaaggtaagtttcgaaggggacaaggtaacttaccttaggaaacccaacngtactccatacccgacgggcacgacgtaccctagttaggaactggaacggtaaccgtaggaagtaagacgggacgaaccgacggtaccaactaattagtttaagttggtacgcggcggtaagggtgggggtacttagtttggtaacgtaacgttaacctaactttaatttacttttacgtttacgtttacgggtaacggttacggttacgggggttaacgtaaaacggggtacccgtaaccggtacccgtacccggttacccttccccgaaccgtaacccccg

SEQ ID NO: 405757 - DNA, 785 bp, Homo sapiens
  misc_feature: GZ8MTXP01CG27C.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcgagttgggtgcgacaggcccttggacaagggtcttgagtggagtgggatcggggccgtaccgttcggacgaaacggaaagagtgggagtagtggtacaaggtaatttcgagggcaagtaacttaccgttgaaacccacaaggtacctcgactcccgaacggggcaacgacgtacccttaacgttacggaaacgttggaaacggtaacccgtaggaaacggtaaagtacgggaaccgaacgaaccgggacctaacgtaacgttaagtttaacgttggtacggtacggtaccgggtaaggggttcggggggtaccttaaggttttacggtaacggtaaaccgtttaaacgttaacctttaaagttttaacgttttaaaccgtttccggtttacggggttaaccggtttaccgggttacggggggttaacccgtaaaaacgggggtaccccgttaaccggggttaccccgtaaccccgggttaccccgttaaccccccgaacgttaacccccccgg

SEQ ID NO: 405758 - DNA, 726 bp, Homo sapiens
  misc_feature: GZ8MTXP01CMAIJ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatcgaggttgggtgcgacgaggcccgttaggacgaaggtcttggagtggagtgggagtcggggcccgtaccgttcgacgaacggaaagagtagggaagtagtaggtcaaggtatttacgacgggacagtaattaccgtacgaaacctacgaacgactacacgtcccgacgggtacacgacgtccttacgtacggaacgtggaaccggtaacctaggtaacgaagtacggaaccgacgaaccggacaacgtagttatttaagtcgtaggaccgtcggtagggtgggggtaccttaggttttaggaacgttaccttaacgttaactttaaagtttacgttttaaccgtttcggtttaacgggtcgttaccgggttacggggaacgtaaaaccggggtaccccgtaacgggtaccccgaccgggtttacccctaaccccgttaaccgtaacccccgg

SEQ ID NO: 405759 - DNA, 713 bp, Homo sapiens
  misc_feature: GZ8MTXP01D6Z3Y.21.67.G01.1.454.CMB.2.raw
  modified_base (398)..(398): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgagtgaagagcctggggcctcggtgaaggtctcctgcagggcctcgtggttactagtttttccgatatagtatcaggttgggtgcgaacaggcccttggacagggcttgagtggatgggatgggcctacgttcgacgaaacggaagatgggatagtggtacaaggatttcgacgggcaagtaacttaccgttacgaaacccanggactcaacgtacccgacgggcaacgacgtaccttaagttacggaactaggtaacgggaaccctaagggacgaaagtcgggaaaccgaaccgacgggacctaaccgtaagttaacgttttaagttcggtacggacggccggtaaggggttcgggggtaactttgtttaacggttaacggtaacctttaaccgttaaacgttttatttaacgtttaccgttttcgttacggggtacggttcccgttgggggaaaccaaacggggtcgtaaccgggttcccaacccgttccccgttaaccccgaagttaaccccccg

SEQ ID NO: 405760 - DNA, 766 bp, Homo sapiens
  misc_feature: GZ8MTXP01B1WQR.21.67.G01.1.454.CMB.2.raw
  modified_base (414)..(414): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcgtggggcctcggtgaaggtctccgtgcgagggcctcgtggttactagtttttccgacttatagtatcgtaggttggtgcgacacggccttaggacgaagggtcttggaggtggtagtgggagtcgggaccgtaccgttcgacgaacggaaagtagtagggagtagtggtacgaggtattcgaggcagtacttaccgtgaaccacgngactacgactaccgacgggcaaccgacgtacccgttagttaacggaaacgtacggaaaccggtaaccgttaaggaacggtaaacggtacgggaaaccggaaacccgaaccgggtaccaaaccgtaaggttaaagttttacgttagggtacgggaccgggtaccgggtaggggttacgggggtactttacgggtttagtaaaccggtacttaaacgttaactttaacgtttaacttttacgtttagttacgggtacggtttaccgggttcggggttaaacggtaaacgggggtaccccgttaacgggttaaccccgtacccgttacccgtcccccggttaacgtaaccccccg

SEQ ID NO: 405761 - DNA, 797 bp, Homo sapiens
  misc_feature: GZ8MTXP01CZ7LC.21.67.G01.1.454.CMB.2.raw
  modified_base (287)..(287): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggcctcgtggttactagtttttccgatatagtatcgagttgggtgcgacnggcccttggacaagggtctgagtggatgggagtgggccgtaccttgacgaaacggaaagagtagggagtagtggtacgaaggtatttcggaaggggtcaagtaactttacccgttaggaaaccctaacgaaggtaaccttacgaaacgttaccccggaacgggggacccaaacgaacggtacccttaacgtttacggaaacgtacgggtaaacggaaacccgttaggaaagggtaaagtacggggaaccgaacgaaccgggaccctaaacgtaagtttaaactttaggtttaggtcggtacggtaccgggtagggttcggggggtaaccttaggttttaggtaacggtaaacgtttaacttaacgtttaactttaaacgttttaccgttacggttttacggggtaaccggtttacgggttacggggggaaaccgtaaaaccggggggtacccgtaaccggggtccctaacccgggttaccccttaacccccggaacgggttaaccccccg

SEQ ID NO: 405762 - DNA, 739 bp, Homo sapiens
  misc_feature: GZ8MTXP01B54S9.21.67.G01.1.454.CMB.2.raw
  modified_base (427)..(427): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtagaagaagccgtggggcctcggtgaggtctcctgcgaggcctcgtggttactagtttttccgattatagtatcgaggttgggtgcgacaggcccttggacaagggtcttggagtggagtggggacgtcggggacccgtaccgttcggaacgaaacgggaaagagtgggagtagtggtacgaaggtaatttcgaagggtcaagtaaacttaccgttagaaacccaangacctacacgtacccgaacggggcaacgacgtccttacgttacggaactaggaacggaacctaggaagaagtacgggaaccgaacgacggaccaacgtaagtttaacgtttagttacggtacggacggtccgggtaaggggtgggggttaccttaggttttaggtaacggtaacccttaagttaacctttaagtttaaacgttttaccgtttacgtttacgggtacggttacgggttacggggaaccggtaaacggggacccgtaaccgggttcccgaacccggttccccgttcccccgaacgtaacccccg

SEQ ID NO: 405763 - DNA, 833 bp, Homo sapiens
  misc_feature: GZ8MTXP01EX0II.21.67.G01.1.454.CMB.2.raw
  modified_base (362)..(362): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagagccgtggggctcggtgaggtctctgcagggctcgtggttactagttttccgattatagtatcgaggttgggtgcgacgtacggccttggaacgaaggtcttggaggttggagtggggagtcggggacccgtaccgttcggacggaaacggaaaggngtagggagttagtggtacgaggtagttcgacggactagtaacgttaccgtacgaaacccagaacgtacctacgaaccgtacccgaaccggggtaccaacgtaccgtacccgttaaacgttacgggaaacgttacgggaaccggtaaacccggtagggtaaacgtaaacgggtaccggggaaccggtaaaccgaacccgggtaaccctaacgttaaacgggttttaacgtttaaacggttgggttacgggcccgggtaagggggtaacgggggttcgggggttaactttaacgggttttggtaaacggttacctttaaacgttaaaccgttttatttttaaccggtttaacgttttccgggttaacgggtccggtttacgggttagggggttacccgtaaaaacgggggtaccccgtaaccgggttccccgtaaccccggttcccgtaacccccggttccggtaaccccccg

SEQ ID NO: 405764 - DNA, 748 bp, Homo sapiens
  misc_feature: GZ8MTXP01DSWX3.21.67.G01.1.454.CMB.2.raw
  modified_base (223)..(223): a, c, t, g, unknown or other
  modified_base (235)..(235): a, c, t, g, unknown or other
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgagtgaagagctgggctggtgaggtcncctgcaggcctntggttactagttttcgactatagtatcgagttggtgcgacaggcccttaggacaagggcttggagttggagtgggagtcggggcctacgttcgacgaaacggaaagagtgggagtagtggtacaggtaatttcgacgggactaagtaacttacccgttagaacccgactaaggaacctacgactacccgaaccggggtacaacgtacgtaccttaacgttacgggaaacgttcgggtaaacggtaaacccgttagggaaacgtaaacgtacgggaaaccgaacgaaccgggaccctaaaccgtaaggtttaaacgtttaacggtttagggtaccggtccgggtaccggtaggggttacgggggtactaccggttttaggtaacggtaacccttaagtaacctttaattacgttttaccgttcgttacggtaccggttacgttcgggggttaactaaacgggggtacctaaccgggttaccacccggttccctaaccccgttaacgtaaccccg

SEQ ID NO: 405765 - DNA, 791 bp, Homo sapiens
  misc_feature: GZ8MTXP01EME8Y.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagtttttccgactatagtatcgaggttgggtgcgacaggcccgttaggacgaagggcttaggaggtgggtagtggggagtcggggacccgtaccgttacgacgaaacgggaaagtagttagggagttagtggtacaaggtaactttcggacgggtacaagtaacgtttacccgtagaaaccctagaacgtacgtaccaacgtccccggaacggggtacacgtaacgtaccgttaacgttacggaaacgtaggaacggtaaacccgttaaggaacggtaaacgtacgggaacgaacccgacgggaccccaattaaggttaacgtttaggttacggtacggtcggtaaccgggtagggtcgggggtacttaggtttacgggttaactaaccgtttaacgttaaccgtttaatttacgtttaaccgttttacggttacgggttaacccggttgggttaccgggggaacgtaaacgggggtaacccggtaaccggttacccgacccggttacccgtaacccccgttaaccgttaacccccg

SEQ ID NO: 405766 - DNA, 712 bp, Homo sapiens
  misc_feature: GZ8MTXP01AEEFN.21.67.G01.1.454.CMB.2.raw
  modified_base (428)..(428): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtagaaggtctccgtgcagggtcctcgtggttactagtttttccgattatagtatcgaggttgggtgcgacagggccccttagggacctaaggggcttaggaggtggagtggggatcggggaccctaccgttcggacgaaacgggaaagagttagggagttagtggtacaaggtaatttcgacgggctagtaattacctgaaacccanaacgtactcgacgtcccgacgggcacgtacgacccgttacgttaggaacgttaggaacggtaacccgtaggaacgaacgtacgggaaccggaccgaaccgggaccctaacgtacgttaagttacgtggtacggccgtccggaggtcgggggtacctagttcgtaacgtacttactaacttatttacttacgttcgttacgggtaccgttcgggttcggggttaaccgtaaacgggacccgtaacggtccctacccgggttccctaaccccgaacgtaacccccg

SEQ ID NO: 405767 - DNA, 724 bp, Homo sapiens
  misc_feature: GZ8MTXP01DRKCI.21.67.G01.1.454.CMB.2.raw
  modified_base (379)..(379): a, c, t, g, unknown or other
  modified_base (501)..(501): a, c, t, g, unknown or other
  modified_base (542)..(542): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctggaggtgaagaagccgtgggcctggtagaaggtctctgcaggctgtggttactagttttcgatatagtatcgtaggttgggtgacgacgacggcccttagggaacgtaagggtcttaggaggtggtaagtggggagttcggggaccccgtacgttcgacgaaaacggaagagtaggagttagnggtacgaaggtaatttcgaaggggacaagtaacgttactacggaaaccagaacgactacacgtaccgacgggacaacacgtactacgttaggaaccttgggaacgtaactaggaaacgtaancgggaaacgacgaaccggtacaaacttagtaagttttaggnggtaggacggtcggagggttacgggtacttaagtttacggaaacttacttaacgtttaactttaacgttttacgttaccgtttgggtacggtaaccggttacggttacggggaaacggaaaaccgggtcccgtaaccggtacccgtaccccgttacccctaaccccggttaaccgaaccccg

SEQ ID NO: 405768 - DNA, 783 bp, Homo sapiens
  misc_feature: GZ8MTXP01D0RML.21.67.G01.1.454.CMB.2.raw
  modified_base (271)..(271): a, c, t, g, unknown or other
  modified_base (276)..(276): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagctggggctggtgaggtctctgcagggctgtggttactagttttcgactatagtatcgaggttggncgacncggcctaggacgaagggcttggagttggagtgggaagtcgggcccgtacgttcggaacgaaaacgggtaagtagtaggtaaggtagtggtacgaaaggttagtttccggaagggtactaaaggtaactttacccgttacgaaaaccccgaagtaacggtaacctaccgaccgtacccggaccggggactacgaaccgtaccgttaacgttacggaaacgtacgggaaacggtaaacccgtaggaaacgaacggtacgggaacgaaccgaccgggactaaccgtaagtttaacgtttaagttcggtacggtaccggagggtagggtcgggggtaacttaggttttacggaacggttaaccttaaggttaaacgttttaactttaattttaaccggttttcgttacggggtaacggtttcgggttacgggggttaaaccggtaaacggggtaaccccgtcgggtttaaacccgcccggttacccgttaaccccgaacgttaacccccgg

SEQ ID NO: 405769 - DNA, 798 bp, Homo sapiens
  misc_feature: GZ8MTXP01EAFEI.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggccttgtggttactagtttttaccgatatagtatcgaggttgggtgcgacgacggcccgttggacgaagggtcttggaggtggagtggggagtcggggacccgtaccgttcgaacgaaaacgggaaagtaggtagggtaagtaggttaggtaccgtaaaggggttaaactttccggaaggggtactaaaggttaaactttacccgttacgaaaccccaactaacggtactcaaccgtacccggacggggacaacgacgtacccgttaacgttacggaacgtacgggaacgtaaacccgttaggaaacggtaacgaccggaaccggaacccgaaccgggaacccaacgttaactttaagtttacgttagggttacggacgggtacggggtacgggttggggggtaacttaggtttagggtaacgtaacgttaaccttaaacgtttaatttaactttacgtttacgttcggggtacgttacgggttcggggttaacggaaaccggggtacccgtaaccggtacccgtacccgttaccccgtaaccccgaaccgtaacccccg

SEQ ID NO: 405770 - DNA, 617 bp, Homo sapiens
  misc_feature: GZ8MTXP01A7FK1.21.67.G01.1.454.CMB.2.raw
  modified_base (353)..(353): a, c, t, g, unknown or other
  modified_base (486)..(486): a, c, t, g, unknown or other
  modified_base (525)..(525): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggcctgtggttactagtttttccgattatagtatcgagttgggtgcgacaggcccttggacaagggtcttggagtggagtggggatcggggccaccgttcgacgtaaacggaaagngtgggaagtgtggttacaagggtaatttcgaggggcaaggtaatttacctggaaacccacgaagacctacgactcccgaacggggcaacgacgtacttacgtaggaactggaacggttaaccaggaagaacgngggacgacgacggtaccaatattattaagttgagcgggnggaggtggtattagttgtactactataattattattcttgtggtcgttggcgggacgaacggcgtaacgtcgtaccgttccctccgcgcccg

SEQ ID NO: 405771 - DNA, 731 bp, Homo sapiens
  misc_feature: GZ8MTXP01CBKZM.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctctggttactagtttttccgactatagtatcaggttgggtgcgacaggccccttggacaagggtcttggaggtggagtgggagtggggcccgaccttcggacaaacggaagagtgggtagtagtggtcaaggtaatttcgacggggcagtaacgttacccgttagaaccctacaaggacctacacgtcccgacggggccacgacgccctacgttacgggaacgtacggaacggtaacctaggaagaacgtacgggacgaaccgacgggacccaactaattatttacgttggtcgaccggtcggtacgggtcgggggtacttaggtttacggtaacggtacttaaccgttaaacgttattttaacgtttaccgtttcggtttaacgggccggtttacgggttcgggggttaaccggtaaaacgggggaccccgttaacccggggtacccgtaccccggttacccgtaacccccgaaccggttaaccccccg

SEQ ID NO: 405772 - DNA, 687 bp, Homo sapiens
  misc_feature: GZ8MTXP01C72WZ.21.67.G01.1.454.CMB.2.raw
  modified_base (278)..(278): a, c, t, g, unknown or other
  modified_base (343)..(343): a, c, t, g, unknown or other
  modified_base (486)..(486): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcgtggggcctcggtgaaggtctcctgcagggcctgtggttactagttttcgatatagtatcgagttgggtncgacaggcccttggacaagggtctgagtggagtgggatgggccgacgttcgacaaacgggaaagntgggagtagtggtacagggtaaatttcgaaggggcaaggtaaattaccgtgaaacccaataacgactcaagtccgaaggggacacacgcctaacgttgggaaactggaacggaacctagagaagcggacgacgacggaccaanaagttatttaagtgttaggacgtcggaggtgggggtacctagtttgggtaacgaacttaacctaactttaatttaacggtttaaacctttcgtttaggggaaacccggtttggttacgggggaaacgaaaaccgggggtaacctaacccgggggtttacccaaacccgggtttccctaacccccgttaacgggaacccccg

SEQ ID NO: 405773 - DNA, 763 bp, Homo sapiens
  misc_feature: GZ8MTXP01BNVHD.21.67.G01.1.454.CMB.2.raw
  modified_base (409)..(409): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgactatagtatcaggttggtgcgacaggccccttggacgaagggcttggagtggagtgggagtggggccgtaccgttcggacgaaacggaaagagtgggagtagtggtacgaggtaatttcgagggcagtaacttacctagaaccangactcatcccgacgggcaacgacgtacccttacgttacggtaacgtacggaacggtaacccgtaggaagtaacgtacgggaaaccgaccgaaccgggaccctaacgtaagtttaacgtttagttacggtacggaccggtacggtaacgggtcggggggtaccttaacggttttagggtaaacggtaaccgtttaacgttaaaccgtttaaattttaaacgttttaaccgttttaccggtttacggggttaacggttacccgggttagggggttaacccgtaaaacgggggtaccccgttaaccggggttacccgtaccccggttccccgtaacccccgttaacccgtcccccgg

SEQ ID NO: 405774 - DNA, 738 bp, Homo sapiens
  misc_feature: GZ8MTXP01CL6MW.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctcggtgaaggtctctgcgaggcctcgtggttactagttttcgactatagtatcgtagttgggtgcgacgacggtcccgttaggacgaagggtcttaggacggtggagtgggagtcgggaccgtaccttcggacgaaacggaagagtgggagtagtggtactaggtattcggacgggatacgtaagttaccgtcgaaacccacgaacgtactaccgacgtacccggacgggaccaacgacgtacccgttagttacggaacgttacggaacggtaaccctaggaaacggtaacggtacgggaaccgaccgaaccgggaccctaaagtacggtttaaagtttacgttagggtcggaccggtaccgggtaggggtacggggtaccgttaagtttacgggaacttaccgttaacttaacgttaactttattaaccgtttcgtacggtcgtttacgggcggggttaaccgtaacgggaccgtaaccggttcctaccccggttcctaacccccggttaacgtaaccccg

SEQ ID NO: 405775 - DNA, 762 bp, Homo sapiens
  misc_feature: GZ8MTXP01B6IL3.21.67.G01.1.454.CMB.2.raw
  modified_base (285)..(285): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtcgcccactcccagactcaactggtgcagtctggacctgaggtgaagagccgtggggcctcggtgaaggtctctgcgagggcctcgtggttactagtttttccgacttatagtatcgaggttgggngcgacgacggcccgttaggaccgtaagggtcttggaggtggagtgggagtcggggcccgtacgttcgacgaaacggaaagagtgggaagttagtggtacgaaggtaagtttcgagggtactaaggtaacttaccgttacgaaaccctaacgaacggtaccttacgaaccgtaccccgaacgggccaaacgtacgtacccgttaacgttacggaaaccgttaggaacggtaaacccgtaggaaggaaacgtacgggaaccgacgaccggacaacgtaattaactttagtagtacgccggtacggtagggttacggggacttagttacggtaacgtaacttacgttaacgttaacttttacgtttaccgtttcgttaacgggtaccgttacgggttcgggggaaaccgttaaacgggggtacccctaacgggttaccccgtaccccgttacccgtaacccccgttaacgtaaccccccg

SEQ ID NO: 405776 - DNA, 763 bp, Homo sapiens
  misc_feature: GZ8MTXP01AITJ0.21.67.G01.1.454.CMB.2.raw
  modified_base (330)..(330): a, c, t, g, unknown or other
  modified_base (363)..(363): a, c, t, g, unknown or other
  modified_base (736)..(736): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctcggtgaaggtctctgcaggcctgtgttactgttttccgattatagtatcgtaggttgggtcgcgacgacggtcccgttagggaacgtaagggtcttaggaggtggaggtgggngtcggggcccgtacgttcgacgaaacggtaagngtagggagtagtggtactaaggtaagttcggacggtactaaggtaacttacccgttagaaaccctaaagcgactaccgtaacgtacccggacgggtacgaacgtacccgtacccgttaagttacggtaaacgtacgggaaccggtaaaccgttagggaaagtaacggtacgggaaacccggaccgaaccgggtacctaaacggttaattaacgtttttaacggttcgggaaccgggtccggtaaggggaggggttacgggggtacctttaaggtttaacgtaacgtaacctttaagttaacgtttaattacgtttacgttggtacggtacgttcgggttacggttaaccgtaaacggggcctaaccggtcccnccgttacccgtcccgaacgtaaccccg

SEQ ID NO: 405777 - DNA, 775 bp, Homo sapiens
  misc_feature: GZ8MTXP01DPGZL.21.67.G01.1.454.CMB.2.raw
  modified_base (221)..(221): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggngaaggtctctgcgagggcctgtggttactagttttccgactatagtatcgaggttggtgacgacgacggcccttagggacgtaagggtcttaggaggtggagtgggagtcggggccctacgttcgacgaaacggaagagtgggaagtagtaggacgtaaggtaagtttccgaaggggtactaaaggtaactttaccgtacgaaacccaacgtaacggtacctacctacgtaccccggaacggggccaacgtacgtaccgttaacgtacgggtaaaccgtggaaacgggtaacccgtaggaaacgtaacggacggaacgaccgaacggacccaagtaacggttaatttagttaggtcgtacggaggtaaggggttcgggggtaccttaggtttaacggtaacttaaacgttaactttaaactttaacttttaaacgttcgttttaccggttagggtaccccggttagggttacggggttaaaccggtaaaaccggggtacccgtaaccggggttccgtaccccgtttacccgtcccccgttaaccgtaacccccg

SEQ ID NO: 405778 - DNA, 657 bp, Homo sapiens
  misc_feature: GZ8MTXP01BOHTL.21.67.G01.1.454.CMB.2.raw
  modified_base (162)..(162): a, c, t, g, unknown or other
  modified_base (383)..(383): a, c, t, g, unknown or other
  modified_base (516)..(516): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtcncccactcccagactcaactggtgcagtctggacctgaggtgaagagcgtgggcctcggtgaggtctctgcgaggcctgttgttactacgtttttccgatatagtatcgaggttgggtgcgacgaggcccttaggacgaagggtcttggagtggagtgggatcggggccctacgttcgacgaaacggaagtgtggagtagtggtacaggtagtttcgagggntaagtaattaccgtgaacccagcgactcacgtcccgacggggcacgacgtaccgttagttaggaacgtggacggaaccgtagacgtaagtggaacgacgacggaccaacgtattacgttagttgcgtacgggnggtgggtgggtacttagttagtaacgtacttaacttaactttaagtttactttcgtttggttacgggtacggttcggttacggggaacgtaaacgggtacccgtaacggtccctacccgttcccgtaacccgttccggccc

SEQ ID NO: 405779 - DNA, 624 bp, Homo sapiens
  misc_feature: GZ8MTXP01B5CB6.21.67.G01.1.454.CMB.2.raw
  modified_base (344)..(344): a, c, t, g, unknown or other
  modified_base (542)..(542): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttacagtttttccgactatagtatcagttgggtgcgacaggcccttggacaagggctgagtggatgggatggggccgacgttcgacgaaacggaaagngtgggagtagtggtcaggaatttcgacgggcagtaagttacctaggaaccaacgcgactacgactccgaacggggcaacgacgtcctacgttacggaactggaacggaaaccgtaggaacgtaagtcgggacgacgacggacacgtagtattagttgagcgcgaggtggggctagttgagtacgtataacgtaatttnttacgttcgttggtacgttcgttggggaaccgtaacggggtacccaacggttccaccggttaccctccccgaacgtcccccg

SEQ ID NO: 405780 - DNA, 656 bp, Homo sapiens
  misc_feature: GZ8MTXP01DX7GI.21.67.G01.1.454.CMB.2.raw
  modified_base (217)..(217): a, c, t, g, unknown or other
  modified_base (399)..(399): a, c, t, g, unknown or other
  modified_base (510)..(510): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggctggngaggtctctgcaggctgtgtactagttttcatatagtatcgagttggtgcgacgaggcccgttaggacgagggtcttggaggtggagtgggagtcggggaccgtacgttcgacgaaacggaagtgtaggtagtagtaggtacgtaaggtagttcgacggctaagtaacttctacgaaacagngactacgacgtaccgacgggacacgacgtacccttagttacggaactaggaacggtaacaggaagaagtacggaccgaacgacggacactaagggttaactttgtagtcgnggacggtgggtacgggtattacgtttaggaacttacttaaccttaatttagtttacgtttaactttcggttacggtacggttcggttacggggacggtaaacgggaccgtcggtacccaccggttcctaacccgaacgtaaccccg

SEQ ID NO: 405781 - DNA, 811 bp, Homo sapiens
  misc_feature: GZ8MTXP01CDU8L.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctctggttactagtttttccgactatagtatcagttgggtgcgacaggccccttggacaagggcttggagtgggatggggatggggccgaccgtttcggacaaacggggaaagagttgggaacgttagtggtacgaagggtaaattttcggaacggggtactaagtaactttaacccgttgaaaccctaacgaaggaccttacgacgtaccccgacggggacaacgtacggtcccttaaccgttagggtaaaccgtggaaacgggtaaccgtacggtaaacgaaacggttcgggaaaccgaaccgaccgggaccaaccgtaaggttaactttaagttgggtacgcgggtccggacggggttgggggtacttaggttttacggtaacggtaaccgtttaacgttaaccgttttaattttaacgtttaaccgttttcggtttacggggttaccgggtttaccgggttacggggggaaccggttaaaaaccgggggtaccccgttaaccgggggttaaccccgtaccccgggttaaccccgtttaacccccccgaacggtttaaccccccccgg

SEQ ID NO: 405782 - DNA, 823 bp, Homo sapiens
  misc_feature: GZ8MTXP01BGE51.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagtttttccgactatagtatcgaggttgggtgcgacgaggcccttggacaagggtcttggaggtggagtgggagtcggggccgtaccgttcggacgaaacggaaaggagtagggaacgttagtggttacgaagggtaaagtttcggacggggtacctaaggtaaacgtttacccgttcggaaaacccaacgaacggtaccctacgaacgttaccccgaacggggtaccaaaccgtacgtaacccgtttacgttacgggaaacgttcggaaacgggtaacccgtaaggaacggtaaacgtacggggaaccgaacccgaaccgggtacccgtaacgtaacgttaagtttacggttacgtacgggaccggtaccgggggtagggttccgggggtacttaacggtttggtaaacgttaaccgtttaacgttaaacctttaagttttaaccgtttaccggtttaccgttaggggttaaccggttcgggttaacgggggttaacccgtaaacggggaccccgttaacccgggtcccgtaccccgggttacccgtcccccgttccggtaacccccg

SEQ ID NO: 405783 - DNA, 709 bp, Homo sapiens
  misc_feature: GZ8MTXP01E3RL6.21.67.G01.1.454.CMB.2.raw
  modified_base (553)..(553): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatcgagtggtgcgacgcggcccttggaacgaagggcttggaggtggatgggagtcggggccctaacgttcgacgaaacgggaaagagtgggagtagtggtacgaaggtaatttcgaagggactaaaggtaactttaacccgtgaaacccaacgaacgtactacaacgtccgaacgggacaacaacgtccgtaacgttacggaaaccgtaggaaacggaaccttaggaacgaagtacggaacgacgaccggacaacgtataagttagttggagcggtacggngggtggggacttagttagtaacgtacttaactaacttaaatttacgtttaactttaccggttagggtaccgttacgggttcggggaaccggtaaacggggtaccccaacggggtaccccaaccccgggttcccttaacccccgaagtaaccccccg

SEQ ID NO: 405784 - DNA, 660 bp, Homo sapiens
  misc_feature: GZ8MTXP01C00FW.21.67.G01.1.454.CMB.2.raw
  modified_base (289)..(289): a, c, t, g, unknown or other
  modified_base (398)..(398): a, c, t, g, unknown or other
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgatatagtatcgagttgggtgcgacnggcccttggacaagggcttgagtggatgggatgggccgacttcgacgaaacggaaagagtgggagtagtggtacaggtaatttcgaggcaagtattacctgaaacccangactcaactcccgaacgggcaacacgaccttacgtaggaactgaacggtaaccgtagaacgaagtcgggaacgaacgaccggaccaacgaattaacgttagttagtgaccggtacggagggtcgggggtactaggtttaggtaacgtacgttaactaacgttaatttatttacgttcgtttagggacgttacggttcgggggttaacgtaaacggggaccctaacgggtaccacccggttcctaaccccgaacgtaaccccg

SEQ ID NO: 405785 - DNA, 604 bp, Homo sapiens
  misc_feature: GZ8MTXP01B1NAL.21.67.G01.1.454.CMB.2.raw
  modified_base (239)..(239): a, c, t, g, unknown or other
  modified_base (392)..(392): a, c, t, g, unknown or other
  modified_base (467)..(467): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtggggcctcggtgagtctcctgcagggcctntggttactagtttttccgatatagtatcagttgggtgcgacaggccccttggacaagggcttgagtggatggggatcggggccacgttcgacgaaacgggaagagtgggagtagtggtcaggtaatttcgaggcagtaataccgttgaaccangactcatccgagggcacacgcctagtggactgagactgagatgacgacacggcacagtattacgtagtgcgcggnggtgggggactagttggtatactagtaacttatttagttaactttcgttgggtacgttcggttcggggacggtaaaacggggtcccgtaacggggtccgtaacccggttccgtaacccccgttaacggtaacccccg

SEQ ID NO: 405786 - DNA, 757 bp, Homo sapiens
  misc_feature: GZ8MTXP01C6V0U.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgttggttactagtttttccgactatagtatcgtaggttgggtgcgacaggcccttaggacgaagggcttggagtggagtgggagtcggggcccgtaccgttcggacgaaacggaaagagtagggaagtagtggtacgaggtatttcgacggcaagtacttaccttgaaacccagaacgtactacgacgtacccgacgggacacgacgtacctacgtaggaacgtggaacggaacgtagaagtaagtacgggaaccgaacgaccggtaccaacgtaagtttaacgtttacgttggtacggacggtaccgggtaaggggttcgggggtacttaggttttacggtaaacgtaaccgttaaacgtttaactttaaatttttaacgtttaaccgtttacggtttacgggtaaccggtttacggggttacgggggttaaaccgtaaaaccgggggtaaccccgttaaccgggtaccccgtaccccggttaccccgtaacccccgaaccgtaacccccg

SEQ ID NO: 405787 - DNA, 701 bp, Homo sapiens
  misc_feature: GZ8MTXP01BBY4T.21.67.G01.1.454.CMB.2.raw
  modified_base (241)..(241): a, c, t, g, unknown or other
  modified_base (403)..(403): a, c, t, g, unknown or other
tcagtcgtcgctcgcacgaccggtgctcgatttagagtatacatattggggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagctggggcctcggtgaggtctcctgcagggcctntggttactgttttccgatatagtatcgaggttgggtgcgacgaggccccttggacaagggcttggacgtggatgggatggggcccaccgttcggacgaaacgggaagacgtgggagtagtggtacaggtaatttcgaagggtcaagtattacctgaaaccangactcgactccgacgggcaacgacggacccttagttacggaacctgggaacggaacccgttaggaacgtaagtcgggaaccgacgacggaccctaaagtattaagtttacgtggtacgcgtacgggtaggtcgggggtaacttagtttgggaaactacgttaaccttaaacgttatttaagtttaccgttacgttacgggtaaacggttcccggttaaggggggacctaaaacggggggtccctaacggggttacccctaacccgggtttcccaacccccggttaaggtaaccccccg

SEQ ID NO: 405788 - DNA, 739 bp, Homo sapiens
  misc_feature: GZ8MTXP01EI9LQ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctggtgaaggtctccgtgcgagggcctcgtggttactacgtttttccgatatagtatcgaggttgggtgcgacacggcccgttaggacgaagggcttaggaggtggagtggggagtcgggaccgtaccgttcgaacgaaacggaaagtagtagggtaagttaggtaggtacgtaaggtaacgtttcggaacggggtacgtaaagtaacgttacccgttacgaaacccgtacgaacgtactacgacgtacccgaacgggtccaacgtacgtaccttacggttacgaacgtacggaacggtaacgtaggaagtaacggacggaacgacgaccggactactaaggtttaagtttagttaggacgtacgggacggtaggggtacgggggtacttaggttacgtaacggttaacctacgttaaatttactttaacgttttacgtttcgttacggggtacgttcggggttgggaaccggtaacgggacccgtaacggtaccgtacccgttcctaaccccgcgtaaccccg

SEQ ID NO: 405789 - DNA, 752 bp, Homo sapiens
  misc_feature: GZ8MTXP01DAO8C.21.67.G01.1.454.CMB.2.raw
  modified_base (307)..(307): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcgtggggcctcggtgaaggtctcctgcgagggcctgttggttactgtttttccgactatagtatcaggttggtgcgacaggcccttaggacagggcttgngtggagtgggagtcgggccgtaccgttcgacgaaacgggaaagagtagggtagtagtggtacgaaggtatttcgagggactaaagtaactttaccgttacgaaacccacgaacgactacaaccgtcccggacggggacacgaccgtaccgttaacgttaggaacgtagaacggaacccgtaggtaaacggtagtacgggaacgaaccgaccgggtaaccaacgttaacgttaagtttacgttaggtcgacgggtaccgggtaggggttccgggggtacttacggtttaggtaaacggttacctaacgtttaaacttaacgttttacttttacggtttaccgtttaggggtacccgtttacggggttcgggttaaacgggtaaacggggtacccgtccggttacccgaacccgtttccccgtaaccccgttaaccgtaaccccccg

SEQ ID NO: 405790 - DNA, 715 bp, Homo sapiens
  misc_feature: GZ8MTXP01BBK10.21.67.G01.1.454.CMB.2.raw
  modified_base (707)..(707): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagagccgtggggcctcggtgaaggtctcctgcgagggcctctggttactgtttttccgatatagtatcgaggttgggtgcgacgacgggccccttagggaaccgtaaggggtcttggaggtggagtggggagtcgggggacccgtaccgttcggaccgaaacgggaaagtagtagggtagtacgtgggtacaaggtaatttcgaggggtacaagtaactttacctaggaaccaacgaacgactcaacgtccccgacgggaccacgacgtacccttagttacgggaacttggaaccggtaaccgtaggaagtaacgtacgggaaaccgacgaacccgggacctaacgtaagttaacgtttaagttcggtacggccggtacgggtggggttgggggtacttagtttacggtaagttaccttaactttaagttatttacgttactttgtacggtacgttggttcggggactaaacgggtccaacggttccacccgttcccgtcccgngtaacccc

SEQ ID NO: 405791 - DNA, 721 bp, Homo sapiens
  misc_feature: GZ8MTXP01BQBQY.21.67.G01.1.454.CMB.2.raw
  modified_base (278)..(278): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtggggcctcggtgaaggtctctgcgaggcctcgtggttactagttttccgactatagtatcgaggttggngcgacacggcccgttaggacgagggcttggagtggagtgggagtcggggccgacttcgacgaaacggaagagtgggagtagtggtcgaaggtatttcgaggactagtaacttaccgttagaaaccacgaagactacgacgtaccgacgggtacacgacgtaccttagtacggaacgtaggaacggaacgtaggaaacgtaagtacggaaaccgaccgaccgggacctaacgtaagtttaacgtttaaggttggacgggtacccggtaggggtaggggttcgggggtaacctttaaggttttacggtaaacggttaaccttaacggtttaaactttaagttttacgtttaaccgtttcggttagggtacgttacgggttacggggttaaacaaacggggtaccgtcggttacccgaccggttaccctccccgaacgtaaccccg

SEQ ID NO: 405792 - DNA, 663 bp, Homo sapiens
  misc_feature: GZ8MTXP01CY372.21.67.G01.1.454.CMB.2.raw
  modified_base (287)..(287): a, c, t, g, unknown or other
  modified_base (362)..(362): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctccgtgcgagggcctcgtggttactagtttttccgactatagtatcgtaggttgggtgngacaggcccttggacgaagggtcttggaggtgggagtgggagtcggggccgtaccgttcggacgaaacggaaagngtagggagtagtggtcgaaggtaatttcgagggcaagtaacttaccgtagaacccagaagtacctacacgtaccgacgggcacgacgtccttaacgttacggaacgtggaacggaaaccgtaggaagaagtacgggaccgacgaccgacaactagttaattgtagtcgcggtggtaggtcggggattacgttagtacgtacttacttaagttatttactttacgttgttacggtacgttcggttgggaaccgaacgggtacccgtaacgggtctaccccgttccgtccccgcgtaaccccg

SEQ ID NO: 405793 - DNA, 750 bp, Homo sapiens
  misc_feature: GZ8MTXP01BV4TM.21.67.G01.1.454.CMB.2.raw
  modified_base (354)..(354): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctctgcaggcctctggttactagtttttccgactatagtatcgagttgggtgcgacaggcccgttggacgaagggcttaggagtggagtgggagtggggcccgaccttcggacgaaacggaaaggngtagggaagttagtaggtcgaaggtaatttcggacgggcgtaagtaagttacccgttagaaacccaacgaagactacgactaccgacgggaccacgacgtaccgttacgttacggtaacgtaggaacggtaacccgtaggaacggaaagtacgggaacgaaccgaaccggacccgtaacgtaggttaactttaagtttaggtacggtcggtccgggtagggtacggggggtacttaggtttacggtaagttaaaccgtttaacgtttaaactttaagtttaacgttttaccgtttcgtttacgggtacgttacggttcgggggttaccgaaacggggtacccgtaaccgggttccgtaccccggttaccgttaacccccgttaacggtaacccccg

SEQ ID NO: 405794 - DNA, 726 bp, Homo sapiens
  misc_feature: GZ8MTXP01ET4HR.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctgtggttactagtttttccgactatagtatcgaggttgggtgcgacaggccctggacaagggcttgagtggagtggagtggggccacgtcgacgaaacggaaagtagtagggagtagtggtacaaggtaatttcgaagggctaagtaacttacccgtacgaaaccaacaagactacgaacgtcccgaacggggacaaacgacgtacccttacgtaggaaaccgtggaaacggaaacctaggaagaaagtcgggaaccgaacgaccggtaccaaactagttaagtttaagtttgacggtcgacgggtaggggtacgggggtactaagtttttacggaaacgttaacgttaacgttaacgttaagttttactttaaaccgttttccggttagggtaaccgttcggttacggggggaaaccgtaaaagggggtacccctaacgggggttccctaccccggttaccccttcccccggaacggtcccccg

SEQ ID NO: 405795 - DNA, 740 bp, Homo sapiens
  misc_feature: GZ8MTXP01EUKAN.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctctgcagggcctctggttactagtttttccgacttatagtatcgaggttgggtgcgacgacggccccttgggacgtaagggtcttggacgtggagtggggagtcggggaccctaccgttcgacgaaacggaagtagtaggtaagttagtggtacgaaggtaagtttcgacgggtactaaagtaacttaccgtacgaaacccaacgaacgtactactaacgtcccgaacggggtaccacgacgtacctaacgttaggaaacctggaaacgaaccgtagaaggtaacgtgggaaccgacgaaccggaccaactaagttaatttaacgttgacggcggtacggaaggggttcgggggacttagttacggtaacgtaacctttaaagtaacctttaagttttaacgttacgtttcggttagggtaaccgttacgggttacggggaaaccgtaaaacgggggtccctaaccggggttccctacccggttccctaacccccgttaacggtaaccccc

SEQ ID NO: 405796 - DNA, 759 bp, Homo sapiens
  misc_feature: GZ8MTXP01DKM2J.21.67.G01.1.454.CMB.2.raw
  modified_base (414)..(414): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcgtggggcctcggtgaaggtctcctgcgagggcctgtggttactagtttttccgacttatagtatcgaggttgggtgcgacacggccccttggaacaagggcttggagtggagtgggagtcggggccgtacgttcgacgaaacggaaagagtggagtagtggtacaggtaattcgagggcaagtaacgttacctaggaaaccaacgngacctcgaactcccgaacggggcaacgacgtaccttacgtacggaaactaggaacggtaaaccgtaggaaagaaggtacgggaaccgaccgaaccgggtaacctaacgtaagtttaagtttaagttacggtacggtaccggtaccgggtagggtacggggggtacttaagggttttacggtaaacggtaaccttaacgttaaacctttaagttttaaacgtttaaccgttttcggtttaacggggtaccggttacgggttacgggggaaccgtaaaacgggggtacccgtaaccgggttacccggaacccgttccccgtaacccccgttaacgggtaaccccccg

SEQ ID NO: 405797 - DNA, 714 bp, Homo sapiens
  misc_feature: GZ8MTXP01ACM1Z.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctggaggtgaagaagccgtggggcctcggtgaaggtctcctgcgagggcctcgtggttactagtttttccgacttatagtatcgaggttgggtgcgacacggcccttggaacgtaagggcttaggaggtggacgttggggagtcggggtccccgtaaccgttcggacgtaaacgggaaagagtagggagttagtggtacaaggtaattcgacgggtactagtaacttacctgaaaccctaagcgactaccagtcccgacgggacacgacgtacctacgttcggaaacgtggaacggaaccgtggaagtaacgtcgggaacgacgaacccggactaactaagttagttagttacggtcgacggtcgggagggttacgggggtacttaaggtttgtaaacgtaccttaagttaacttaagttttacttaacgttccgttagggtaccgttacgggttcggggaccgtaaacggggtcccgtaacggttcccgaccccgttcccgtccccgcggttaacccccg

SEQ ID NO: 405798 - DNA, 763 bp, Homo sapiens
  misc_feature: GZ8MTXP01CNRQX.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtcgcccactcccagactcaactggtgcagtctggacctggaggtagaagaacgccgtggggcctcggtagaaggtcctccgtggcgacgggtcctcgttggttactagtttttccgattatagtatcgtaggttgggtgcgacgacggcccgttaggacgtaagggcgttggaggtggagtggggagtcggggcccgtaccgttcggaacgaaacggaaaggtagtagggtaagtagtggtacgaaggtagtttcgaacgggtctaaaggtaactttaccgtacgaaacccaacgtaacgtacctacgacgtccgacggggaccaacgaacgtaccttaagttacggaacgttaggaaacggtaacctaaggaaacggaagtacgggaacgaaccgacggacctaacgttaagttagtttaacgttgaccgggcggtacggtaggggtggggtacttagtttacggtaacgttaacttattaactttaagtttactttaaccgttggttacgggttacggttacgggttaggggttaaccgtaaacgggtaccccgtaacggggttacccaccccggttaccctaaccccgaacgtaacccccg

SEQ ID NO: 405799 - DNA, 688 bp, Homo sapiens
  misc_feature: GZ8MTXP01ERSDY.21.67.G01.1.454.CMB.2.raw
  modified_base (393)..(393): a, c, t, g, unknown or other
  modified_base (402)..(402): a, c, t, g, unknown or other
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctgggcctcggtgaaggtctctgcagggcctctggttactagttttccgactatagtatcagttggtgcgacaggcccttaggacagggcttgagtggatgggagtgggccacgttcgacgaaacggaagagtgggagtagtggtacaggtaatttcgacgggcagtaagttacctgaacccanaacgactanacgtaccgacgggacacgaacgccgttacgtaggtaacgtacggaacggtaaacccgttaggaaggtaaacgtacgggaaccgaaacggaaccgggaacctaaccgtaagttaacgtttaagtttcggttaacgcggtaccgggtaggggttcgggggactttaaggtttgtaacgttacgttaactaacgtttattagttacgtttcgtaggtacgttacggttggggactaaacgggtcccgtaacgggtcctacccgttaccgtccccgttaacgtaaccccg

SEQ ID NO: 405800 - DNA, 748 bp, Homo sapiens
  misc_feature: GZ8MTXP01C5BXS.21.67.G01.1.454.CMB.2.raw
  modified_base (401)..(401): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctctggttactagtttttccgactatagtatcgagttgggtgcgacaggcccttggacgaagggcttggagtggatgggatggggccgacgttcggacaaacgggaaagagtgggagtagtggtcaggtatttcgaggcaagtaattaccgtgaaacccanaacgtactccaagtccgacggggcctaacgacgtccctagtacggaactaggaacgtaacccgtaggacgaagtacggaaccgacgaaccgggaccaaccgtaagtttaacgttagtttacggtacgggacggtaccgggtagggtggggggtaccttaaggtttcggtaacgtaccgtttaaacggttaacctttaagtttaaacgttttaaaccgtttccgtttaaggggtaccggtttacggttcggggggttaaaccaaaacccggggggtaaccctaaccgggggttacccctaaaccccgggttccccgttaaccccccggaacgggtttaaccccccccg

SEQ ID NO: 405801 - DNA, 685 bp, Homo sapiens
  misc_feature: GZ8MTXP01CWYTO.21.67.G01.1.454.CMB.2.raw
  modified_base (411)..(411): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcaggttgggtgcgacaggcccttaggacgaagggcttggagtggagtgggatcggggaccgtaccgttcgacgaaacggaagagtagggagtagtggtacaaggtatttcgagggactaagtaattaccctgaaacccaanaagactacagtaccgacggacacagctacgtaggaacgtgaacggaactggaaagaagtacggacgaacgacgggaccaacgtaagttaagtttagttacggtacggcggtaccggaagggttcgggggtaattacgtttaggtaacggtaacttaaccgttaatttaatttagtttaacgttcgtttacgggtacgttacggttcggggaaccgtaaacgggtacccgtaacggttacccaccggttaccctccccgttaaccggtaaccccg

SEQ ID NO: 405802 - DNA, 842 bp, Homo sapiens
  misc_feature: GZ8MTXP01DGR97.21.67.G01.1.454.CMB.2.raw
  modified_base (218)..(218): a, c, t, g, unknown or other
  modified_base (419)..(419): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgagtgaagaagcgtgggcctggngaggtctctgcaggcctgtgttactagttttccgatatagtatcgtaggttgggtgcgacaggtccccttaggacgaagggtcttaggaggtggagtggggagtcggggacccgtaccgttacggaccgaaaggaaacgagtgggaagtagtggtacgaaggtatttcggacggtacagtaacttaccgtagaaaccctanaagtacttacgaacgtaccccgaacggggacacgtacgtaccgttaacgttacggtaaaccgagggtaaacggtaacccgtaaggaacgggttaaacgtacggggaaaccgaacccggaaacccgggacctaaaaccgttaaacgggttttaagtttttaaacggttacggtttaccggggaacccgggttaaccggggtaaacgggggtttggggggtaaccttttaaggttttaacggtaaccgggttaaacttttaaaccgttaaacggtttaaacttttaacggttttaaccttttcgggtttaaacgggtaaccgggtttacgttacgggggttaaaccggtaaaccgggggtaaacccgtaaccggggttaaaccctccccgggttaccctaacccccggttaaaccgtccccccgg

SEQ ID NO: 405803 - DNA, 644 bp, Homo sapiens
  misc_feature: GZ8MTXP01C0N3R.21.67.G01.1.454.CMB.2.raw
  modified_base (361)..(361): a, c, t, g, unknown or other
  modified_base (635)..(635): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctccgtgcgagggcctctggttactagttttccgactatagtatcgtaggttgggtgcggacgcggcccttagggacgtagggtcttggaggtggagtgggagtcggggaccgtaccgtcgacgaaacggaagngtagggagtagtggtacgaaggtattcgacgggactaagtacttaccgtcgaaaccacaagtaacctcgacgtaccgacgggacacgacgtaccttacgtaggaacgtaggaacggtaaccgagaaggaagtacggaccgaacacggacaacgtaagttaatgtgacgcggacgtgggtcgggtactagttggatactataattattacttacgttgttaggcgttaggttcgggaacgaagggtacctcggtacctaccgttcctaaccccgngtaaccccg

SEQ ID NO: 405804 - DNA, 717 bp, Homo sapiens
  misc_feature: GZ8MTXP01AK4UW.21.67.G01.1.454.CMB.2.raw
  modified_base (362)..(362): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctggtgaaggtctcctgcgagggcctcgtgttactgttttccgacttatagtatcgaggttggtgacgacgacggcccgttaggacgtaagggtcttaggaggtcggagtgggagtcgggaccgtaccgttcgacgaaacggaagngtaggagtagtggtacaggtattcgacggtacagtacttacgtagaaacccagaacgtactcgacgtacccgacgggacacgtacgtaccttacggtacggaaactcggaacggaacctaggaagagtacggacgaacgaccgactaacgaagttacgttagttcgacggtcgtacggagggttccggggtattaggtttagaaccgttaacgttaacttaaacgttattttaaacgtttaccgtttcggttaacgggtaccgttcggggttaacgggttaaccggtaaacgggtaccccgtaacgggtaacccgtaccccgggttccctaaccccccggttcgtaaaccccccg

SEQ ID NO: 405805 - DNA, 669 bp, Homo sapiens
  misc_feature: GZ8MTXP01DMBWL.21.67.G01.1.454.CMB.2.raw
  modified_base (221)..(221): a, c, t, g, unknown or other
  modified_base (537)..(537): a, c, t, g, unknown or other
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtggggcctcggngaaggtctcctgcgaggcctgtgttactagttttccgatatagtatcgaggttggtgcgacacggcccttaggacgaaggtcttaggagtggagtgggagtcggggccgtaccgttcgacgaaacggaagagtggagtagtggtacgaaggtatttcgaaggtactaagtaacgtttaccgttacggtaaaacccaacgaacggtaactccgaacgttacccgacggggacaacgacgtaccttacgttacggaaacgtggaacggtaacgtagaaggaagtcggaacgacgaacgaccaactagttattaagtgngacgcggtaggtacgggacttgttagtagtacttagtaattatttagttacttcggtacggtcgttacggttcgggttaacgaaacgggtccgtaaccggtccgtaccgttccctcccgaaccgtaaccccg

SEQ ID NO: 405806 - DNA, 786 bp, Homo sapiens
  misc_feature: GZ8MTXP01EYYLA.21.67.G01.1.454.CMB.2.raw
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggctggtgaggtctctgcaggcctctggttactagtttttccgactatagtatctaggttgggtgcgacacgggcccttagggacgtaagggcttggaggtgggagtggggagtcggggaccctaccgttcgacgaaacgggaaagagtagggagttagtggtacgaagggtaactttcggaacgggacgtaaggtaaacgtttaccgttacggaaaaccctaacgaacggtaacctacgaaccgttccccggaaccggggtaaccaacgtaccggtacccgtttaacgttacggaaacgttacgggaaacggtaacccgtaaggaacggtaaaggtacgggaaccgacgaaccggacctaacgtagttaagtttagtcggtacggaccggtacgggtaagggttcgggggtaacttaggtttacgtaacggtaaaccgttaacttaaacgtttaattttaagtttaacccgttttggttacgggtaccgtttacggggttacggggttaaccggtaaacggggaccgtaaccggtcccgaacccgttccctaacccggttaaccgtaacccccg

SEQ ID NO: 405807 - DNA, 770 bp, Homo sapiens
  misc_feature: GZ8MTXP01AIW0X.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctcggtgaaggtctccgtgcgagggtcctcgtggttactacgtttttccgacttatagtatcgaggttgggtcgcgacgacggcccgttaggacgaagggtcttaggaggtggagtgggagtcggggaccgtaccgttcggacgaaacgggaaagagtgggtaacgtagtgggtacaggttaaagtttcggacgggactaagtaacgtttaacccgtagaaaccacgaacgtacctacacgtacccgacgggaccaacgtacgacccttaacgtacggaacgtacggaaacggtaaccctagggaaacgtaacggtacgggaaccgaccgaaccggacctaaacgtaagtttagtttaacgtttggacggtcgggtacggtagggtcgggggtaccttaggtttaggtaaccgttaaacttaacgttaactttaacgtttacgtttaacgttcggtttaacggtacggttaccgggttggggttaaaccggtaaaccggggtacccgtaaccgggtcccgtacccgttaccccgtcccgaacccgggtaaccccg

SEQ ID NO: 405808 - DNA, 728 bp, Homo sapiens
  misc_feature: GZ8MTXP01CA6AK.21.67.G01.1.454.CMB.2.raw
  modified_base (291)..(291): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctggaggtagaagagccgtgggcctggtgaaggtctcctgcgaggtcctcgtggttacttacgttttccgatatagtatcgtaggttgggtgcgacncggtcccttaggaccgaagggtctaggaggtggagtgggagtcggggaccgtacgtcgacgaaacggaagtagtggaagtagtaggtacgtaaggtaatttacggacggactaagtaacttacccgtacgaaacccacgtaagacctagaccgtaccggacggcaacgtcgtacttacgttaggaacgtaggaacgtaaccgtaggaacgtaacgtacgggaaccgaaccgaacggactaacgtaagttagtttacgtagtcggacggtacggtcgggtggggtaaccttagtttacgtaacgttaacttaagttaactttaagtttaacgttttacgttcggttaacggtcggttacgggttacgggaaccggtaaaacgggtaccgtaaccggtacccgtacccggttacccttaaccccgaacgttaacccccg

SEQ ID NO: 405809 - DNA, 730 bp, Homo sapiens
  misc_feature: GZ8MTXP01B98QM.21.67.G01.1.454.CMB.2.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggtcctcgttggttactacgtttttccgactattagtatcgaggttgggtgcgacgacggcccgttaggacgaagggtcttggaggtggagtgggagtcggggacccgtacgttcgacgaaacggtaaagagtaggagtgtaggtacgaaggtagttcggacggactaagtaagtttacccttagaaaccctaacgaagtaacctacacgtacccgaacgggccaacgcggtacccttagttagggaaactagggaacgaacgtaggaacggtaagtacgggaaccgacgaccgggacctaacgtaagtttaactttagttaggcggcggaggagggttggggacttagtttagactaaccgtattaacgtttatttaccgtttaacgtttcgttacgggtacggttacggggttcggggttaacgtaaacgggggtacccgtaacgggttacccgtacccgttacccgtaacccccgcggtaaccccccg

SEQ ID NO: 405810 - DNA, 623 bp, Homo sapiens
  misc_feature: GZ8MTXP01EI94Y.21.67.G01.1.454.CMB.2.raw
  modified_base (404)..(404): a, c, t, g, unknown or other
  modified_base (501)..(501): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagctggggcctcggtgaaggtctcctgcagggcctcgtggttactagtttttccgactatagtatcgagttgggtgcgacaggcccttggacgaagggtcttggagtggatgggatcggggccgcttcggacaaacggaagagtgggagtagtggtacaggtaagtttcgagggcaaggtaacttacctgaaacccagngactcgatcccgaacgggcacgacgacctacgtacggaacgtagaggaaccgtagagaagtaggacgacacggggacacgagtattattgtgcgcgnggtggggacgtagtttagtagtactacttaacgttatttattacgtttcgttaggtacgttcgttcgggacgtaacgggtaccgtaacggtaccgtaccgttcctaaccccgcgtaaccccg

SEQ ID NO: 405811 - DNA, 824 bp, Homo sapiens
  misc_feature: GZ8MTXP01EDNZR.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagaagccgtggggcctggtgaaggtctcctgcgagggcctcgtggttactacgtttcgtactatagtatcgtaggttgggtgcgacgacggccgttaggacgaagggtcgttgaggtggagtgggagtcgggccgtacgttcgacggaaacggaaagtagtagggtaagtaggttaggtacgtaaggtaacgtttcggacggggtacgtaacgtaaacgtttaaccgttacgaaaccctaacgtaacgtaccgtaccgtaaacccgttcccggaaaccgggggtacctaaacggtaacccgtttacccgttaacggttttaacgggaaacccgtaagggtaaaccgggtaaacccggttaaaggtaaacggaacggtaaccgggaaccggaaacccgtaaccggggaacctaaaccggttaaagtttaacggtttttaaacgtcgggttaacggcgggacgggtagggtacgggggttaacgtttacgtttaggggtaaactttaacgtaagttaaacttttattaacgtttacgtttacgttacggtacggttcggttacggggagtaaaccggggaccctcgggtcccggtaccgttaccgtccccgccgttaaccccg

SEQ ID NO: 405812 - DNA, 665 bp, Homo sapiens
  misc_feature: GZ8MTXP01EYR7K.21.67.G01.1.454.CMB.2.raw
  modified_base (278)..(278): a, c, t, g, unknown or other
  modified_base (283)..(283): a, c, t, g, unknown or other
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctctgcaggcctgtggttactagtttttccgactatagtatcaggttggngcganaggcccttggacaagggctgagtggatgggagtcggggcctaccgttcgacgaaacggaaagagtagggaagtagtggtacaaggtaatttcggagggctaagtaacttaccttgaaaccacaagtactcactccgaaccgggacacgacgtaccttacgttacggaaacgtaggaacggaacccgttaggaacgtaaagtacgggaacgaccgaaccggaccaacgtaattaattacgttagtgccgacggagggttggggacttagttcggtaatacgttaacttaacttaatttaacgttactttcgttggtaacgttcggttaggggaacaaagggacctaacggtaccgaccgttcctaaccccgaacgtaaccccg

SEQ ID NO: 405813 - DNA, 816 bp, Homo sapiens
  misc_feature: GZ8MTXP01BE5IX.21.67.G01.1.454.CMB.2.raw
  modified_base (231)..(231): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggcctggtgaggtctctgcgnggtcctgtggttactacgttttccgactatagtatcgtaggttgggtgcgacacggcccgttaggacgtagggtcttggtaggtggagtgggagtcggggacccgtaccgttcggacgaaacgggaaagtagtagggagtagtggtacgtaagggtaactttcgggaacgggactaaaggttaacgttacccgttacggaaaccctacgaagtacctacgtaccgtacccggacgggacaaccgtacgtaccgttaagttacgggaaactagggaaccggtaaccgtagggaaacggtaacgtacgggaccgaaccgaaccgggacctaaaccttaaggtttaacgtttagtttcgggcggtaccgggtcgggtagggggttaggggtaacctttaggtttaagggtaaccttaaaccgtttaactttaaacggtttaacttttaacggtttcgtttaccgggtttacgggtacgggttcggggttaccgggggttaaaccggtaaacccgggggtaccctaaccggggttaacccccgacccggtttacccccgtaaccccgggttaacccgttaaccccccgg

SEQ ID NO: 405814 - DNA, 730 bp, Homo sapiens
  misc_feature: GZ8MTXP01BG0KB.21.67.G01.1.454.CMB.2.raw
  modified_base (357)..(357): a, c, t, g, unknown or other
  modified_base (597)..(597): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagaagccgtggggcctcggtgaaggtctcctgcgagggcctgtggttactagtttttccgactatagtatcgaggttgggtgcgacacggccccttaggacgaagggtcttggagtggatgggatggggcccacgttcgacgaaacggtaaagngtagggtagttagtgggtactaagggtaactttacggaaggggtactaaggtaaactttacccgttacggaaaaccctaacgaacggtaaaccttccgaaacgttacccggaaccggggtacaaaccgtaaaccgtcccgttaaggtaacggtaacgaggaaaccggttaacgaaagaagtaacgacggaaccgaaccgaccgaacctaattaacgttagtttaaggtcgtacgacgggnggtagggtcggtagttagttagtaacttacgttaattaatttacgttacttacgttcggttacgtcggttacgggttacggaacggtaacgccgtaaccgtccgtaccgttaccctaaccgttcccgtaaccg

SEQ ID NO: 405815 - DNA, 717 bp, Homo sapiens
  misc_feature: GZ8MTXP01BMOTY.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtggggcctcggtgagtctctgcgaggctgtgttactcgttttcgatatagtatcgaggttggtgacgacaggtcccttgggacgtaagggtcttggagtggagtgggagtcggggccgtacttcggacgaaacggaagagtcgggagttagtggtactaagggtaagtttcgaaggggtactaaaggttaacgtttaccgttacgaaacccaacgtaacggactccctaacgtacccggaacggggccaaacgacgtaccccgttaagttacggaacgtacggaacggtaaacccgtaggaacgtaacgacgggaacgaacgccggaactacttaagttagtttaagtcggtacgacgggtacggtagggtcgggggtacttaggtttggtaacgtaacttacgttaaacttatttacgtttaactttggttacggtacgttcggttcggggaacgtaaacgggtccgtaacggtacccgtaccgttacccgtcccgaacgtaaccccg

SEQ ID NO: 405816 - DNA, 888 bp, Homo sapiens
  misc_feature: GZ8MTXP01CEZHI.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctggtgaaggtctcctgcgagggcctcgtggttactagttttccgactatagtactcgtaggttgggcgcgacacgggcccttagggacgtaagggtcttggaggttggagtgggagtcggggtacccgtacgttcggacgaaacgggaaagtagtagggtaagtagtggtacgaaggtactttacggagggtactaaagtaacgtttacccgtacggaaacccttaacgaacggtaacctacccgtaacggtacccccggaacgggggtaccaaaccgtacccggttaacccgttaaccggtttaacgggaaaccgttacgggaaacgggtaaaccccgttaggggaaacggtaaacggtacgggggaaacccgtaacccggaaacccgggtacccctaaaccgttaacggttttaaggtttaaacggtttccgggttacggggaccggggtaaccggggttaaccgggggttaggggggttaacgtttaaccggttttaagggtaacgggttaaccctttaaaccgggtttaaacctttttaagttttaacgtttttacccggttttacggtttacggggttaaccgttacggggttcgggggaacggttaaaccgggaccgttccgggtaccgtaccccgttccgtaacccccggttaacgtaacccccg

SEQ ID NO: 405817 - DNA, 622 bp, Homo sapiens
  misc_feature: GZ8MTXP01AEVB2.21.67.G01.1.454.CMB.2.raw
  modified_base (268)..(268): a, c, t, g, unknown or other
  modified_base (277)..(277): a, c, t, g, unknown or other
  modified_base (306)..(306): a, c, t, g, unknown or other
  modified_base (315)..(315): a, c, t, g, unknown or other
  modified_base (610)..(610): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtcctgtcgcgcgtctgttacgttacttcgttacatagtatntcgtggtgngacgacgcgtcgtagacgagtgtaggagngtaggtggngcggtcctacgtcgaacggaaagagtggagtagtggtgagtaagttagtaggacgataacgttactcgtacgaaaccgataacgctacgcgtacccggacgtacacgaccgttactttaagggacgtaacgacgggtaaccaagtggaaagtcggacgaaaccgacgacgacttaatagtttacgtggtcgacgtcggaggtggggtcgttacttgtacgaacttacctgttaaatattttcgtacgtttggacggtgttcgggacgaacgtaaccgcgtcgtccgacttccccngttccgaacccg

SEQ ID NO: 405818 - DNA, 804 bp, Homo sapiens
  misc_feature: GZ8MTXP01CA4X7.21.67.G01.1.454.CMB.2.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctggtgaaggtctctgcgaggcctctggttactgtttttccgacttatagtatcgaggttgggtgcggacacggccccttagggaacaaggggtcttggaggttagggagtggggagtcggggcccgaccgttcggacgtaaacgggaaagtgtagggagttagtggtacgaaggtaatttcggaacgggtacctaaggtaacgtttaaccgttacggaaaacccaacgtaacgactaccgaccgttccgaaccggggtccaactacgtacccttaacgttacggaaacgttacgggaaacggtaaccgtaaggaacgtaaagttaccgggaaacggaccgaacccggaccgtaaacgttacggttaacgttttaaggttacggttcggacggtaccggggtacggggttaggggggttaacccttaggttttaacggtaacggttaaccgtttaaccgtttaaagtttaacttttacgttttaaacgtttcgtttaacgggtcggtttacgggttcggggttaccgtaaaacgggtacccgtaacggtacccgtacccgttcccgttaaccccgaacgttaacccccg

SEQ ID NO: 405819 - DNA, 817 bp, Homo sapiens
  misc_feature: GZ8MTXP01DDE86.21.67.G01.1.454.CMB.2.raw
  modified_base (284)..(284): a, c, t, g, unknown or other
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactacgttttccgactatagtatcgaggttggngcgacaggcccttaggacaagggcttggagtggagtgggagtggggcccgtacgttcgacgaaacggaaacgtagtagggtagtagttaggtcaaagggtatttccggaaggggtacctaaagggtaactttaacccgttacgaaaccccgtaagtaacgtaaccgtacctaaccgttaccccggaaccggggtaaccaaccgaacgttacccgttaacgtttacgggaaaccgttggaaacggtaaacccgtaggtaaacggtaaagtacgggaaaccgtaacccgaccgggtaacccaaacgttacggtttaaacgttttagtttagggtacggaccgggtacggtacggggtagggggtacctttaagtttggtaaaccgtacgtttaaccgttaaatttagtttaaacgttttccgtttaacggtttacgggtaacccggttcgggttacgggggttaacgaaaacccggggtacccgtaacggttaccccgtacccggttaccctccccggaacccgtttaacccccg

SEQ ID NO: 405820 - DNA, 748 bp, Homo sapiens
  misc_feature: GZ8MTXP01CQTOS.21.67.G01.1.454.CMB.2.raw
  modified_base (270)..(270): a, c, t, g, unknown or other
  modified_base (313)..(313): a, c, t, g, unknown or other
  modified_base (710)..(710): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagagcgtgggcctggtagagtctctgcgaggctgtgttatgttttcgatatagtatcgtaggttggngcgacacggtccctaggacgagggtcttggaggtggagtgggngtcggggaccgtacgttacggacgtaaacggaagtaggtagggaagttaggtggttacgaaggttatttcggaacggggtactaaacgtacgtttaccttacgaaacccgaactaacggtacctacgtaaccgtaccgacccggggacacggtaaccgtacccttaaggttacgggaacgtgggaaaccggtaaccgtaaggaacggtaaacggtaccggggaaccgtaccgaaacccgggtactaaaccgtaggtttaaagtttacgggtacgtaccgggtacgggtacggtaggggtagggttacttaggtttacgaacggtactttacgtaatttaagttactttcgttggttaaacggtcgttacgggttggggttaaccaacggggttaccncggtaacccgtccttccgaaccccgccggttaaccccg

SEQ ID NO: 405821 - DNA, 675 bp, Homo sapiens
  misc_feature: GZ8MTXP01ECPGL.21.67.G01.1.454.CMB.2.raw
  modified_base (217)..(217): a, c, t, g, unknown or other
  modified_base (233)..(233): a, c, t, g, unknown or other
  modified_base (255)..(255): a, c, t, g, unknown or other
  modified_base (257)..(257): a, c, t, g, unknown or other
  modified_base (264)..(264): a, c, t, g, unknown or other
  modified_base (268)..(268): a, c, t, g, unknown or other
  modified_base (519)..(519): a, c, t, g, unknown or other
  modified_base (530)..(530): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggctggngagtctctgcaggctntgttactgttttcgatatagtntnagttggncganggcctggacgaggcttggaggtggagtgggagtcgggcccgtacgttcggaacgaaacggaaaggagtggtaaggttagtagggtacgaaggttaatttacggaagggcgtaaagtaacgtttacccgttacggaaaaccctagaacggtactacgacgtacccgacggggaacacgtaaacgtactaacttgggaaactggaagaacgtagaagtaagcgggaacacgaacggacataagttatttacgngttacgacggnggacgggtgggacttagttagtagtaccttaattaacgtttatttaacgttaccgtttgttacgggtacgttagggttcgggaaacgtaaacgggggtaccctaacgggtaccccgccgttaccgtccccgaacggttaaccccg

SEQ ID NO: 405822 - DNA, 612 bp, Homo sapiens
  misc_feature: GZ8MTXP01CZFLY.21.67.G01.1.454.CMB.2.raw
  modified_base (390)..(390): a, c, t, g, unknown or other
  modified_base (413)..(413): a, c, t, g, unknown or other
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccacttcgcaaacggaaagatggagtaagtggtcaggatttcagggcaaagattaccttgaaaccaacngactcaaatccaacggggcacancctattgggaactgacggaacctagagaatggacgacacggacaacagtaattaattggcgcgcggagggtggggtactagtttagtaacgtaacttaacttaacttaatttaacgtttacttcgttagggtacggttacgttggggaacgaaaagggacccgtaacggtaccgacccgttcctaaccccgaacgtccc

SEQ ID NO: 405823 - DNA, 668 bp, Homo sapiens
  misc_feature: GZ8MTXP01EY2NI.21.67.G01.1.454.CMB.2.raw
  modified_base (221)..(221): a, c, t, g, unknown or other
  modified_base (404)..(404): a, c, t, g, unknown or other
tcagtcgtcgctcgcacgaccggtgctcgattttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctggngaaggtctctgcgagggcctctggttactagtttttccgacttatagtatcgagttggtgcgacacggccctaggacgagggcttgagtggagtgggatggggccgacgttcgacgtaaacggaagtgtagggagttagtggtacaggtatttcgagggctaagtacttacgtgaaaccgacngtactacgacgtaccgacgggcaacgacgtcctaacgttaggaaccgtagaacggtaacctaggaagtacgacggaacgacacggaccaacgtagttaattagttcgaggacgcggaggtagggggacttagttgtaaggtaccttaactaacttaagtttaacgttaacgtttcgttacgggtacgttacgggttacggggaaccggaaacgggtaccgtaaccggtcccgtaacccggttccctccccgaacgtaacccccg

SEQ ID NO: 405824 - DNA, 808 bp, Homo sapiens
  misc_feature: GZ8MTXP01CQ9XS.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtagaaggtctcctgcgagggtcctcgttggttactagtttttccgactatagtatcgaggttggtgcgacgacggcccgttaggacgaagggcttggagtggagtgggagtcggggaccgaccgttcggaacgaaacgggaaagagtagggtaagtagtggtacaaaggtaagtttaccgaaggggtacaaaggtaaactttaacccgtttacggaaaaccccaacgtaacggtaacccgttaccaaacgttaccccggaaccggggaccctaaacgaacccggtacccctttaaggttaacgggaaacctagggaaaccgggaaacccttaggaaaacggttaaaggacggggaaaccaacggaacccggttaccaaacgttaggtttaactttaagtttcggaagggtccggtacggaacgggtgggggtacgtagtttaggtaaggtaacgttaaccttaacttaaactttaatttaacctttacgtttagggtacggttaccggttggggttacggtaaaacgggaaccggtaaccgggtaaccgtacccggttacccgttaaccccttaaccggtaacccccg

SEQ ID NO: 405825 - DNA, 770 bp, Homo sapiens
  misc_feature: GZ8MTXP01BXVGY.21.67.G01.1.454.CMB.2.raw
  modified_base (251)..(251): a, c, t, g, unknown or other
  modified_base (279)..(279): a, c, t, g, unknown or other
  modified_base (337)..(337): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttacngtttttccgatatagtatcagttgggtncgacaggcccttggacaggcttgagtggatgggatgggccgaccttcgcaacggaagntgggagtagtggtcaggtaatttcgacggcagaacttaccctgaaacccacaaggactacgactacccgacggggtaccacgtacgtcccttaacgttaggaaaccgtaggaacgggtaaacccgttaggaaacggtaaagtacggggaaaccggaaccgtaaaccggggaccccgtaacctaaacgggtttaacttttaacggtttaggtacggttaccgggtacgggaacggggttaggggggtaccttaacggttttggttaacggtaaccttaaccgttaaaccgtttaacgttttaacttttaaccgtttacgtttacggggtaaccggtttccgggttacgggggttaccggtaaaaccgggggaaccccgtaacggggttacccgaaccccggtttccccgttaacccccgaacccggttcccccg

SEQ ID NO: 405826 - DNA, 807 bp, Homo sapiens
  misc_feature: GZ8MTXP01C76U7.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagaacgcgtggggcctggtgagtcctctgcaggtcctcgtggttactagttttccgactatagtatcgaggttgggtgcgacgacggtcccttagggacgtaagggtcttaggaggtggagtgggagtcggggaccctacgttcggaacgaaacgggtaagacgtagggtacgtaggtgtacgaaggtatttcgaaggggactagtaacttaccgtagaaaccctaagaacgaccttacgaaaccgtacccggaccgggaacaaccgtaccgggtaacccttacggttacggaaacgttagggaaacgtaacccggtaaggaacgtaaacgacgggaaccgtaacccgacgggtacccctaaaggtactttaaagtttcggtacggtaaccggcgggttaaccggaggggtttagggggtaaccttagtttacgggtaaacgttaaaccttaacggtttaaattacgtttaaagtttttaccgttacgggtttacggttaacccgggttcggggttacggggaaaaccggttaaccggggaaccggttaaccgggttaccccgtaaccccgttccgtaaccccgggttaaccttaacccccggg

SEQ ID NO: 405827 - DNA, 743 bp, Homo sapiens
  misc_feature: GZ8MTXP01AMFKX.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctcggtgaggtctctgcaggcctgttagttacttacgtttacgacttatagtatcgtaggttggtcgacgacgtacggtccgtaggaacgtaggtcgttaggaggtggagtagggaggtcgggtacccgtacgttacggacgaaacggaagtcgtagggtagtaggtggtacgtaaggtagttacggacggtacgtaagttaacgttaccgtacgtaaacccagtaacgtactaccgaacggtacccgacgggacacgtaccgtaccgtttagtagggaacgtaggaaccggtacgtaaggaagtacggacggaacgtaccgacgtacctaatagtttagtttaggtcgacggcggtaaggggtacgggttaggtacctttaaggttcggtaaacttaacggttacttaacggtttaactttcgtttaccgttgggttacgggtcggtttacggggaacgggttaacggaaaccggtccccgttaacggtaccccgtaccgttaccccgtccgttaaccgtaacccccg

SEQ ID NO: 405828 - DNA, 842 bp, Homo sapiens
  misc_feature: GZ8MTXP01CICIH.21.67.G01.1.454.CMB.2.raw
  modified_base (322)..(322): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctcggtgaagtctctgcacggcctcgtggttactagttttccgactatagtatcgaggttgggtgcgacaggccctggacgaagggtcttggaggtggagtaggggngtcggggccccgtaccgttacgggaccgaaacgggaaaggagtacgggtaaggtagttcggtacgaagggtaacgttttcggaacggggactaaggtaaactttacccgttagaaacccaacgaacgtactaccaacgttaccccgacgggaccgaacgaccgtaccttaacggttacggaaacgttacggaacgggtaaaccgtagggtaaacgtaacggttacggggaacccgaacgaacccgggtaccctaaacggtaacgtttaacgttttaaggtttaggtacgggtaccgggtacgggtaagggggttacggggggttccttaaagggtttttccggtaacgttaaccgtttaacgttaaaccgttttaagttttaaacttttaacgttttcccggtttaaggggttaccggttaccggggttacgggggttacccgggtaaaacggggtccccgtaaccggggttaccccgtaccccggttaccccgtaaccccgaacccggttaaccccccg

SEQ ID NO: 405829 - DNA, 739 bp, Homo sapiens
  misc_feature: GZ8MTXP01BXQWA.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactaggtttttccgactatagtatcgagttgggtgcgacaggcccttggacaagggcttggagtggagtggggatcggggccgaccgttcgacgtaaacgggaaagagtagggagtagtgggttacaaggtaatttcgaagggcaagtaacgttaccttagaaaccaacgaacgactacacgttacccgacggggacaacgacgcccttaagtcggtaaactggtaacggaacccttaggaagaacgtggaaccggaccgaacgggacctaacgtaagttaagtttacgttggtacggcggtacggtaggggtcgggggtaccttaggtttggtaaacggacttaaacgtaaccgtttaagtttactttaaaccgtttcggtttagggtaaccggtttccgggttagggggttacccgtaaaaacgggggtacccctaaccggggttaccccgtaacccggttacccgtcccccggaacgttaacccccgg

SEQ ID NO: 405830 - DNA, 679 bp, Homo sapiens
  misc_feature: GZ8MTXP01C5NY3.21.67.G01.1.454.CMB.2.raw
  modified_base (574)..(574): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcgtggggcctggtagaaggtctcgtgcgaggcctgtggttactacgttttcgactatagtatcgtaggttggtgcgacgacggcccgttaggacgtaagggtcttggaggtggagtggggagtcggggacccgtaccgttacggaacgaaacgggtaaagtagtagggtagtagtggtacgtaaggtattcggaacggtactaaagtacttaaccgtacgaaaccaacgaagactcgaacgtaccgacgggacacgacgtaccttagtacggaactaggaacgtaactggaagtaacgtcggaactacgacggaaccatagttaagtcgttgcgtacgcggtagggtgggtacttagttaggtaacnctttaagtaactttatttacttacgttcggttacggtcgttacgggttgggaacgtaacgggtacccgtggttccccgacccgttcctaaccccgcgtaaccccg

SEQ ID NO: 405831 - DNA, 854 bp, Homo sapiens
  misc_feature: GZ8MTXP01DDACU.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctgggtagaaggtctcgtgcgacgggtcctcgttggttacttacggtttttccgaacttataagtagtcgtaggttgggtgacgacgacggtccgtaggacgtaagggcgttaggaggtggagtgggagtcggggaccctacgttacggaacgtaaacgggaagtagtacgggtaagtaggttaggtacgtaaagggttaagtttacggaacggggtacgtaacgttaaacgtttacccgttacggaaacccgtaacgtaacgtaaccgtaccgtaaacggttaccccggaaccggggaacctaacggaaccggttacccctttaaggttaacggtaaacggtacggtaaacgggtaacccgttagggaaaccgtaaggtaccgggaaaccgaaaccgaacccggaccctaaagttaaggtttaacgttttaaggtttggacccgggaggtaaccgggtagggggttacggggtaacctttaacgggtttagtaaccggttaaacctttaaccgttaaattttaagttttaacttaaccggtttcgttacggggtaaccggtttcgggaacgggttaacggaaaccgggtaccgtaaccggtccgtacccgttacccgttaacccgaacgtaaccccg

SEQ ID NO: 405832 - DNA, 724 bp, Homo sapiens
  misc_feature: GZ8MTXP01AF6M8.21.67.G01.1.454.CMB.2.raw
  modified_base (244)..(244): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgccccactcccagactcaactggtgcagtctggacctgaggtgaagagccgtggggcctcggtgaaggtctccgtgcgaggcctntggttactgttttccgatatagtatcgaggttgggtgacgacaggccccgttggactaagggcttggagtggagtgggatcggggccgacttcgacgaaacggaagtagtgggagtagtggtacaggtaatttcgacgggtacagtaaacttacccgttaggaaaccccaagaacgacctaccgacgtacccgacggggacaacgacgtacccttacgttacggaacgtaggaacggtaaccgtaggaaacggtaagtacgggaaaccgaccgaccggacctaacgtagttaacgtttagttgggtacgacccgggtaggtacggggttgggggtaccttagttttacggtaagtaccgttaacttaacgttaatttactttacgtttacgttggggtaaccgttcggttacgggggaccgtaaacggggacccgtccgggttaccgtacccgttccgtccccgttaacggtaacccccg

SEQ ID NO: 405833 - DNA, 763 bp, Homo sapiens
  misc_feature: GZ8MTXP01EWJED.21.67.G01.1.454.CMB.2.raw
  modified_base (277)..(277): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctctgcagggctcgtggttactagttttccgactatagtatcgagttggngcgacaggcccttaggactaagggtctggagtggagtgggatcggggccacgttcgacgaaacggaagagtagggtagtagtggtacgaggtaagtttcgaggggctagtaacttaccgtcgaaacccagaagtacctacacgtacccgacgggacacgtacgaccttaacgttagggaaaccttggaacggaacccgttaggaaagtaacgtcgggaaacaccgaacgggtaacctaaacgtactttaaagtttacgttacggtacggtaccggtaaccggggtaagggggttcggggggtaaaccttaagggtttttacgggtaaacggtaaaccgtttaaccttaaacgttttaattttaaacgtttaccggttttacgtaggggttaaccgtttacgggttacgggggaaaccgttaaaaccgggggtccctaacgggtttccccgaacccggttccctccccgggttaacctaacccccgg

SEQ ID NO: 405834 - DNA, 824 bp, Homo sapiens
  misc_feature: GZ8MTXP01D8KVO.21.67.G01.1.454.CMB.2.raw
  modified_base (271)..(271): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgagtgaagagctgggctcggtgaggtctcctgcaggcctgtgttactagttttccgatatagtatcgaggttgggngcgacgacggcccttaggacgtaagggcttggaggtggagtgggatcggggaccctaccgttcgacgtaaacggaagtagtagggtaagtagtggtaccgaaggtactttacggacggggactaaaggtaactttacccgttacgaaaccccaacgtaacggtaacctccgtaacctaccccggaaccggggtacaaaccgtacgtacccgttaacggttacggtaaacgtacgggtaaaccgggtaaacccgttaagggaaaggttaaacggtacggggaaacccgtaacccggtaaacccggggaaccgtaaaccctaaagggtttaaacgttttaaggtttacggttcgggaccggtacggggtaacggggttacggggggtaacttaaggttttacggtaacggttaaaccttaaccggttaaactttaaacttttaacgttaaacgttttcggttaggtaaccggttacggttacggggaacgtaaaacggggtacccgtaacgggttaccacccggttacccgtaaccccgttaaccggtaaccccg

SEQ ID NO: 405835 - DNA, 710 bp, Homo sapiens
  misc_feature: GZ8MTXP01BFXZH.21.67.G01.1.454.CMB.2.raw
  modified_base (183)..(183): a, c, t, g, unknown or other
  modified_base (551)..(551): a, c, t, g, unknown or other
  modified_base (657)..(657): a, c, t, g, unknown or other
tcagtcgtcgctcgcacgaccggtgctcgatttagagtatacatattgggtttggggacccaaaaaccacacccctccttgggagattcccctagatcacagtccctcaccatggactggacctggagcatccttttcctggtggcagcagcaacaggtgcccactcccagactcaactggtncagtctggacctgaggtgaagaagccgtggggcctcggtgaaggtctcgttgcgacgggtccttcgtaggttacttacgttttccattatagtatcgtaggttgggtgacgacgtacggccccgttaggacgtaagggtcttaggagtggagtgggagtcgggcctacgtcgacgaaacggaagtgtagggagtagtggttacgtaaggtaacgtttcggaacggggtactaaaggtaaacgttttacccgtagaaaaccccgtaagaacgtaacctacgaaccgtcccgaaccggggactaacgtaccgtaccgttacgttacggaaacgtcggaaacgtaacgtaggaaacgtgtacgggacaacncggaacacttagtagtttacggtgtacgcgtacggtagggtcggaattagttaggactacgttacttaagttaactttacgttctttacgggtagcggtttacggngggttaacaacgggtccaacggttcacccggttcccaacccgcgtaacccccg

SEQ ID NO: 405836 - DNA, 772 bp, Homo sapiens
  misc_feature: GZ8MTXP01B51AP.21.67.G01.1.454.CMB.2.raw
  modified_base (286)..(286): a, c, t, g, unknown or other
  modified_base (369)..(369): a, c, t, g, unknown or other
  modified_base (438)..(438): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagaagccgtggggcctcggtgaaggtctcctgcgaggtcctcgtggttactagtttttccgactatagtatcgtaggttgggngcgacacggccccttaggaaccgaagggtcttaggaggtggagtgggagtcggggcccgtacgttcggaacgaaagggaaagngtagggagtagtggtacgaaggtagtttcggaacgggactaagtaacgttacccgtagaaacctaacgngtactacacgtcccgacgggcacgacgtcccgttaacgtacggaactaggaacggtaaccgtaggaacgtaacgaggaaccgaacgaaccggtaccaaacttaaggttaacgtttaagttcggacgggtaccggtacgggtaaggggttccgggggtaattagggttttacggtaaacggtaacctttaaccgttaaacgtttaattttaaaccgttaccgttttacggttaacgggtaccgggtttacgggagggggttaaaccgtaaaccgggggacccgttaacgggtacccgtacccgttacccggaacccccgaacgggttaacccccg

SEQ ID NO: 405837 - DNA, 664 bp, Homo sapiens
  misc_feature: GZ8MTXP01DKXQ6.21.67.G01.1.454.CMB.2.raw
  modified_base (409)..(409): a, c, t, g, unknown or other
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctgtggttactagtttttccgactatagtatcagttgggtgcgacaggccccttggacaagggcttggagtgggatggggatggggcccgtaaccgttcggacaaacgggaaagatgggaagtagtggtcaaggtatttcgaaggggcaagaattacctgaaacccaanaagactcaactccgacgggcacgacgcctacttaggaactggagaaccgtagaagaaagtggaacgacacgggaccaactataagtttagttgtagacggtcggtagggtgggggacctagtttaggtaacggtaaccttaacgttaacttaatttactttacgttccgttagggtacgttcggttgggggttaccgaaacgggggtacccaacgggtttcccgacccggttccttcccccgaacgtaacccccg

SEQ ID NO: 405838 - DNA, 773 bp, Homo sapiens
  misc_feature: GZ8MTXP01CUB5L.21.67.G01.1.454.CMB.2.raw
  modified_base (284)..(284): a, c, t, g, unknown or other
  modified_base (574)..(574): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgccccactcccagactcaactggtgcagtctggacctgaggtgaagagcgtggggcctggtgaagtctctgcaggcctcgtggttactagttttccgactatagtatcgaggttgggtgcgacgnggcccgttggacgagggtcttggaggtggagtgggagtcggggaccgtacgttcggacgaaacggaagagtagggagtagtggtacgaaggtatttcgaacggactaaggtaactttacccgtacggaaaccctaacgaacgtacctaccgtaacgtacccggaacggggaccaaacgtacgtacccttaaacgtttacgggaaacgtgggaaaccggtaaacccgtaggaaacgtaaagtacgggaaaccgaccgaacggactaacgtaagtttaacgttagttacggngacccggtaggaacggggtggggtaacctagtttacgtaacgtaactttacgtaactttaagtttacgttttaacgttcggtttaacgggtccgtttaacggggttcgggggttaaacccgtaaaaacggggggaccccttaaccggggttacccgaaccccggtttccccgtaacccccgaacgggttaacccccccg

SEQ ID NO: 405839 - DNA, 766 bp, Homo sapiens
  misc_feature: GZ8MTXP01AXU9M.21.67.G01.1.454.CMB.2.raw
  modified_base (288)..(288): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcagggcctcgtggttactagtttttccgactatagtatcgaggttggtgcganaggccccttggacaagggcttggagtggagtggggatcggggacccgtaccttcggacgaaacggaaagagtggagtagtggtacaggtaatttcgagggactaagtaacttaccgttggaaacccacgaacgtaactcacgtcccgacggggacacgacgtacccttaacgtacgggaacgtggaacggtaacctaggaacgtaagtacgggaaccgacgaaccggaccaacgtaagttaatttacgttaggtacggaccggtaccggtaggggttacgggggtacttaaggttttggtaacggtaaccttaaccgttaaactttaacgttttaacgtttaaccgtttcggtttaacgggtaaccggtttcggggttacgggggaaccgttaaaaccgggggtaccccgttaaccgggggttacccctaaccccgggttaccccgttaaccccccggttaaccgggttaaccccccg

SEQ ID NO: 405840 - DNA, 605 bp, Homo sapiens
  misc_feature: GZ8MTXP01EBS9J.21.67.G01.1.454.CMB.2.raw
  modified_base (241)..(241): a, c, t, g, unknown or other
  modified_base (283)..(283): a, c, t, g, unknown or other
  modified_base (382)..(382): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatcctttcctggtggcagcagcaacaggtgcccactccccagactcaactggtgcagtctggacctgagtgaagaagcctggggcctcggtgaaggtctcctgcagggcctntggttactagtttttccgactatagtatcagttgggtgcganggcccttggacagggcttggagtggatgggatggggccaccgttcgacaacggaaagagtggagtatggtcaggatttcgagggcagatactgaaccanaagactcatccacgggcacagcctattgaactgagactagagaatggacacgacggaccacagtacttatcgtgcgcgaggtgggggtactagtttaggtagtacgttaactaactaatttacttaaacgtttcgttagggtacgttcggttcgggggaacgtaaaccgggtaacgtaaccgggttaccgacccggttaccgttcccccgaacgtaacccccg

SEQ ID NO: 405841 - DNA, 702 bp, Homo sapiens
  misc_feature: GZ8MTXP01DID25.21.67.G01.1.454.CMB.2.raw
  modified_base (367)..(367): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctgttggttactagtttttccgacttatagtatcgtaggttgggtgcgactacggccccttagggaacgaagggtcttggaggtggaagtgggagtcgggcccgtacttcggacgaaacggaaagngtagggagtagtggtacgaaggtatttcgaagggcaagtaatttaccgtagaaacccaacgaacgtactacacgtaccgacgggacacgacgtaccttagttacggaacgtggaaacggtaacctaaggagtaacgtcgggaacgaacgacggaccaagtattaagtttagttcggcgacggtcggtaggggtcggggtaacttagtttaggtaactacgttaacttaactttatttacgttaccttggttacggtacggttcggttaggggaaccgtaaacgggtaccctaacggttacccgacccggttccttaaccccgaacgtaacccccg

SEQ ID NO: 405842 - DNA, 694 bp, Homo sapiens
  misc_feature: GZ8MTXP01DK37R.21.67.G01.1.454.CMB.2.raw
  modified_base (286)..(286): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggcctcgtggttactagtttttccgactatagtatcagttgggtgcganagccttggacaggctgagtggatgggatggggccgaccttcgacaacggaaagagtggagtagtggtcgaaggatttcgaagggcaagtaattacctgaaacccacgaagactcactccgacggggtcacgagtccctacgttaggaactggaacggtaacctaggaagaaagtcgggaacgaaccgacgggacccaacgaacgttaagtttagttaggttcggacggaccgggtaaggtcgggggtacgtagttttacggtaacggtaacgttaacttaacgttaatttaacgttttaccgtttcgtttacggggtacggttacggttcgggggttaacgtaaaccgggggtacccgtaacgggttcccgtaaccccggttccgtcccccgttaacggtaacccccg

SEQ ID NO: 405843 - DNA, 758 bp, Homo sapiens
  misc_feature: GZ8MTXP01CAN0I.21.67.G01.1.454.CMB.2.raw
  modified_base (351)..(351): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaggtctctgcgagggcctcgtggttactagtttttccgactatagtatcgtaggttgggtgcgacaggccctggacgaagggtcttggagtggatgggatggggccgtacttcgacgtaaacggaaagngtagggacgtagtggtacaaggtaatttcgaacgggtctaaggtaaactttaccgttacgaaaccctaacgaaggtacctccgaacgttaccccgaaccgggggacctaacgacggtaccccgttaacgtttacgggaaactacgggaacggtaaacccgttaggaacggtaaagttacggggaaacccgaccgaacccgggacccgtaaaccgttaaggtttaaacgttttacgttcggttacgggccggtaccggtaggggtcgggggtacttagtttaggtacgtaacttacgtaacttaatttagtttacgttgttacggtacgttacgggttcggggaacgtaaacgggacccgtaacgggttccctacccggttcccgtaaccccgttaacgtaacccccg

SEQ ID NO: 405844 - DNA, 700 bp, Homo sapiens
  misc_feature: GZ8MTXP01AHR6J.21.67.G01.1.454.CMB.2.raw
  modified_base (284)..(284): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgactatagtatcgaggttgggngcgacacgggcccttggacgaagggtcttggaggtggagtgggagtcggggcccgtacgttcggacgaaacggaagagtaggagtagtggtacgaggtagttcgacgggactaagtaacgttacccgtagaaaaccctacgaagtacctcgaacgtccgacgggacacgacgtacctagtacggactaggaacgaaccgtagaagtaagtacgggaacgaccgaacggaccaatacgttattaagtgtcgcggtacggtaggtgggggtacttaggttggtaacgtaactttacgtaacgtttaatttacgtttaccgtttacgttacggttaccggtttgttcggggttacggtaaccgggtaaaacggtcccgtaccgggtaccgaccccgttcccgttaaccccggtaacccg

SEQ ID NO: 405845 - DNA, 777 bp, Homo sapiens
  misc_feature: GZ8MTXP01B6WZ4.21.67.G01.1.454.CMB.2.raw
  modified_base (368)..(368): a, c, t, g, unknown or other
  modified_base (702)..(702): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtcgcccactcccagactcaactggtgcagtctggacctgaggtgaagagccgtggggcctggtgaaggtctcgtgcgagggtccttcgttggttactagtttttccgacttatagtatcgaggttgggtgcgacgcggtcccgtaggaacgtagggtcttaggaggtggagtgggagtcggggtcccgtaccgttcgacgaaacggaagngtagggtaagtaggtaggtacgtaaaggtactttcggaacgggtactaagttaacgttaccttacggaaccctactaagtactaccgtaacgtcccgacgggtaccacgtaacgtccgtttaacgtacggtaaacgtcggaaacggtaaacccgtaagggtaagtaaacggtacggggaaaccgtaaccgaccggtaacctacggttaaattaggttttaacgtcggtaggaccggtacgggaggggttcgggtacgttagttagggtacctaaacgttacgtttaaacttacgttttaacgttaccgtttcggttaacgggtcggtttacggnggggttaaaccggtaaacggggtacccgtaacggggtacccctaacccggttcctaacccccggcgtaacccccg

SEQ ID NO: 405846 - DNA, 818 bp, Homo sapiens
  misc_feature: GZ8MTXP01BLAGI.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctccgtgcgagggcctcgttggttactagtttttaccgacttatagtatcgtaggttgggtgcgacgacggcccttaggacgaagggtcttaggaggtggagtgggagtcggggcccgtacgttcgacgaaacggaagtagtagggagttagtagggttacgaaggtaacgtttacggacggggtacctaaggtaaaccgtttaacccgttacggaaacccctaacgtaacgaaccgtttaccgaacgttacccccggaacggggtaccaaaccgtaccgtaccccttaacggttacgggaaacgtacgggaaccggtaaccgtaggtaaaggtaacgtacgggaaccgaaccgaaccggaccgaaccgttagttaaagtttaggtttcgacgggtccggacggtagggggtgggggtaccttaagtttacggtaacgttaacttaacgttaacgtttaattttacgtttacgttttcggttacgggtaaccggttcgggttacgggggaaccgtaaaaaccgggggtccctaaccggggttaccccgtaccccggttacccgtaacccccgttaaccgttaacccccccg

SEQ ID NO: 405847 - DNA, 749 bp, Homo sapiens
  misc_feature: GZ8MTXP01ADGR7.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaacggtctcctgcagggcctcgtggttactagtttttccgacttatagtatcgtaggttgggtagacgaaacggtccctaggaacgtaagggtcttggaggtggagtagggacgtcgggaccgtaccgtttacggacgtaaacggaaagtaggtaggtaagttagttagggtacgtaagggtaaatttccggaaggggtaccgtaagtaaacgtttacccgttacggaacccaaaactacggtaaccttacgtaaaccgtacccggaaccggggtaccaacgtacgttacccgttaacgttacggtaaacggttcgggaaacggtaaccgtaaggaacggtaagtacgggaaccgaccgaccgggaactacgttattaagggttagttagggcgacgggtcgtagggtggggtacttaagttacggtactaagtacttaactaatttagttacgttcgttaggtcgttacggacgggacggttaaacggccacggtcgaccgtcccaccgtcgttcccgtaaccccg

SEQ ID NO: 405848 - DNA, 821 bp, Homo sapiens
  misc_feature: GZ8MTXP01BDKVG.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagtttttccgacttatagtatcgaggttgggtgcgacaggccccttggacaagggcttggagtggagtgggatggggcccgacgttcggacgaaacggaaagtagtgggaagttagtgggtacgaaggggtaatttcgaacgggggactaaaggtaaactttacccgttagaaaccccaacgaacgaaccgtccaaacgttccccggaaaccgggggccaaaccgtacgtaccccgttaacgttacgggaaaccgttagggaacggtaaacccgttagggaaggtaaacgtacggggaaaccgaaccgtaaccggggaaccctaaaccgtaaggtttaaacgtttagttacgggttacggaccggtaccggggtaaggggttcggggggtaccttaaggttttacggaacgttaaccgttaacttaaaccgtttaattttaacgtttaacctttcggttacgggtaaccggtttaccggttcgggggttaaccgtaaaacgggggtaccccgtaaccggggttcccgtaaccccggttcccgtaacccccgttaacgggtccccccg

SEQ ID NO: 405849 - DNA, 688 bp, Homo sapiens
  misc_feature: GZ8MTXP01D8XBR.21.67.G01.1.454.CMB.2.raw
  modified_base (447)..(447): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagagccgtggggcctcggtgaaggtctcctgcagggcctcgtggttactagtttttccgactatagtatcgaggttgggtgacgacgtagggccccgttgggaacgtaagggtctttagggaggttggggaggttggggagtcgggggtaccccgtaccgttacggacgaaaacgggaaagtagtagggtagtacgtaggtacaaggtaactttacgaggggacaagtaacttactgaaaccanaagtactacaacgtaccgacgggacacgtacgtcccttaagttacggaactaggaaacggtaacgtaggaagaaagtcggaacgaacgacgacactaattacgttagttcgagcggacggtagggtgggactagttacgataactagtaacttattagttactttggtacggtcgttagggttacgggacgtaaacgggcgtaacgggtccacccgttaccgtaacccgttcggtaacccc

SEQ ID NO: 405850 - DNA, 745 bp, Homo sapiens
  misc_feature: GZ8MTXP01EAFKO.21.67.G01.1.454.CMB.2.raw
  modified_base (275)..(275): a, c, t, g, unknown or other
  modified_base (280)..(280): a, c, t, g, unknown or other
tcagtcgtcgctcgcacgaccggtgctcgatttagagtatacatatttgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtggggctcggtgaaggtctcctgcgaggcctgtgttacttgttttccgatatagtatcagttggtncgacnggcctggacaggcttgagtggagtgggagtcggggccgacgttcgacgtaaacggaaagtgtaggtagtagtaggtacgtaaggtaaagtttcgaacggggtacctaaggtaaacgttacccgttacggaaaacccctaagaacggtacctaccaaccggtacccgaacggggaccacgtaacgtcccttaacgtttacggaaacgtacgggtaaacggaaccgttaagaacggtaaagacggggaacgaacgccggaccctaaataggtttaatttagggttacgtacggacggtcgggaacgggttggggtaacttagtttaggtaagtaccttaagtaacttttaagttacgttttacgttaggtttcgggtaacgttcgggttacggggttaacgggtaaacgggtaccggtaaccgggttaccccgtaccgttacccgttcccccgaacgtaaccccccg

SEQ ID NO: 405851 - DNA, 684 bp, Homo sapiens
  misc_feature: GZ8MTXP01BLCIJ.21.67.G01.1.454.CMB.2.raw
  modified_base (281)..(281): a, c, t, g, unknown or other
  modified_base (407)..(407): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctggtgaaggtctctgcgagggcctcgtggttactagttttccgactatagtatcgaggttgggngcgacacggcccttggacgtaagggtcttagaggtggagtgggagtcgggccgtacgttcgacgaaacggaaagagtggagtagtggtacaggtaattcgaggacagtaattaccgtagaaccaangactacacgtccgacgggacaacacgtacccgtattacgggaactcggaaacggacgtagaagtaggacgaacggacgacggacctacgtagttaagttagttgtcggacgtcgggtagggtgggtactagtttacgtaacgtacttacggttaactttaatttaacgttttacgttacgtttacgggtcggttaacggttcgggggaaccgtaaaaggggtcccgttaaccggggtccctaccggtttaccccgcccccgttaaaggtcccccccg

SEQ ID NO: 405852 - DNA, 695 bp, Homo sapiens
  misc_feature: GZ8MTXP01C9GTZ.21.67.G01.1.454.CMB.2.raw
  modified_base (279)..(279): a, c, t, g, unknown or other
  modified_base (283)..(283): a, c, t, g, unknown or other
  modified_base (366)..(366): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctggtgaggtctcgtgcgagggcctgtggttactagttttccgatatagtatcgaggttgggtncganacggcccgtaggacgaagggtcttaggaggtgggagtggggtaagtcggggacccgtaccgttacggaacgaaacgggaaagngttagggaaggtagtggtacgaagggttatttacggacggggactaaaggtaactttaccctagtaaaacccgataacggacttaccgacgtacccggaccgggacacgtaacgtccgttagtacggacgtaggacggtaacgtagaagacgtacggaacgacaccggacaactagtttacgttaggttgtacggccggaggtgggtagggtacttagttagtaagtacttaattaagttatttactttacgttgttacggggtcgttacggttcggggaacgaaacggtccgtaaccggtccgacccgttacctcccgcgtaaccccg

SEQ ID NO: 405853 - DNA, 681 bp, Homo sapiens
  misc_feature: GZ8MTXP01CMQI9.21.67.G01.1.454.CMB.2.raw
  modified_base (432)..(432): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaagtctccgtgcacgggcctcgttggttactgttttaccgactatagtatcgtaggttgggtgcgacgacggccccttaggacgagggtcttggaggtcggtagtgggtagtcggggtcccgtaccgttcggacgaaacgggaaagtagtagggaagtagtggtacgaaggtagtttcgacgggtacagtaacgttacctagaacccanaacgactacacgtccgacgggcacgacgtacccttagtacggaagttacggaacggtaccgtagaagtaagtcggaacgacgaacgccactagtagttgtgtcgcgtacggtgggtaggggtactgttaggtacgtacttacgttaattaatttacgtttacgttcgttaggtacggttcgggttacggggaccgtaaacggggtaccctcgggtaccctaccggttccctaaccccgcgtaacccccg

SEQ ID NO: 405854 - DNA, 715 bp, Homo sapiens
  misc_feature: GZ8MTXP01A41RE.21.67.G01.1.454.CMB.2.raw
  modified_base (562)..(562): a, c, t, g, unknown or other
  modified_base (705)..(705): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcgtgggcctggtgaacggtctccgtgcgtacgggtcctcgtcggttactacgtttttccgaacttatagtatcgtaggttgggtcgtacgacgtacggtccgttaggacgtaagggtcgtaggtaggtaggagtgggaggtcggggacccgtaccgtccggacaaagggaagtagtagggaggtagtggacgtaaggtagttgaacggtctaagtaacgttacgtacgaaactacaacgtacacgtacgtccggacggtacacgtacgtaccgtaagttaggaacgtacgtaaggaacccgaggtaaagacggtacggacgacgaaccggactaacgtagttagttacgttcggnggacggtacggtggggtacgtagtttaagttaggtaacctaattaacctaattttaagttacgttttaacccgttgtacgggtaacggttcgggttggaaaaccggtaacggtaccccgtggtacccctccggacccgtcccnggtaaccccg

SEQ ID NO: 405855 - DNA, 794 bp, Homo sapiens
  misc_feature: GZ8MTXP01DDEJF.21.67.G01.1.454.CMB.2.raw
  modified_base (424)..(424): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctggtgaggtctcctgcgagggcctgtggttactagtttttccgactatagtatcgaggttgggtgcgacgtacggcccttagggacaagggtcttggacggtggagtgggagtcggggcccgtaccgttcgacgaaacggaaagagtagggtagtagtggtacgaaggtagtttcgacgggcaaggtaacttaccgtagaaacccaancgactaccgtacgtccccgacgggaccacgtacgtcccttaacgtacggaacgtggaacggtaaaccgtaggtaacggtaagtacgggaaccgtaaccgaaccggtaccctaaaccgtaaggtttaacgtttaagttcgggtacggaccgggtacgggtacggggtggggggtaccttaaggtttacgggtaacgttaaccgtttaacgtttaaaccgtttaaagttttaacgttttaccggttacggttttaaccggggtaccgggtttacgggggttacggggaaacccggtaaaaccgggggtaacccgtaacccgggttacccgtaccccggttaccccgtaacccccgttaacggtaaccccccg

SEQ ID NO: 405856 - DNA, 830 bp, Homo sapiens
  misc_feature: GZ8MTXP01EDEWS.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaggtctcctgcgagggcctcgtggttactagttttccgactatagtatcgaggttgggtgcgacgacggcccgttggacgaagggcttggaggtggagtgggaagtcggggacccgtaccgttcggacgaaacgggaaagtagtagggagttagtggtacgtaaggtaatttcggagggactaaaggtaactttaccgttagaaacccacgtaacggtacctacgaacgtacccgaaccggggtacaacgtaccgtaccgttaacgttacggtaacgtacggaaacgggaaaccgttaacgggtaagaaacggtacgggaaaccggaaaccgaaccggaacccgtaaccgttaaagtttaaacgttttaacggtttaggttacgggtaccgggtaccggggtaagggggttacgggggtaaccgtttaggttttaacggttaacggttaaaccggtttaacttaaaccgtttagttttaaaaaaaacgtttccgttttacggttacgggttacgggttacgggttacgggggttaacggtaaacggggtaacccggtaaccggttaccgtacccggttacccgttaaccccgaaccgttaacccccgg

SEQ ID NO: 405857 - DNA, 715 bp, Homo sapiens
  misc_feature: GZ8MTXP01AE7KD.21.67.G01.1.454.CMB.2.raw
  modified_base (360)..(360): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatcgaggttgggtgcgacacggccttaggactagggtcttggaggtggagtgggatcggggacctaaccgttcgacgaaacggaaagngtagggagtagtggtacgaggtaattcggacggacagtaactttaccgtgaaaccacgaagactacactacccggacgggtacacgtacgacctacgtacggtaacgtagaacggtaacgtacgagtaacgtacggaaccgaccgaacgaccgaaccgtagttaacgttagttgtacggtacggcggtaggtacggggtacgtagttaggtaacgtaactaacgttaacttaacgtttacttacgtttacgttacggttaacggttgggttaccccccccgggttaaggtaaaccgggtaccggtaaccggtacccgtacccggttaccccgtaaccccgttaaccgtaaccccg

SEQ ID NO: 405858 - DNA, 641 bp, Homo sapiens
  misc_feature: GZ8MTXP01D7XVJ.21.67.G01.1.454.CMB.2.raw
  modified_base (239)..(239): a, c, t, g, unknown or other
  modified_base (271)..(271): a, c, t, g, unknown or other
  modified_base (341)..(341): a, c, t, g, unknown or other
  modified_base (619)..(619): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagagcgtggggcctcggtgaaggtctctgcaggctntgttactgtttcgatatagtatcgtggttggnacgacgcggccttaggacgtaagggtcttggagtggagtggagtcggggcctacgtgaacgaaggaaagngtggagtagtgtagaggtaattcgaggactaagtaagttacctacgaaacctacgaagtactccgaacgtcccgaacgggacaacgtacgtacctagttacggaacgtacggtaacgtaaccgtaggaagagtacggacgacgacggacacgtattagtttacgtggtcggagtcggtaggtacggggtatacgtttggtaacgtacgttaacttaacgttaatttacttacgtttgtacggtaggttcggttgggacgtaacggcgtaacggtaccncgttaccctccgaacgtccccg

SEQ ID NO: 405859 - DNA, 693 bp, Homo sapiens
  misc_feature: GZ8MTXP01C6S9K.21.67.G01.1.454.CMB.2.raw
  modified_base (361)..(361): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtagaagagccgtggggctcggtagaggtctctgcgaggcctgttggttacttacgttttaccgactagtagtatcgtaggttggtagcgacgacggcccgttaggaacgtaggtcttggaggtggagtggagtcgggaccgtacgtcgaacgaaaggaagngtgggtaagtagttaggtacgtaaggtagttcgacgggactaagtaacttaccgtacgaaaaccctagaacggtaacctcgtaaacgtaccggaacgggacaacgacgtaccgttacgtacggaaacgtggaacgtaacgtagaacgaagtacgggaaccgacgaccggaaacctagttaagttaagtttcggtagtcgggtacgtacgggaggggtcggggtattagttgtaacgtattaacttaattagtttacttacgttcgttaggtcgttacgggttcggaacggtaaggccgtaacgtccctaccgttcctaacccgcgtaacccg

SEQ ID NO: 405860 - DNA, 785 bp, Homo sapiens
  misc_feature: GZ8MTXP01EW01V.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggactgagtgaagagccgtgggctcggtgaaggtctctgcgagggcctcgtggttactacgtttttccgacttatagtatcgtaggttgggtgcgacgaggcccttggacgaagggtcttgaggtggagtgggagtgggcccgtacgttcgacgaaacgggaaagagtagggagttagtggtacgaggtaatttcggaacggtcgtaagtaacttaccgtacgaaaccgacaagtacgtactacgtaccgacgggtacaacgacgacccttaacgttacggaaacgtacggtaaacggtaacgttacggaacgtaaacggtacgggaaccgtaaacccgggaaccgggaaccctaaaccgtaacggtttaagttttaaccggtttagggtacccgggtaccgggtaaccggggtaagggggttacgggggtaaccggtttaagttttccggttaaagttaacccggtttaaacccttaagtttaaacgttttacgtttaaccgtttggtttacgggtacggttacggttggggttaaccgaaaacgggtcccgtaacgggtcccgtacccgttacccgtccccgttcgtaaccccg

SEQ ID NO: 405861 - DNA, 820 bp, Homo sapiens
  misc_feature: GZ8MTXP01CDFG0.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctctggttactagtttttccgactatagtatcgagttgggtgcgacgacggcccgttggacgaagggtcttaggaggtggtagtggggtagtcggggacccgtaccgttcggaccgaaacgggaaagtagtagggtaagtagtggtacgtaagggtaacgtttcggacggggtacgtaagtaacgtttacccgttaggaaacccctaaacgtcggaaccttaccgaacgttaccccgacggggacctacgacgtacccgttaacgttacggaaacgttacgggaaaccggtaaacccgtaggaaacggtaaacggttcgggaaacccgtaaccggaacccgggaccctaaacgtaagtttacgtttaacgttcggtacggtccggtaccgggtaggggtacgggggtaccttaagtttacgggtaacgttaccttaaaccggttaactttaacgtttacgtttaccgttcggtttaacggtaccggggttcggttacgggggaacccgtaaacgggggtacccctaacgggttacccgtaaccccgggttcctaaccccccgttaacggtaaccccccg

SEQ ID NO: 405862 - DNA, 707 bp, Homo sapiens
  misc_feature: GZ8MTXP01BB271.21.67.G01.1.454.CMB.2.raw
  modified_base (183)..(183): a, c, t, g, unknown or other
  modified_base (272)..(272): a, c, t, g, unknown or other
  modified_base (540)..(540): a, c, t, g, unknown or other
  modified_base (566)..(566): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtncagtctggacctgaggtagaagacgcgtgggcctggtgaggtctctgcgaggctgtgttactagtttcgatatagtatcgtaggttggngcgacgcggcctaggaacgtaggtctggaggtggagtggagtcgggaccgtcgtacggacgaaacggaagtacgtagggtaagtaggtaggtactaaggttaacgtttacggaacgggtactaaacggttaacgttaccttacggaaacccgtaagtaacgtactacgtacccgtaccggacgggacacgtacgtacccttaagtacggtaacgtacggtaaacggacgttaacggagtaaggtacggacgaaccgacgtaacctaanaggtttaattggtagtcggtaccggnggtacgggtgggtactttagttacgtagtaaccgttataacgtttaatttacgttaacgttgtacgggtacttcgggttaggggaacggtaacggaaccgtcggtaccgtaccgttacccgtaacccgaacggtaaccccg

SEQ ID NO: 405863 - DNA, 658 bp, Homo sapiens
  misc_feature: GZ8MTXP01CGMAH.21.67.G01.1.454.CMB.2.raw
  modified_base (514)..(514): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggcctggtgaaggtctccgtgcgagggtcctcgtaggttactagtttttccgacttatagtatcgtaggttgggtgcgacgtacggccttggaacgtaaggtcttggagtggagtgggagtgggccgtaccgtcgacgaaacggaagagtggagtagtggtagaggtagttcgaggtactagtacgttactagaaacccagtaacactaccagtacccgacggacacgtacaccttacgtaggaactaggaacgacgtagacgaagtgacgacaccggactactagtacttgtagtgacgtggnggtcgggattagttaggtactaacgttaacttaacgttaacgtttatttacgttcgttagggtaccgttcggttacgggggttaaacctaaccgggtacgtaaccgtaccgtcccgttacccgtaaccccgttcgtaacccccg

SEQ ID NO: 405864 - DNA, 681 bp, Homo sapiens
  misc_feature: GZ8MTXP01C94ES.21.67.G01.1.454.CMB.2.raw
  modified_base (320)..(320): a, c, t, g, unknown or other
  modified_base (332)..(332): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctggaggtagaagaagccgtggggcctcggtagaaggtctccgtgcgaggtccttgttgttactagtttttccgattatagtatcgtaggttggtgcgacaggcccttaggacgaagggtctaggngtggattggggntcggggccctacgttacgacgaaacggaaagtgtagggaagtagtggtactaaggtatttcgaacgggactaagtaacgtttacccgtagaaacccaagaacgactacgtaacgtccgaacgggtcacgacgtacgttacgtagtacggaacgacggtaacgacgtagaacgtaggacgaacgaacgacgtactagtaattagtgtaggtcgacggaggtgggacgtattagtaggtactaacgttaacttaagtttatttaaccttgttcggtacgttaccggttagggaccggtaaacgggaacgtccggtaacctccgttacccgtcccgttaacccggtaacccg

SEQ ID NO: 405865 - DNA, 889 bp, Homo sapiens
  misc_feature: GZ8MTXP01BSL9U.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgccccactcccagactcaactggtgcagtctggacctgaggtgaagagccgtgggcctcggtgaaggtctccgtgcgaggcctgttggttactagtttttccgacttatagtatcgtaggttgggtgcgacgacggtcccgttggaacgtaagggtcttggaggtggagtgggagtcggggaccgtaccgttcggacgaaacggaagtgtagggtagtagtaggtacgtaaggttaagtttccggagggtacgtaagtaacttaccgttacgaaacccaacgtaagaccttaccaccgttccccgaccggggaccaacgtaccgtacccgtttaacggttacggtaaccgtaggtaaccgggtaacccgttagggaaaggtaaacgtaccgggggaaaccgaacccgggaaccggtaaccgtaacccgttaaggtttaaacgttttaacggttcggggttaacggtccgggtaacgggggtacgggggtttacggggggttactttaacgggttttacgggttaaaccggttaccctttaaacggtttaacccttttaaagtttttaaccgtttttaaaccggttttccggtttaacggggttacccggtttaccggggttaacgggggttaaaccggttaaaaccccgggggtacccgttaacccggggtttaccccgtaacccccgggttacccccgtttcccccgaaccccgggtttaacccccccg

SEQ ID NO: 405866 - DNA, 669 bp, Homo sapiens
  misc_feature: GZ8MTXP01CS15W.21.67.G01.1.454.CMB.2.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagtttttccgactatagtatcgaggttggtgcgacaggcccttggacgaagggtcttgagtggatgggagtcggggccgtaccgttcggacgaaacgggaagagtagggagtagttggtacgaaggtaatttcgacggggtacaaggtaactttacccgttacgaaaccctacgaaggtacctacacgtaccgaccgggcaacgaccgtacttacgttaggaactggaacggacgtagagaataggaacgacgacggacacgtagttattagtcgcgacgcggagggtgggggtactagttcgtaagtacttaacgttaacttaatttactttacgtttacgtacgggtacgttcggttgggaacgtaaacgggaccgtaacggtcgcccgttacctccccgaacgtaaccccg

SEQ ID NO: 405867 - DNA, 861 bp, Homo sapiens
  misc_feature: GZ8MTXP01A73LO.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagagccgtggggcctggtgaggtctctgcagggcctgtggttactagtttttccgattatagtatcgtaggttggtgcgacgaggccccttggacaagggtcttggtaggtggagttggggagtcggggccgtaccgtttacggacgaaaacggggaaaggtagttaggggtaaagttacggttagggtacgtaaaggggggtaaacttttcggaaaccgggggttactaaacggttaaaccgttttaacccgttacggtaaaacccctaaacgtaacggaaacccgtttacgtaaacccgttaccccgaaccgggggttacccaaaccggtaacggtaccccttaaacggttacgggtaaaccgttacggaaaccggtaaacccggttagggaaccggtaaaggttaacgggaaccggaaaccgaaccggggaccctaaaccggtaattaagttttactagggtcgacggacgggtagggttagggggtacgttaagtttgggtagtaccgttaaaccggttaacctttaatttaacgttttacgttaccgtttaacggggtaacgtttaccggggttcggggttaccggtaaaaacggggtccccgtaacgggttaccccgtacccggttacccgtcccccggttgtaaccccccg

SEQ ID NO: 405868 - DNA, 846 bp, Homo sapiens
  misc_feature: GZ8MTXP01A1QVW.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagacgcgtgggcctggtagaggtctctgcgaggcctgtggttactgttttaccgatatagtatcgtaggttgggtgcgaacgcggtccccgttaggacgtaagggtcttaggaggttggagttgggacgtcggggaccccgtaccgttacgaccgaaaggaaagtagtagggtaagtagtggtaacgtaaggttaacgtttacggaaggtacaaagttaacgttacccgttacggaaaccctaacgtaacggacccttaccgacgttaccccggaacgggacctaacgtacgttacccctaaggtttaacggaaacgttacgggaaaccggttaaccgtagggaaagttaacggtaccgggaaccgtaacgaaccgggtacctaacgtaaggtttaaacttggtttaggaccgggacggtaccggggtaggggttacgggggtacctttaaggtttagggtaaccgttaaccctttaaaggtttaaccttttaagttttaccgttttaccgtttcggttaaacggggttcccgtttagggggttaacccggggttaacggtaaaaacccgggggtccctaaaccgggtttccccgtaaaccccgggtttccccgtaacccccgggttaacggttaacccccccg

SEQ ID NO: 405869 - DNA, 736 bp, Homo sapiens
  misc_feature: GZ8MTXP01DFCVE.21.67.G01.1.454.CMB.2.raw
  modified_base (233)..(233): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattcccttttcctggtggcagcagcaacaggtgcccactcccagactcaactggtgcagtctggacctgaggtgaagagcgtgggctggtgaggtctcgtgcgnggccttgtggttacttacgttttccgattatagtatcgtaggttgggtgcgacgacgggtcccgttaggacgtaagggtcttaggagtggagttggggaagtcggggcccgtacgttcggacgaaaacggaagtagtaggtagtagtggtacgaaggtaagtttcggagggtactaaggtaactttacccgtacgaaacccaactaacggacctacgaacccgtacccggaaccgggacaacgtacgtaccttacgttacggtaacgtaggaacggaacgtacgaagtaacgacggaacgacgaaccgacgtaacttacgttaagtttagttggtacggtacggacggtacgggttggggtacgttagttagtaacgtacgttaacttaactttaatttacgtacgttttttttttacgtacggttacggttcggttcgggttaacggaacgggtaccgtaaccggttaccgtacccgttacccgtcccgaaccgtaaccccg

SEQ ID NO: 405870 - DNA, 797 bp, Homo sapiens
  misc_feature: GZ8MTXP01ADQV1.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtagaaggtctcgtgcagggtcctcgtggttactagttttccgacttatagtatcgaggttgggtgcgacgtacggccccgttggacgagggtcttggaggttggagtggggagtcggggaccgtacgttcgacgaaacggaagagtagggtaactaggttaggtacgtaaggtaacgtttcggaagggtctaaaggtaaactttacccttaggaaaacccgaacgtaacgtactaccacgtacccggaacgggaccacgacgtacccgttaagttacggaacgttacgggaacggtaaaccgtagggaaacgtaacgtacgggaaacccgaccgaaccgggacctaaactagttttaaacgttaggtttacgggcggacccggtagggtaaggggttcggggtaactttaggttacggttaaacggtaccttaacgttaaaccttagttttaacgtttaccgtttacggttacgggtacgggtttacggttcggggttaaaccggtaaaacggggtccccgtaaacggggttcccctaaccggtttcccccaaccccggttaacgtaaccccccgg

SEQ ID NO: 405871 - DNA, 768 bp, Homo sapiens
  misc_feature: GZ8MTXP01CI9WV.21.67.G01.1.454.CMB.2.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggcctggtgaaggtctcgtgcgacggtcctcgttggttactacgttttccgactatagtatcgaggttgggtcgtcgacgtacggccccgttaggacgtaacgggtcttaggtaggtggtagtggggagtcggggacccgtaccgtttcggaaccgtaaacgggaaagtagtacgggtaagttagtaggtacgaaggttaacgtttacggaacggtacggtaagttaacgttacccgttagaaaacccgtaacaacgtaccttacgaccgtaccggacgggaccaacgtcgtaccttacgtacggaaacgtggaacgtaacgtagaacgtaacgtacggaacgaaccgaacgggacctaagtaacgttagttaaggttcggacggtaccggacgggttaggggtcggggtacctttaggttacgtaagtaaaccttgttaaaccggtttaatttacggtttacgtttcggtacggttaaccgttacgggttaggggaaaccgtaacgggtacccgtaacggacccgtcccggttacctccccggaacgtaacccccg

SEQ ID NO: 405872 - DNA, 802 bp, Homo sapiens
  misc_feature: GZ8MTXP01B6S0C.21.67.G01.1.454.CMB.2.raw
  modified_base (281)..(281): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagacctcaactggtgcagtctggacctgaggtgaagagccgtggggcctcggtgaaggtctcctgcagggcctcgtggttactagttttccgactatagtatcagttgggtncgacaggcccttggacaggtctggagtggatgggatcggggccacgtttcgacgtaaacggaagtagtagggagtagtcggtacgaaggtactttcgaacggggactaagggtaactttacccgttacggaaaccctacgaacggtacctaccgtaacgttcccggaaccgggtaccaaccgtaacggtaccctttaacgttacgggaaaccgttacgggaaacccggtaaacccgttaagggaacgtaaacggttacggggaaaccgtaaccggtaaccggaccgtaaaccgtaaaccggggtttagttttaaacgggttcggttacggaaccggtcccgggtaaggggtcggggggttaacccttagttttacgggtaaggtaacccttaaggtttaacccgttaattttaaccgttactttaccggtttacgggtccggttacgggttcggggaacgtaaacggggccccgttaacggtacccgtacccggttaccgtccccgttaacggttcccccg

SEQ ID NO: 405873 - DNA, 779 bp, Homo sapiens
  misc_feature: GZ8MTXP01E2II1.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatcctttttcctggtggcagcagcaacaggtgcccactcccagactcaactggtgcagtctggacctgaggtgaagaagccgtggggcctcggtgaaggtctcctgcagggcctcgtggttactagtttttccgacttatagtatcgaggttgggtgcgacacggccccttggacaaggggcttggagtggagttggggatcggggccctaccgtcgacgaaacggaaagagtaggagtagtggtacgaagggtaatttcggaacgggacaaggtaaactttacccgttacgaaacccaacgaacgtacctaccaacgtacccggaacggggtaccaaacgtacgtaccccgttaaacgttacggggaaaccgttacgggaaaccgggtaaacccgttaggaaaggtaaaacgtacggggaaaccggacccgaaccgggtacccaaaccgttaatttaagtttaaagtttcggtcgggaccgggacggggtaacgggggttcggggggtaacttacgttttaagggtaacgttaaccttaaccttaaacttaatttaactttacgtttcgtacgggtacgttcggttgggggaccgaaacggggacccgtaaccggttcccacccggttccctccccgaacgtaaccccg

SEQ ID NO: 405874 - DNA, 738 bp, Homo sapiens
  misc_feature: GZ8MTXP01A83ZO.21.67.G01.1.454.CMB.2.raw
  modified_base (217)..(217): a, c, t, g, unknown or other
  modified_base (277)..(277): a, c, t, g, unknown or other
tcagtcgtcgctcgcacgaccggtgctcgatttagagtatacatattgggtttgggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggcctggngagtctcgtgcgaggcctgtggttactagttttccgatatagtatcgagttggtgcgacnggccttggaactaagggtcttggacgtggagtgggagtcggggtccctacgttcgacgaaacggaagtagtgggagttagtggtacgaggtagtttcgagggtactaaggtactttaccgtacgaaacccctagaacgtacttccgaacgtcccgaacggggtacaacgtacgtaccccttaagttaacggacgttacggaaacggtaaacccgttagggaacgttaaacggtcgggaaaccgaaaccggaccgggtaaccctaaggtaattaacgtttagtaccgtgggtaccggtaccgggtaagggtccggggtaattagtttacggaacgttacttacgttaacgtttaagtttacttaacgtttcgttacgggtaccgttacgggttcggggaaccgtaacggggtaccgtaacgggttacccaccggttaccctaacccgaacggttaacccccg

SEQ ID NO: 405875 - DNA, 779 bp, Homo sapiens
  misc_feature: GZ8MTXP01C3DUY.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagttttccgactatagtatcgtaggttgggtgcgacgacggcccgttagggacgtaagggtcttggaggtggagtgggagtcggggacccgtaccgttcgaacgtaaacgggaagagtagggtagtagtggtacgaaggttacttcgagggactaagtaacttaccgtacgaaacccaacgcgtaactaccgaacgtcccgaaccggggacaccgtacggtacctttacggtacggtaacgtaggtaacggaaacccgtaggaaacggtagtacggggaaccaaccgacggaacccacgtaaggtttacgttagttcggtacgacggtaccgggtaggggtcgggggtaacttaggttttcggaaacttaaccgttaagtttaaacctttaagtttaaagttttcccgttacggtttacgggtaacccgtttcgggttaagggggttaacccgttaaaacggggccccgttaaccggttacccggtaacccggttcccctaacccccggttcgggtaaccccccg

SEQ ID NO: 405876 - DNA, 736 bp, Homo sapiens
  misc_feature: GZ8MTXP01D68RP.21.67.G01.1.454.CMB.2.raw
  modified_base (217)..(217): a, c, t, g, unknown or other
  modified_base (258)..(258): a, c, t, g, unknown or other
  modified_base (269)..(269): a, c, t, g, unknown or other
  modified_base (275)..(275): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctgacctgagtgaagagcgtgggcctcggngaggtctctgcaggctgtgttactagttttccgatatagtntcgaggttggngcgacncggcccgttaggacgagggtctggagtggagtggagtcggggacctaccgttacgaacgaaacggaagtgtaggtaagtacgtcggtactaaggtaactttcggaacggtactaacggtaactttaccgttacggaaaccctaacgaacggtactaccgacgtacccgaacgggacaaacgtacgtaccctttaacgtaggtaacgtaggtaacgtaaccgttaaggaacggtaacggtaacgggaaccgaccgaaccggtaccgtaacgtaagggtttattacggtttagcggacggtacggtacgggtgggggtaccttagtttaggtaacgtacttacttaacttaactttacgtttcgtttacgtacggttaccgttacgggttacggggaaccgtaacggggtacccgtaacggtacccgtacccggttaccctaaccccggaaccgtaacccccg

SEQ ID NO: 405877 - DNA, 545 bp, Homo sapiens
  misc_feature: GZ8MTXP02G1O6P.21.67.G01.1.454.CMB.2.raw
  modified_base (379)..(379): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgacttcgcaacggaagatggagtatggtcaggaatttcagggcagatactgaccacngactcatccacgggcacagcctactggactgagactgagatggacgacacggaccacatatatgtagcgcgaggtgggggcagttgtagactacgtactattattacttcttacggtacgtcgtggggacaaagggacgacggtacaccgtctacccgagtccccg

SEQ ID NO: 405878 - DNA, 542 bp, Homo sapiens
  misc_feature: GZ8MTXP02ILHTS.21.67.G01.1.454.CMB.2.raw
  modified_base (380)..(380): a, c, t, g, unknown or other
  modified_base (385)..(385): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgatatagtatcagttgggtgcgacaggcccttggacaagggcttgagtggatgggatgggccgaccttcgcaacggaaagatggagtatggtcaggaattcgagggcagaatactgaccacngactnatccacgggcacagcctatgaactgagaacctgagaatggacgacacggccaacatattattgtgcgcgagtgggggctagttgtagactactactattatacttcttaggacgtcgtagggctaaagggaccacggtcacgtcctacccacgcccg

SEQ ID NO: 405879 - DNA, 555 bp, Homo sapiens
  misc_feature: GZ8MTXP02F8JWW.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttgggacaaggggcttgagtggatgggatggggccgaccttcgcaacggaagatggagtatggtcaggaatttcagggcagaattaccttgaccacagactcatccacgggcacagcctactgaactgagacctgagatggacgacacggcacatattatgtgcgcgagtgggggcagttgtagacgtactactattatttacttcgttggtacgtcgtggggtactaaaggggaccacggtcaccgtcctaccccacggtacccg

SEQ ID NO: 405880 - DNA, 568 bp, Homo sapiens
  misc_feature: GZ8MTXP02ISZ8A.21.67.G01.1.454.CMB.2.raw
  modified_base (387)..(387): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgaccgttcgacaacggaaagagtgggagtatggtcaggaatttcgagggcagaattactgaccangactcatccacgggcacagcctactggaactgagaacctgagaagtggaacgacgacggccaacgtatatttagttcgtgcgcgtaggtggggctagtttgtagacgtactactatttattacttcttggacgttcgtggggacaaaggggacccacggtacaccgtctccccgagtaccc

SEQ ID NO: 405881 - DNA, 555 bp, Homo sapiens
  misc_feature: GZ8MTXP02GP5IG.21.67.G01.1.454.CMB.2.raw
  modified_base (378)..(378): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaaggcttgagtggatgggatgggccgacttcgcaacggaagatggagtatggtcaggaatttcagggcagaatacttgaccacngactcatccacgggcacagcctacttgaactgaggaacctagagaatgacgacacggaccacatattatgtgcgcgagtgggggcagttgtagacgtactactattattacttcttggacgttacgtggggtacgaaagggaccgaacggtccgaccgtctaccccgacggtccccg

SEQ ID NO: 405882 - DNA, 592 bp, Homo sapiens
  misc_feature: GZ8MTXP02HE3JK.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatgggatgggccgacttcgacaacggaaagagtggagtagtggtcaggaatttcgagggcagaattacctgaccacagactcatccgacgggcacagcctactaggaactgacgaactagacgaagtgacgacgacggaccacagtattatgtgcgcgaggtggggactagtttgtacgtacgtaacttactatttattacgtttacgttacggtacgttcgtagggggaactaaaacgggggacctaacggtacacccgtccgtacccccgtaggtacccccg

SEQ ID NO: 405883 - DNA, 540 bp, Homo sapiens
  misc_feature: GZ8MTXP02IS7ZE.21.67.G01.1.454.CMB.2.raw
  modified_base (373)..(373): a, c, t, g, unknown or other
  modified_base (453)..(453): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatgggatgggccgaccttcgcaacggaagatggagtatggtcaggattcaggcagatactgacangactcatccacgggcacagcctactgaactgagaacctgacgaatggacgacacggaccacgatattatgtgacgcgagngggggcagttgtagtactactactattattacttcttagtacgtcgtgggactaaacgggacacggtcaccgtctcccacgtacccc

SEQ ID NO: 405884 - DNA, 559 bp, Homo sapiens
  misc_feature: GZ8MTXP02F2ET5.21.67.G01.1.454.CMB.2.raw
  modified_base (376)..(376): a, c, t, g, unknown or other
tcagtcgtcgctcgcacgaccggtgctcgatttagagtatacatattgggtttggggacccaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttggtgcgacaggcccttggacaagggcttgagtggatgggatgggccgaccttcggcaacggaagatggagtatggtcaggaattcgaggcagattactgaccangactcatccgacggcacagcctacgttgactagaggaacctagagagtgacgacacggacacatattatgtagcgcgaggtggggctagttgtagtactacgtactattattacttcgttacggtacgttcgtggggtacgtaaagggaccgacggtacgaccgtcgtaccccgacgtacccg

SEQ ID NO: 405885 - DNA, 682 bp, Homo sapiens
  misc_feature: GZ8MTXP02IJC4O.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatctaggttgggtgcgacaggcccttggacaaggcttgagtggagtgggatggggccgaccgttcgacgaacggaaagagtagggagtagtggtcaggtaatttcgagggcagtaacttacgttgaccacgagactcacgtccgaccggggcacgacgccctaacgttaggaaactaggaacggaaacccgtaggaacgaaagtacgggaaccgaacgaccggaccgaaccaagttaactttagttggtagtccggcggtaacggggtcgggggtacttaagtttaggtaacggtaacttaaccgttaaacttatttaactttacgtttacgttacggtaccgttacggttagggggaacgaaaacggggacccgtacggttaccgaaccgtccgtaccccgacggtacccccg

SEQ ID NO: 405886 - DNA, 660 bp, Homo sapiens
  misc_feature: GZ8MTXP02FUT3S.21.67.G01.1.454.CMB.2.raw
  modified_base (243)..(243): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctntggttactagtttttccgactatagtatcaggttggtgcgacaggcccttggacaaggcttgagtggatgggatgggccgaccttcgcaaacgggaagagtgggagttagtggtacgaaggtaaatttcgaggggcaagtaacttaccttgaacccacagactcactcccgacgggcacagcctacgttaggaactagaacgaaccgtagaagtaagtcggacgacgacggaccaacgtaataactttagttcgtacggacggacggaagggtgggggtactaaggtttgtaagtaaccttaacgttaacttaatttaactttaacgtttcgttacgggtacgttacggtaggggtaaccgaaaacggggtacccgaacggttaccgaacccgtccgtacccccgacggtacccccg

SEQ ID NO: 405887 - DNA, 595 bp, Homo sapiens
  misc_feature: GZ8MTXP02FQ4FR.21.67.G01.1.454.CMB.2.raw
  modified_base (390)..(390): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaaggcttgagtggatgggatggggccgaccgttcgacaacggaaagagtgggagtagtggtcaggtaatttcgagggcagaattaccttgaccacngactcatccacgggcacagcctactaggaactgagaacctagagaataggacgacacggacacgatattattgtgcgacgaggtgggggactagtttgtaagtacgttaactaacttatttaatttacgtttacttacggtacgttcgtaggggtacgaaaaggggaccgtaacggtaccacccgtcctaccccgacgtaccccg

SEQ ID NO: 405888 - DNA, 588 bp, Homo sapiens
  misc_feature: GZ8MTXP02JO25T.21.67.G01.1.454.CMB.2.raw
  modified_base (381)..(381): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttggtgcgacaggcccttggacaagggcttgagtggatgggatgggccgaccttcgcaacggaaagatgggagtatggtcaggaatttcagggcagaatacttgaccacngactcactccacgggcacacgcctacttggaactggaggaacctagacgaagtggacgacgacggacacagtacttattgtgcgcgaggtggggactagttgtagtactacgtactaatttattaactttcgttaggtacgtcgtacggggacgtaaacggggacccgtaacgggtacgacccgttaccgtacccgacggtaccccg

SEQ ID NO: 405889 - DNA, 549 bp, Homo sapiens
  misc_feature: GZ8MTXP02GNZ0C.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatgggatgggcgaccttcgcaacggaaagatggagtagtggtcaggaatttcagggcagaatacttgaccacagactcaactccacgggcacacgacctacttggaactgacggaacctgagaatggacgacgacggaccacatattatgtgcgcgagtggggctagttgagactactactattattacttctacgtacgtcgtgggtacgaaaggccacggtcaccgtctcccacgtccc

SEQ ID NO: 405890 - DNA, 548 bp, Homo sapiens
  misc_feature: GZ8MTXP02FW373.21.67.G01.1.454.CMB.2.raw
  modified_base (382)..(382): a, c, t, g, unknown or other
tcagtcgtcgctcgcacgaccggtgctcgatttagagtatacatattgggtttggggacccaaaaccacaccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgacttcgcaacggaagatggagtatggtcaggaatttcaggggcagaattaccttgaccacngactcatccacggggcacagcctactggaactgaggaacctgagaatggacgacacggcacatatatgtgcgcgagtgggggctagttgtagacgtactactattattacttcttggtacgttctggggactaaaggggaccacggtcaccggtctccccagcccg

SEQ ID NO: 405891 - DNA, 686 bp, Homo sapiens
  misc_feature: GZ8MTXP02GXKFZ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttggtgcgacaggcccttggacaagggcttgagtggagtgggatggggccgaccgttcgcgaacggaaagagtgggagtagtggtacgaggtaatttcgaggggcaggtaaatttaccgttaggaacccacaggacctacacttacccgacggggacacgacgtaccctacgttcggaaacttcggaaggaaaccctaggaacggtaagtacgggaaccgacgaaccgggacccaacgtaattacgtttaagttgtaggacggcggaagggttgggggactagtttggtaagtacttaacgttaacttagtttaacgtttactttacgtttaggtaccgttacgttagggggacgtaaaacggggtaccgtaaccgggttaccgacccggtccttacccccgacgtacccccg

SEQ ID NO: 405892 - DNA, 563 bp, Homo sapiens
  misc_feature: GZ8MTXP02GOV7M.21.67.G01.1.454.CMB.2.raw
  modified_base (280)..(280): a, c, t, g, unknown or other
  modified_base (375)..(375): a, c, t, g, unknown or other
  modified_base (393)..(393): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtncgacaggcccttggacaagggcttgagtggagtgggatggggccgaccttcgacaaacggaaagagtagggagtagtggtcaggaatttcgaggnagaattaccttgaccacngactcatccgacgggcacacgctacttggaactgagacctgacgagtgacgacacggcacatattatgtgcgcgaggtggggctagttgtagacgtactactatttattacttgttcggtacgtcgtagggtacgaacggacgacggtcaccgtcctcccgacgtacccg

SEQ ID NO: 405893 - DNA, 579 bp, Homo sapiens
  misc_feature: GZ8MTXP02G18HG.21.67.G01.1.454.CMB.2.raw
tcagtcgtcgctcgcacgaccggtgctcgatttagagtatacatattgggtttggggacccaaaaccacacccctccttgggagattcccctagatcacagcccctcaccatggactggacctggagcatccttttcctggtggcagcagcaacaggtgcccactcccagactcaactggtgcagtctggacctgagtgaagagcctggggcctcggtgaaggtctcctgcagggcctctggttacagtttttccgactatagtatcagttgggtgcgacaggcccttggacaagggcttgagtggatgggatgggccgaccttcgcaacggaaagatgggagtatggtcaggaatttcagggcagaataccttgaccacagactcatccacgggcacagcctacttaggactgaggaacctgagatggacgacacggcacgatattatgtagcgcgagtgggggctagttgtagacgttacttacgtattaattacttcttacggtacgttcgtagggggtacgtaaacggggtaccgaacgggttaccaccggtaccgttacccccgacgtaccccg

SEQ ID NO: 405894 - DNA, 559 bp, Homo sapiens
  misc_feature: GZ8MTXP02I935G.21.67.G01.1.454.CMB.2.raw
  modified_base (381)..(381): a, c, t, g, unknown or other
  modified_base (453)..(453): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgaccttcgcaacggaaagatgggagtatggtcaggattcagggcagattacctgaccangactcatccagggcacagcctactggaactgaggaacctgacgaatggacgacacggccacatattaattgngcgcgaggtgggggcagttgtagacgtactactatttattacttcttaggtacgtcgtggggacaaaaggggtaccacggtcaaccgtcgtccccgacggtacccc

SEQ ID NO: 405895 - DNA, 568 bp, Homo sapiens
  misc_feature: GZ8MTXP02JCQGZ.21.67.G01.1.454.CMB.2.raw
  modified_base (377)..(377): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggccccttggacaagggcttgagtggatgggatgggcgacttcgcaacggaagatggagtatggtcaggaatttcagggcagatacctgacacngactcatccacgggcacagcctactggaactgaggaacctgacgaatggacgacgacggaccacgatattattgtagtcgcgagtgggggctagttgtagtactactacgtattattacttcttacggtcgttacgtggggtacgaaagggtaccgacggttacaaccggtcctaccccgaacggtccccg

SEQ ID NO: 405896 - DNA, 608 bp, Homo sapiens
  misc_feature: GZ8MTXP02G197Z.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttggagtggatgggatggggccgacttcgcgaaacggaagagtgggagtagtggtcaggaatttcgagggcagaattactgaccacagactcataccgacgggcacacgacctacttaggaactagacggaacctagacgaagtggacgacgacggaccacgatattagtgtagtcgacgaggtcgggggtctagttgtaagtactaacgttacgttactttattacgtttcgttacggtacgttcgtacggggtacgaaacggggtaccgaccggtaccgtacccgtcctaccccgacggtccccg

SEQ ID NO: 405897 - DNA, 564 bp, Homo sapiens
  misc_feature: GZ8MTXP02GV9HJ.21.67.G01.1.454.CMB.2.raw
  modified_base (242)..(242): a, c, t, g, unknown or other
  modified_base (381)..(381): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctntggttacagtttttccgactatagtatcagttggtgcgacaggcccttggacaagggcttgagtggatgggatgggccgacttcgcaacggaagatgggagtatggtcaggaatttcagggcagaattacttgaccacngactcatccacgggcacagcctatggactgagacctgagatggacacgacgacacagtattatgtgcgcgaggtggggctagttgtagactacgtactatttattaacttcttaggtacgttcgtagggggtacgaaacgggtaccgaacggtaccgaaccgtccgtaccccgacgtaccccg

SEQ ID NO: 405898 - DNA, 570 bp, Homo sapiens
  misc_feature: GZ8MTXP02FIJUE.21.67.G01.1.454.CMB.2.raw
  modified_base (387)..(387): a, c, t, g, unknown or other
  modified_base (462)..(462): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctgttggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggccccttggacaagggcttgagtggatgggatggggccgaccttcgcaacggaagatgggagtatggtcaggaatttcgagggcagaattaccttgaccacngactcatcccgacgggcacagcctacttaggaactgaggaacctgagaatggacgacacggcacatatattgtgngcgagtgggggctagttgtagactacgtactattattacttcgttacggacgttcgtggggtacgaaacggggtaccacgggtcacccgtctaccccgacgtaccccg

SEQ ID NO: 405899 - DNA, 650 bp, Homo sapiens
  misc_feature: GZ8MTXP02JAPOT.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctggtgaaggtctctgcgaggcctgtggttactagttttccgatatagtatcagttggtgcgacaggcccttggacgaaggcttgaggtggagtgggatgggccgaccgttcgcgaaacggaagagtagggagtagtggtacgaggtaatttcgacggggtacaagtaatttaccgtttacgaacccgacgacggaacttacaactacccgacggggtaccacgacgtacccttacgttacggaacgttaggaacggaaccctaggaacgaaagtcggaaccgacgaccggacccgaacaattagtttattagtgacgcgtaggtggggactagttagtagactacgtaacttatttattacttacgttaggtacgttcgtaggggacgtaaacgggaccgacggtaccgaccgtcccgacccgtacgtacccccg

SEQ ID NO: 405900 - DNA, 574 bp, Homo sapiens
  misc_feature: GZ8MTXP02IZ2HP.21.67.G01.1.454.CMB.2.raw
  modified_base (280)..(280): a, c, t, g, unknown or other
  modified_base (381)..(381): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgatatagtatcagttgggtgngacaggcccttggacaagggcttgagtggatgggatgggccgaccttcgcaacggaaagatgggagtatggtcaggatttcagggcagaattactgaccangactcatccacgggcacacgcctacgtagaacgtgaaggaaccgtgacgaatggacgacacggacacgatattatgtgcgcgaggtgggggctagttgaagtacgtactactatttattacttacgttcggtacgttcgtagggtacgaaagggaccgtaacggtcgtaaccggtcctaccccgacgtacccc

SEQ ID NO: 405901 - DNA, 575 bp, Homo sapiens
  misc_feature: GZ8MTXP02HZVFR.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttggagtggatgggatggggccgaccttcgcaacggaaagatgggagtagtggtcaggaatttcagggcagaattaccttgaccacagactacgatccgacgggcacacgcctacttggaactgaggaacctagagaagtggaacgacgacggaccacgatattattgtgcgcgaggtggggcagtttgtagactacgtacttattattacttcttaggtacgtcgtggggacgaaacgggaccgaacggtcaccgtaccgtcccaacgtcccc

SEQ ID NO: 405902 - DNA, 587 bp, Homo sapiens
  misc_feature: GZ8MTXP02HQKGW.21.67.G01.1.454.CMB.2.raw
  modified_base (387)..(387): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcgacaacggaaagatgggagtagtggtcaggtaatttcgagggcagaattacttgaccangactcatccgacgggcacagcctacttggaactgaggaacctagagaatggacgacgacgacacgatattattgtgcgcggaggtggggctagtttgtagacgttacttaactatttatttacttacgttacggtacgttcgtacggggacgtaaacggggaccgaacgggtccaaccggtcctaccccgacgtaccccg

SEQ ID NO: 405903 - DNA, 562 bp, Homo sapiens
  misc_feature: GZ8MTXP02FW7D0.21.67.G01.1.454.CMB.2.raw
  modified_base (384)..(384): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcagggcctctggttacagtttttccgactatagtatcagttgggtgcgacaggcccttggacaagggcttgagtggatgggatgggccgacttcgcaacggaagatgggagtagtggtcaggtaatttcgagggcagaattaccttgaccangactcatacccacgggcacagcctattggaactgaggaacctagagaatggacgacgacggaccacgataattattgtagcgcgaggtgggggctagtttgagtactactactatttattacttcttggtacgtcgtggggacaaagggaccacggtacaccgtctcccagtaccccg

SEQ ID NO: 405904 - DNA, 620 bp, Homo sapiens
  misc_feature: GZ8MTXP02HGHU6.21.67.G01.1.454.CMB.2.raw
  modified_base (386)..(386): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttggagtggatgggatggggccgacttcggcaacggaaagatgggagtagtggtcaggaatttgaggggcagattaccttgaccangactcatccagggcacagcctactggaactgacggaactgaagaatggaacgacacggaccaacgatatttactgttgacgcgaggtcgggggctagtttaggtaacggacttaaacttacgttaactttactttaactttacgtttacggtaccggttcgttagggggtaccgaaaacggggtaccgtaacggggttaccaacccggttcccgtacccccgtacgtacccccg

SEQ ID NO: 405905 - DNA, 544 bp, Homo sapiens
  misc_feature: GZ8MTXP02GRYVM.21.67.G01.1.454.CMB.2.raw
  modified_base (380)..(380): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgacttcgcaacggaagatggagtatggtcaggatttcagggtcagataccttgaccacngactcatccacgggcacagcctattggaactgaggaacctgagaatgacgacacggccacatattatgtagcgcgagtgggggcagttgtagactactactattattacttcttcggtacgtcgtggggtacaaagggaccacggtcaccggtctcccagtccc

SEQ ID NO: 405906 - DNA, 559 bp, Homo sapiens
  misc_feature: GZ8MTXP02I9WCU.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgacttgcaacggaagatggagtatggtcaggaatttcgagggcagaattaccttgaccacagactcatccagggcacagcctacttggaactgagaacctgagaatggacgacacggccacatatatgtgcgcgagtgggggcagttgtagactacgtactattattacttcttaggtacgtcgttggggacgtaaaggggaccacggtaccaaccgtccttaccccgacgtaccccg

SEQ ID NO: 405907 - DNA, 601 bp, Homo sapiens
  misc_feature: GZ8MTXP02HFWKS.21.67.G01.1.454.CMB.2.raw
  modified_base (251)..(251): a, c, t, g, unknown or other
  modified_base (391)..(391): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttacngtttttccgactatagtatcagttgggtgcgacaggcccttggacaagggcttgagtggatgggatggggccgacgttcgcaacggaaagagtgggagtatggtcaggtaatttcgagggcagtaacttacttgaccacngactcactccgacgggcacacgaccctacgttacggaactaggaacggaacccgtagaagaaagtagggaacgaacgacgggaccaactaatatttaagttgtagacgcgaggtgggggctagttagtagactacgtacttatttattacttgttacgtacgtcgttagggacgaaaggacgacggtacaccggtcctacccgacgtccc

SEQ ID NO: 405908 - DNA, 574 bp, Homo sapiens
  misc_feature: GZ8MTXP02H3W8Q.21.67.G01.1.454.CMB.2.raw
  modified_base (347)..(347): a, c, t, g, unknown or other
  modified_base (378)..(378): a, c, t, g, unknown or other
  modified_base (452)..(452): a, c, t, g, unknown or other
  modified_base (461)..(461): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttcgatatagtatcagttggtgcgacaggccccttggacaaggcttgagtggatgggatggggccgaccttcgacaacggaaagatggagtanggtcaggattcagggcagaatactgacaacngactcatccaacggggcaacagacctactggaaactggaggaacctagagaaatggaacgacaacggaccaaanatattatgngcgaggaggtaggggatagttagtagactaactaactaatttattacttacgttacggtacgtcgtagggaacgaaaacgggaccaacggtaccaccgtcctacccgacgccc

SEQ ID NO: 405909 - DNA, 566 bp, Homo sapiens
  misc_feature: GZ8MTXP02HP01P.21.67.G01.1.454.CMB.2.raw
  modified_base (384)..(384): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttgggtgcgacaggcccttggacaagggcttgagtggatgggatgggccgacttcgcaacggaagatgggagtagtggtcaggaatttcgaggggcagaattaccttgaccangactcatccacggacacacgcctacgtgaactgaggaacctgagaatggacgacacggccacatattatgtgcgcgaggtgggggctagtttgagtactaactacttattattacttcgttggtacgtcgttaggggactaaacggggaccaacgggtcaccgtcctaccccgtacgccccg

SEQ ID NO: 405910 - DNA, 560 bp, Homo sapiens
  misc_feature: GZ8MTXP02HDBMW.21.67.G01.1.454.CMB.2.raw
  modified_base (382)..(382): a, c, t, g, unknown or other
  modified_base (435)..(435): a, c, t, g, unknown or other
  modified_base (441)..(441): a, c, t, g, unknown or other
  modified_base (458)..(458): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaaggcttgagtggatgggatgggccgacctcgcaacggaaagatgggagtatggtcaggaatttcaggggcagaattacttgaccanagactcatccacgggcacagcctactggaactgaggaacctgagaatgacganacgcanatattatgtgcgcgagngggggcagttgtagacgtactactattattacttcgttcggtacgttcgtggggactaaaaggggacccaacggtccaaccgtcctaccccgtacgaccccg

SEQ ID NO: 405911 - DNA, 564 bp, Homo sapiens
  misc_feature: GZ8MTXP02G4KFO.21.67.G01.1.454.CMB.2.raw
  modified_base (462)..(462): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatgggatggggccgacttcgcaacggaagatgggagtatggtcaggaatttcaggggcagaattaccgttgaccacagactcatccacggggcacagcctactggactgaggaacctgagaatggacgacacggcacatattatgtgcgcgagngggggctagttgtagactacgtactattattacttacgttaggtacgtcgtggggtacgaaaggggtaccacggtacaccggtacctccccgacggtccccg

SEQ ID NO: 405912 - DNA, 572 bp, Homo sapiens
  misc_feature: GZ8MTXP02J163E.21.67.G01.1.454.CMB.2.raw
  modified_base (485)..(485): a, c, t, g, unknown or other
  modified_base (488)..(488): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctctggttactagtttttccgactatagtatcagttgggtgcgacaggcccttggacaagggcttgagtggagtgggatgggccgtaccttcgacgaacggaaagatagggagtagtggtacaggaatttcgagggtcagaattaccttgaccacacgactcatccgacgggcacgagcctacgtggaactgagaacctagagaagtggacgacagtacgacactatattatgtgcgcgtagggnggnttgttagacgtatactacttattacttacttacgtcgtcgtggtaggaacgaacggacgtacggtacctcgtccctacgacccg

SEQ ID NO: 405913 - DNA, 553 bp, Homo sapiens
  misc_feature: GZ8MTXP02J27K1.21.67.G01.1.454.CMB.2.raw
  modified_base (277)..(277): a, c, t, g, unknown or other
  modified_base (386)..(386): a, c, t, g, unknown or other
tcagtcgtcgctcgcacgaccggtgctcgatttagagtatacatattgggtttggggacccaaaaaccacacccctccttggagattcccctagatcacagcccctcaccatggactggacctggagcatccttttcctggtggcagcagcaacaggtgcccactcccagactcaactggtgcagtctggacctgaggtgaagaagcctggtcctcggtgaaggtctcctgcagggcctctggttacagtttttccgactatagtatcagttgggtncgacaggcccttgggacaaggggcttgagtggatggggatggggcccgacctcgcacggaaaagatggagtagtggtcaggaatttcagggcagattactttgaccacngactcactccacgggcacagcctacttggaactgagaaccgtgagaataggacacgacggccacatattattgtgcgcgaggtgggggcgattgttagactaactactattattacttcttggtacgtctgggcgaaaggaccacggtcaccgtcctccccacgccc

SEQ ID NO: 405914 - DNA, 556 bp, Homo sapiens
  misc_feature: GZ8MTXP02IUPL7.21.67.G01.1.454.CMB.2.raw
  modified_base (385)..(385): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatgggatggggccgaccgttcgcgaacggaaagagtgggagtatggtcaggaatttcagggcagaattactgacacngactcatccacggcacagctactgactgagactgagatgacgacacggaccacgatattatgtgcgacgaggtggggctagttgtagactactactagttattacttcgttacgtacgttcgtggggacgaaaagggaccgacggtccgaccgtccgtcccacgtaccccg

SEQ ID NO: 405915 - DNA, 614 bp, Homo sapiens
  misc_feature: GZ8MTXP02GWICE.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggagtgggatggggccgaccttcggacgaacggaaagagtgggagtagtggtacaaggtatttcgaggggcagtaattaccgttagaccaacgagactacacgtcccgacgggacacgacgcctacgttacggaactgaaggaaccctagacgaagtacggacgacgacggaccgactatattagtgtagcgacggtaggtgggggtctagttgtagtactacttacgtatttacttacttacgttacggtacgttacgtagggacgtaaacgggaccgacggtactaccgtctacccgacgtcccg

SEQ ID NO: 405916 - DNA, 565 bp, Homo sapiens
  misc_feature: GZ8MTXP02G1TE2.21.67.G01.1.454.CMB.2.raw
  modified_base (383)..(383): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcgcaacggaagatggagtatggtcaggaatttcagggcagaattaccttgaccacngactcatccacgggcacagcctacttggaactgagaacctgagaatggacgacgacggaccacatattatagtgcgcgaggtgggggcagtttgtagtactactacttaattattactttcttggtacgtacgtggggtacgaaagggacccgaacggtccaccgtcctccccgagtacccc

SEQ ID NO: 405917 - DNA, 555 bp, Homo sapiens
  misc_feature: GZ8MTXP02IZFFW.21.67.G01.1.454.CMB.2.raw
  modified_base (387)..(387): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaaggggcttgagtggatgggatgggccgaccttcgcaacggaagatgggagtagtggtcaggaatttcaggggcagaattaccttgaccacngactcatccacgggcacagcctacttggaactgaggaacctgacgaatggacgacgacggaccacatacttattgtgcgcgagtgggggctagttgtagactatactattattacttcttgacgtcgtgggtacgaaaggaccgacggtcaccgtcctcccacgtccc

SEQ ID NO: 405918 - DNA, 561 bp, Homo sapiens
  misc_feature: GZ8MTXP02ITIQ1.21.67.G01.1.454.CMB.2.raw
  modified_base (386)..(386): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgaccttcgcaacggaaagatgggagtatggtcaggtaattcgagggcagaattaccttgaccangactcatccacgggcacgagcctactggactgaggaacctgagatgacgacacggcacatattatgtgcgcgagtggggcagttgtagactacgtactattattacttacgttaggtacgttcgtaggggacgtaaagggaccgacggtactaccgtccgtcccgacgtaccccg

SEQ ID NO: 405919 - DNA, 567 bp, Homo sapiens
  misc_feature: GZ8MTXP02G88YT.21.67.G01.1.454.CMB.2.raw
  modified_base (383)..(383): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgaccttcgcaacggaaagatgggagtatggtcaggaatttcagggcagattactgaccacngactcatccacgggcacacgcctactggaactgacggaacctagagaatggacgacgacggacacatattatgtgcgcgaggtggggctagtttgtagtactacgtactagtttattacttcgttacggtacgtcgtggggacgaaacgggaccacggtcaccggtcctacccgacgtaccccg

SEQ ID NO: 405920 - DNA, 571 bp, Homo sapiens
  misc_feature: GZ8MTXP02IMLCG.21.67.G01.1.454.CMB.2.raw
  modified_base (227)..(227): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgagagcctggggcctcggtgaaggtcncctgcagggcctctggttacagtttttccgactatagtatcagttggtgcgacaggcccttggacaagggcttgagtggatgggatgggccgaccttcgcacggaaagatgggagtatgggtcaggaaatttcgagggacagaattaccttgaccacagactcatcccacggggcacagcctatggaactgaggaactagagaatggacgacacggacacatacttattgtgcgcgaggtgggggctagttgtagactactactatttattacttcttaggtacgttcgttggggacgaaacggggacctaacggtccgtaccggtcctccccgacgtaccccg

SEQ ID NO: 405921 - DNA, 635 bp, Homo sapiens
  misc_feature: GZ8MTXP02GWAJF.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggcctgtggttactagtttttccgatatagtatcgtaggttggtgcgacaggccccttggacgaagggcttggagtggagtgggatggggccgacgttcgacgaaacggaaagagtgggagtagtggtacgaggtaatttcgagggtacaagtaattaccgtgaaccagagacctacacgtacccgacgggacaacacgtaccctacgttacggaaactaggaacggaacccgttagaacgtaagacggaacgaacgacggacccataaattatttagtgtggacgacgagggtcggggtatagttagaagtacgtacttactatttattacttgttacggtacgtcggtagggacgaaaggcccgtacggtaccaccgtcctacccgtacgaccccg

SEQ ID NO: 405922 - DNA, 587 bp, Homo sapiens
  misc_feature: GZ8MTXP02IQ9BH.21.67.G01.1.454.CMB.2.raw
  modified_base (340)..(340): a, c, t, g, unknown or other
  modified_base (388)..(388): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcgcaacggaaagntgggagtatggtcaggaaatttcgaggggcagaattaccttgaccacngactcatccacgggcacagcctactggaactgaggaacctgagaatggacgacacggcacatattatgtgcgcgaggtggggctagtttgtacgtactacgttaactatttaattactttcgttaggtaccgttcgtagggggtacgaaaacggggacccgtacgggtaccacccggttcctacccccgacgtaccccg

SEQ ID NO: 405923 - DNA, 619 bp, Homo sapiens
  misc_feature: GZ8MTXP02F6AYN.21.67.G01.1.454.CMB.2.raw
tcagtcgtcgctcgcacgaccggtgctcgatttagagtatacatattgggtttggggacccaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagttttccgactatagtatcagttggtgcgacaggcccttggacaagggcttgagtggatgggatggggccgaccttcgacgaacggaaagagtgggagtagtggtcaggaatttcgagggacagaattaccttgaccacagactcataccgacggggacacacgacctacttaggaactagacggaaacccgtagagaaagtacgggaacgacgacggaccaaccaattaacttagttgttaggacgacggaggtgggggctagtttggtaagtactaacgtaacttatttattactttcgttacgtacgtcgtcggggacgaaaacgggtaccgacggtaccgaccgtcctaccccgacgtacccccg

SEQ ID NO: 405924 - DNA, 588 bp, Homo sapiens
  misc_feature: GZ8MTXP02HX87V.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaaggcttgagtggatgggatgggccgacgttcgcgaacggaagatgggagtatggtacaggaatttcgagggacagtaattaccgttagaccacagactacactcccgagggcacacgcctactggaactgacgaacgtgacgaagtggacgacgacggaccacaataattagttgtagcgacgaggtggggactagttgtaagattaacgtactatttaattacttcgttaggtacgttacgtagggacgaaacggtaccgacggtacacccgtcctacccgtacgtaccccg

SEQ ID NO: 405925 - DNA, 598 bp, Homo sapiens
  misc_feature: GZ8MTXP02IUBBA.21.67.G01.1.454.CMB.2.raw
  modified_base (389)..(389): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatgggccgaccttcgcaacggaaagatgggagtagtggtcaggaatttcgagggcagtaattaccttgaccacngactcatcccgacgggcacgagcctacgtggaactgaggaacctgagaagtggaacgacgacggccaacgataattagttgtgccgcggaggtggggctagtttgtagtacttacttaacgttatttatttactttcgttacggtacgttcgtaggggacgtaaagggtacccgacgggttaccaccggtacctccccgacgtaccccg

SEQ ID NO: 405926 - DNA, 579 bp, Homo sapiens
  misc_feature: GZ8MTXP02F2KIQ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttacagtttttccgactatagtatcagttgggtgcgacaggcccttggacaagggcttgagtggatgggatggggccgacttcgcaacggaagatggagtatggtcaggtaatttcgagggcagaattaccttgaccacagactcataccacgggcacagcctacttgaactgagaacctgagaataggacacgacggaccaacatacttattagtgcgcgaggtgggggcagttgagactactactattattacttcgttaggtacgttacgtcggggtaacgaaaacgggtaccgacggtaccaacccgtccgtacccccaggtacccccg

SEQ ID NO: 405927 - DNA, 567 bp, Homo sapiens
  misc_feature: GZ8MTXP02JIXM6.21.67.G01.1.454.CMB.2.raw
  modified_base (384)..(384): a, c, t, g, unknown or other
  modified_base (477)..(477): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatgggccgacttcgcaacggaagatgggagtatggtcaggaatttcgaggggcagtaattactgaccangactcatccgacgggcacagcctactggaactgacgaacctagagaatggacgacgacggaccacgatattattgtagcgcgaggtcgggggntagttgtagtactactactattattacttcttaggtacgtcgtaggggacgaaagggaccacggtcaaccgtcctaccccgagtaccccg

SEQ ID NO: 405928 - DNA, 577 bp, Homo sapiens
  misc_feature: GZ8MTXP02IGCD8.21.67.G01.1.454.CMB.2.raw
  modified_base (383)..(383): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaaggcttgagtggatggatgggcgacttcgcacggaaagatggagtatggtcaggatttcgagggcagtaacttacttagacctacngactcactccacggggcacgacgacctactgaactgaggaacctagagaagtaggaacgacgacggaccacactattattagtgagcgaggtggggcgtagttgtagtactactactatttattatttacccccgttagtacgtacgtggtacgaaaggtaccgacggtacgaccgtccgtcccgtacgacccg

SEQ ID NO: 405929 - DNA, 763 bp, Homo sapiens
  misc_feature: GZ8MTXP02JCCPY.21.67.G01.1.454.CMB.2.raw
  modified_base (390)..(390): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttggtgcgacaggcccttgggacaagggcttgagtggatgggatggggccgaccgttcggcgaacggaaagactgggagtatggtcaggaatttcagggcagaattacctgaccagngactcatcccacggggacacagaccctacttcggaaactggaacggaacccgtagaaggaaacgtgggaacgaaaccgaccggggaaccaaccgtaaacgttaaacgtttaagtttacggttacgggaccggaccgggtaacgggggttaggggggtccgtaaacggtttttaggtaaacggggttaaaccgttaaaacctttaaaccggtttaaatttttaaacgtttaaaccgtttttaccggtttaacggggttaaccggttaccggtttacgggggtaacccggtaaaaacgggggtaaccccgtaaccgggggttaacccgtaaaccccggggtttcccttaccccccggtaacggtaacccccccgg

SEQ ID NO: 405930 - DNA, 567 bp, Homo sapiens
  misc_feature: GZ8MTXP02F98E0.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgaccgttcgacgaacggaaagagtagggagtagtggtcaggtaatttcgaggggcagtaattaccttgaccacagactcactccgacgggcacagcctactcggaactgaggaacctgagaagtggacgacgacggaccacatattagtgtgcgcgaggtggggctagttgagtactactactattattacttctcgtacgtcgtgggacgaaggaccgacggtcaccgtctacccgacgtcccg

SEQ ID NO: 405931 - DNA, 590 bp, Homo sapiens
  misc_feature: GZ8MTXP02F7QBA.21.67.G01.1.454.CMB.2.raw
  modified_base (468)..(468): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatggggatggggccgaccttcgacaacggaaagatgggagtagtggtcaggaatttcgagggcagaattaccttagaccacagactcatccgacgggcacagcctacttaggaactagaggaacctgagaagtggacgacacgaccgacatattatgtgngcgaggtgggggctagtttagagtacgtaacttactattatttacttcgttacggtacgtcgtacggggtacgaaacggggtaccgaacggtactaacccgtcctacccccgagtacccccg

SEQ ID NO: 405932 - DNA, 592 bp, Homo sapiens
  misc_feature: GZ8MTXP02JJSAE.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatgggatgggccgaccgttcgcaacggaagatgggagtatggtcaggaatttcgaggggcagtaattaccttgaccacagactcatccgacgggcacgacgcctacgttaggaactgaggaaccgtgagaagtaggacgacgacggaccacgatattatgtgcgacggaggtgggggctagtttgtagtactacgtaacttattacttacttcgttacggtacgttcgtaggggacgtaaagggaccgtaaccggtcgacccgtacgtaccccgacgtaccccg

SEQ ID NO: 405933 - DNA, 647 bp, Homo sapiens
  misc_feature: GZ8MTXP02JXZBH.21.67.G01.1.454.CMB.2.raw
  modified_base (279)..(279): a, c, t, g, unknown or other
  modified_base (391)..(391): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttggtncgacaggcccttggacaaggcttgagtggatgggatgggccgacttcgacgaaacggaaagagtgggagtagtggtcaggtaatttcgagggcagtaattaccgtgaaccanacgactcactccgacggggcaacgacgaccctacgttacggaacgtggaacggaacccgtaggaacgaaagtacgggaaccgaccgaaccgggaccaactaattagttagttagtcggacgcgtaagggtcgggggtactagtttaggtaacggtacttaacttacttaatttattacgtttacgttacggtacgtcgttaggggacgaaacggggtacctaacggtccgacccggtcctaccccgacgtaccccg

SEQ ID NO: 405934 - DNA, 607 bp, Homo sapiens
  misc_feature: GZ8MTXP02G7QHI.21.67.G01.1.454.CMB.2.raw
  modified_base (343)..(343): a, c, t, g, unknown or other
  modified_base (390)..(390): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatggggccgacttcgacgaacggaaagngtggagtatggtcaggtaatttcgagggcagtaattaccttgaccanagactcactccgacgggcacagcctacttggaactgagaacctagagatggaacgacacggcacatattatgtagcgcgaggtggggactagtttaggtagtaacttaacgttaacttatttaagtttacgtttacgttacggtacgttcgtaggggacgtaaaaggggtaccctaacgggttaccacccgtaccgttaccccgacggtaacccccg

SEQ ID NO: 405935 - DNA, 561 bp, Homo sapiens
  misc_feature: GZ8MTXP02HZ7ZF.21.67.G01.1.454.CMB.2.raw
  modified_base (327)..(327): a, c, t, g, unknown or other
  modified_base (378)..(378): a, c, t, g, unknown or other
  modified_base (496)..(496): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggcacttcgnaacggaagatggagtatggtcaggatttcagggcagtaatacttgaccacngactcatccgacgggcacacgcctacttggaactgaacggacctagagataggacgacgacgccacatattatgtgcgcgagtgggggcagtttgagacgtatactattatttacttnttcggtacgtcgttaggggacgtaaagggaccaacgggtcacccggtcctccccgtaacgccccg

SEQ ID NO: 405936 - DNA, 615 bp, Homo sapiens
  misc_feature: GZ8MTXP02ISL9M.21.67.G01.1.454.CMB.2.raw
  modified_base (243)..(243): a, c, t, g, unknown or other
  modified_base (412)..(412): a, c, t, g, unknown or other
  modified_base (499)..(499): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggcctntggttactagtttttccgattatagtatcgaggttgggtgtcgacaggtccccttggacaagggcttggagtggatggggatcggggaccgtaccttcggacaaacgggaaaagagtagggagtagtgggtacaggtaaatttcgagggcagtaattaccgtgaccacngactcactcccgacgggcacacgcctactaggaactggagaaccgtagagaataggacgacgacggaccactagtattagtgtgcgngacggtgggggctagtttgagtactaacttacgtatttattacttaccgttaggtacgttcgtagggtacgaaacgggtaccgacggttacgaccgtccgtaccccgacgtccccg

SEQ ID NO: 405937 - DNA, 600 bp, Homo sapiens
  misc_feature: GZ8MTXP02F3YJM.21.67.G01.1.454.CMB.2.raw
  modified_base (279)..(279): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtncgacaggcccttggacaagggcttgagtggatgggatgggccgacttcgacaacggaaagagtggagtagtggtacaggtaatttcgaggcaagaattacctagaccacagactcactaccgacgggcacgacgtcctacgtaggaactagacgaaccgtagagaagtaggacgacgacggaccacatacttatgtagcgacgaggtggggactagtttgagtacgttaactacttattatttaccttgttacggtaacgttcgtggggaccgtaaagggacccgtacggtccgaacccggtcctaccccgacgtaccccg

SEQ ID NO: 405938 - DNA, 567 bp, Homo sapiens
  misc_feature: GZ8MTXP02JOVC0.21.67.G01.1.454.CMB.2.raw
  modified_base (379)..(379): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccacgttgcaacggaagatggagtatggtcaggaatttcagggcagaattacttgaccangactcatccacgggcacagcctacttaggaactgaggaacctagacgaatggacacacggacacatactaatgtgcgcgaggtgggggctagttgtagtactaacgttactattattacttcgttaggtacgtcgtaggggactaaaggggaccgtacggtacgacccgtccgtacccgacgtacccg

SEQ ID NO: 405939 - DNA, 585 bp, Homo sapiens
  misc_feature: GZ8MTXP02H5UA2.21.67.G01.1.454.CMB.2.raw
  modified_base (387)..(387): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactgtttttccgactatagtatcagttgggtgcgacaggcccttggacaagggcttggagtggatgggatggggccgacttcgcaacggaaagatgggagtatggtacaggaatttcagggcagattaccttgaccacngactcatccacgggcacagcctactgatgagaaccgtgagaatggaacgacgacggacacgactattactaggtagcgcgaggtgggggctagttgtaggactacgtactatttaagttacttacgttggaacgtcggttcggggacgaaaaggggtacccaacgggtactacccggtccttccccgaacgtcccccg

SEQ ID NO: 405940 - DNA, 601 bp, Homo sapiens
  misc_feature: GZ8MTXP02F22EZ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatggggccaccttcgcaacggaagagtggagtagtggtcaggtaatttcgagggcagtaattaccttgaaccacagactcatcccgacgggacacgagcctacgttaggaactagacgaaccgtagagaacgtaggacgaacgacggaccaacattattagttgtagacgacgtaggtgggggactagtttgagtactactactatttattacgttcgttaggtacgttacgtcggggacgaaacggggacctaacggtaccaccgtcctaccccgacgtaccccg

SEQ ID NO: 405941 - DNA, 614 bp, Homo sapiens
  misc_feature: GZ8MTXP02H3AIP.21.67.G01.1.454.CMB.2.raw
  modified_base (395)..(395): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgacttatagtatcgagttgggtgcgacaggcccttggacaagggcttggagtggatgggatggggccgtaccttcggacgaacggaaagatagggagtatggtcaggaatttcgagggcagaatacctgaccangactcatccacgggcacacgcctactggaactgaaggaaccgtagaagaagtacggacgacgacggaccactaatattaattggtagacggtcgaaggtgggggtctaagttttaggaagtacttaacctacttatttaatttactttcgttaggtacgttacgttaggggacgaaaacgggccgaacggtctacccggtaccttcccaacggtccccg

SEQ ID NO: 405942 - DNA, 652 bp, Homo sapiens
  misc_feature: GZ8MTXP02IPLZP.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgactatagtatcagttggtgcgacaggcccttggacaggcttgagtggatgggatgggccgaccgttcgacgaaacggaaagagtaggagtatggtacaggtaatttcgagggacaagtaacttaccgttgaacctaacacgactcaacgtcccgacgggcaacgacgacccttacgttaggaaacctggaacggaaccgtagaagaagtacggaacgacgaccggaccaacaattaattagtagtcgcgacgaggtgggggactagtttgtaacgtacgtaacttaacttaatttatttacttcgttacggtacgttcgttacgggggacgtaaaacggggtacccgtaacggtaccgtaacccgtcccgttacccccgacgtacccccg

SEQ ID NO: 405943 - DNA, 594 bp, Homo sapiens
  misc_feature: GZ8MTXP02G8HDP.21.67.G01.1.454.CMB.2.raw
  modified_base (383)..(383): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgacttcgcaacggaagatgggagtatggtcaggaatttcgagggcagaattacttgaccacngactcatccacggggcacagcctactggaactgaggaacctagagaatggacgacacggaccacattacttattagtgcgcgaggtgggggactagtttcgtagacgttacgtaacttatttactttactttcgttacggtaacgttcgtgggggtacgaaaaggggtacccgaacgggtccgacccgtccttacccccgacgtacccccg

SEQ ID NO: 405944 - DNA, 572 bp, Homo sapiens
  misc_feature: GZ8MTXP02IX27Y.21.67.G01.1.454.CMB.2.raw
  modified_base (391)..(391): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttggagtggatgggatggggccgaccttcgacaacggaaagatgggagtatggtcaggaatttcgagggcagtaattaccttgaccacngactcacgtccacggggcacacgacctacgttcggaactggacgaacctagacgaatggacgacacggaccacatattatgtgcgcgaggtggggctagttgtagactacgtactattattacttcttggtacgtcgtgggacaaacgggaccgtacggtcaccgtcctacccacgtaccc

SEQ ID NO: 405945 - DNA, 572 bp, Homo sapiens
  misc_feature: GZ8MTXP02HTY1I.21.67.G01.1.454.CMB.2.raw
  modified_base (382)..(382): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaaggcttgagtggatgggatgggccgacttcgacaacggaaagatggagtatggtcaggatttcgagggcagtaattacttgaccangactcatccgacgggcacacgcctatcggactgaggacctagagaatggacgacacggacacatattagtgtgcgcgaggtggggctagtttgtagactacgtacttatttattacttcgttaggtacgtcgtaggggacgtaaaggggacccgacggttccgaccgttcccgtacccgtacgtaccccg

SEQ ID NO: 405946 - DNA, 607 bp, Homo sapiens
  misc_feature: GZ8MTXP02HWWMP.21.67.G01.1.454.CMB.2.raw
  modified_base (340)..(340): a, c, t, g, unknown or other
  modified_base (384)..(384): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctcgtggttactagtttttccgattatagtatcagttgggtgcgacaggcccttggacaaggcttgagtggatgggatgggccacttcgcaacggaaagntgggagtatggtacaggaattcgagggcagtaatacttgaccangactcactccgacgggcaacacgccctacgtaggaactaggaaggaaccctagaacgaatagggaacgacgacgaccgacactattatagtgacgcgaggtgggggacctagtttagtagtacgtactaactacgtttaattactttcgttaggtacgttcgtacggggacgtaaagggtaccgtacgggtaccaccggtcctacccccgtacggtacccccg

SEQ ID NO: 405947 - DNA, 627 bp, Homo sapiens
  misc_feature: GZ8MTXP02JCVEF.21.67.G01.1.454.CMB.2.raw
  modified_base (475)..(475): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgacttatagtatcgagttgggtgcgacaggcccttggacaagggcttggagtggatgggatggggccgacttcgacgaacggaagagtgggagtagtggtacaggtaattcgagggcaagtaacttaccgttagacctaacgagtactcactccgacgggcacgagcctacgtaggaactgacggaacctgaagaagtaggacgacgacgaccanactattatgtcgacgcgaggtggggactagtttgtagactacgtacttattatttacgttacgttaggtaccgttacggtacggggtaacgtaaaacggggtacccgtacgggttacccgaacccggttcccgtaccccgacgtaacccccg

SEQ ID NO: 405948 - DNA, 599 bp, Homo sapiens
  misc_feature: GZ8MTXP02JNGP9.21.67.G01.1.454.CMB.2.raw
  modified_base (387)..(387): a, c, t, g, unknown or other
  modified_base (484)..(484): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatggggccgacgttcgacgaacggaaagagtggagtagtggtcaggaatttcgagggcagattactgaccangactcactccgacgggtcacgagaccctacgtacggaactgaacggaacccgtagaagaagtagggaacgacgacggaccaacatacttatgtgcgngacgtgggggctagttgtagactactacgttattatttacttcgttacggtacgtcgttacgggacgtaaacgggaccgtacggtaccgtaaccgtcctacccgacggtaccccg

SEQ ID NO: 405949 - DNA, 636 bp, Homo sapiens
  misc_feature: GZ8MTXP02GNTGY.21.67.G01.1.454.CMB.2.raw
  modified_base (279)..(279): a, c, t, g, unknown or other
  modified_base (342)..(342): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttggtncgacaggcccttggacaagggcttgagtggatgggatgggccgtaccttcgacaacggaaagngtagggagtagtggtacaaggtaatttcgaggggtacaggtaacttaccgttagacccagagactcatcccgacggggacacgacgtaccctacgttacggaactaggaacggaaccctaggagaagtggaacgacgaccggacacattagttagttgtcggcgacggaggtcgggggactagtttaggtagtacgttaacttaacgttatttatttacttcgttacggtacgtccgttaggggacaaacggggtaccgaacggtaccgtaccgtacctccccgaacgtccccg

SEQ ID NO: 405950 - DNA, 740 bp, Homo sapiens
  misc_feature: GZ8MTXP02JXIYU.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgacttcggacaacggaaagatgggagttagtggtcaagggtaaatttcgacggggtcaaggtaattaccgttggaaccacacgactacacgtacccgacggggaccaacacgacccttaacgttacggtaaaccgtaggaaacggtaacccgtaggaacgaaagttcggggaaaccgaccgaaccggacccgaactaacttaagttaaagtttggttaggtaccgacgggtaagggttcggggggtaccgtaaggttttacggtaaggtaacgttaaccgtttaaccgtttaattttaaacgttttaccgtttacgtttacggggtaaacgtttccggttacgggggttacgaaaacggggtacccgtaaaccgggtaccggtaacccggtacccgtttaccccccgaggtaccccccg

SEQ ID NO: 405951 - DNA, 559 bp, Homo sapiens
  misc_feature: GZ8MTXP02F18TE.21.67.G01.1.454.CMB.2.raw
  modified_base (278)..(278): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtncgacaggcccttggacaagggcttgagtggatgggatggggccaccttcgcgaacggaaagatgggagtagtggtacaggtaatttcgaggggcagtaattaccttgaccacagactcatccgacgggcacagctacttggaactgaggaacctgagaatgacgacgacggaccacatattatgtgcgcgaggtggggctagttgtagactagtactattattacttctagtcgtacgtgggacgtaaggaccgacggtacaccgtcctacccgagtaccc

SEQ ID NO: 405952 - DNA, 569 bp, Homo sapiens
  misc_feature: GZ8MTXP02JFFCS.21.67.G01.1.454.CMB.2.raw
  modified_base (511)..(511): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttggagtggagtggggatggggccgaccgttcgacgaaacggaaagagtgggagtagtgggtacaggtaatttcgagggcagaattaccttgaccacagactcatccacgggcacagcctacgtgaactgagacctagagaagtggacgacacgacacatatatgtgacgcgaggtggggctagttgtagactactacgtattattacttnttacggtacgtacgtgggacgaacggacacggtcaccgtcctaccccgacgtaccccg

SEQ ID NO: 405953 - DNA, 555 bp, Homo sapiens
  misc_feature: GZ8MTXP02HJE28.21.67.G01.1.454.CMB.2.raw
  modified_base (386)..(386): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgacttatagtatcagttgggtgcgacaggcccttggacaagggcttgagtggatgggatggggccgacttcgacaacggaagatggagtatggtcaggaatttcgagggcagtaattacttgaccangactcatccacgggcacagctactgactgagactgagatgacgacacggacacatattatgtgcgcgaggtggggctagttgtagactacgtaactatttattacttcgttaggtcgttcgtggggacaaaaggggaccacggtcgaccggtccacccgtacgtccccg

SEQ ID NO: 405954 - DNA, 584 bp, Homo sapiens
  misc_feature: GZ8MTXP02GTLCA.21.67.G01.1.454.CMB.2.raw
  modified_base (394)..(394): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgacttcgcgaacggaagagtggagtatggtcaggaatttcgagggcagtaacttaccttagaccacagacctnactccgacggggcacgacgcctacgtggaactgacggaacctagacgaagtaggaacgacgacggaccacatattatgtgcgcgaggtggggcagttgtagactagtactatttattacttcgttacggtacgtcgtaggggtacgaaagggaccgtaacggtcgaccgtccgtaccccgacgtaccccg

SEQ ID NO: 405955 - DNA, 566 bp, Homo sapiens
  misc_feature: GZ8MTXP02HA0EF.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttggagtggatgggatggggccgacttcgacaacggaagatgggagtatggtacaggatttgagggcagattactgaccacagactcactccacgggacacacgcctacgtaggaactgacggaacctgagataggaacgacacggccacatatattgtgcgacgaggtggggctagtttggtagtacgtactacgtattatttacttgttcgtacgtccgtggggtacaaggggactacggcaaccgtcctacccgacgtacccg

SEQ ID NO: 405956 - DNA, 650 bp, Homo sapiens
  misc_feature: GZ8MTXP02HQOG5.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgaggcctcgtggttacagtttttccgactatagtatcagttggtgcgacaggcccttggacaaggctgagtggagtgggagtggggccgtaccgttcgacgaacggaaagatgggagtagtggtacaggaatttcgagggtacaagtaattaccgttgacccaacacgactacactacccgaacggggcaacacgacccttaacgttcggaaactggaacggaaccgtagaagaagtacggaacgacgacggaccaacgattaatttatgtcgacgcgagggtggggtctagtttggtaacgtacgttaacttaacgttatttaagttactttcgttacggtacgttacggtacggggacgaaaacgggtaccgaacggttacccgtacccgttcccgtacccgaccgtacccccg

SEQ ID NO: 405957 - DNA, 662 bp, Homo sapiens
  misc_feature: GZ8MTXP02JQYLB.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagtttttccgacttatagtatcgagttggtgcgacaggcccttggacaaggcttgagtggatgggatgggccgtaccgttgacgaaacggaaagagtagggagtagtggtacaggtaaatttcgaggggtcagtaaacttaccttagaccaacgagacttacacgtcccgaacggggccaacgacgacccttacgtttacggaaacgtcggaaggaaacccgtaggaagaaagtacgggaacgaccgaaccggacaaccattaattaagttcgtagaccgaggaggtgggggactagtttagaacgtactaactaacttatttattacttcgttaggtacgttcggtacggggtacgaaacggggtaacccgaacggtaccgaccgtacctaccccgacgtacccccg

SEQ ID NO: 405958 - DNA, 632 bp, Homo sapiens
  misc_feature: GZ8MTXP02JKCAQ.21.67.G01.1.454.CMB.2.raw
  modified_base (498)..(498): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatcagttggtgcgacaggcccttggacaaggcttgagtggagtgggatgggccgactcgacaacggaagagtgggagtagtggtacaggtaatttcgagggcaagtaattaccgttgaccacgagactcactcccgacgggtcacgacgcctacgtcggaacgtcgaacggaacccgtagacgtaagtacgggaacgacgaccggaccaacgtattaattagttgngtacgcggaaggttggggactagttagtagactaacgttactagttacttacgttcgttacggtacgttacggtggggtacgaaacgggtaccggtaacggtaccgtaccgtacccgtacccgtacgacccccg

SEQ ID NO: 405959 - DNA, 561 bp, Homo sapiens
  misc_feature: GZ8MTXP02FQRLD.21.67.G01.1.454.CMB.2.raw
  modified_base (378)..(378): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatgggatgggccgacttcgcaacggaagatggagtatggtcaggaatttcaggcagaatacttgaccacngactcatccagggcacagcctactggaactgaggaacctgagaatggacgacacggaccacatattattgtgcgcgaggtgggggcagtttgtagactacgtactattattacttcttggtacgttcgtgggggtacaaaaggggtaccgacggtacgaccgtaccgtccccgacgtaccccg

SEQ ID NO: 405960 - DNA, 666 bp, Homo sapiens
  misc_feature: GZ8MTXP02IDU2B.21.67.G01.1.454.CMB.2.raw
  modified_base (408)..(408): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttggtgcgacaggcccttggacaagggcttggagtggatgggatggggccgacttcgacgaacgggaaagagtgggagttatgggtacaagggtaatttcgacggggacaaggtaatttaccgttagacccaancgaactcacttacccgaacgggggcaaccgagcccttaacgtcggaaactggaacggaaaccctaggaacggaagtacggaacgacgacggaccagtactatttattgtgcgacggaggtcgggggtactagtttagtacgtacgtaacttactatttatttactttacgttacggttaccgttcgttacggggtacgtaaaacgggggtacccgtaacggtacccgacccgttacccgtaccccgtacgtacccccg

SEQ ID NO: 405961 - DNA, 758 bp, Homo sapiens
  misc_feature: GZ8MTXP02GUZ1Y.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcagggccttcgtggttactagtttttccgacttatagtatcgaggttgggtgcgacacggcccttggacgaaggcttggagtggatgggatggggccgtaccttcggacaaacggaaagagtagggagtagtggtacgaaggtaagtttcgaaggggcaagtaactttaccttggaacccacgacgactcacgtacccgacggggacaacgacgtacccttaacgttacggaaacttagggaacggtaaacccgtaggaaaggaaacgtacgggaacgaaccgaaccgggacccgaaccgtaaattaacgtttaagtttaggttacggaccggacgggtaacgggttaggggggtaccttaaggttttaggtaaacggtaacgttaaacccgtttaaacgtttaaacgttttaaactttaaccgttttacgttacggggttaccgttaccggtttagggggaaccgtaaaacggggtacccgtaacgggtaccgtaacccggtccctaccccgtacggtacccccg

SEQ ID NO: 405962 - DNA, 713 bp, Homo sapiens
  misc_feature: GZ8MTXP02IR2XZ.21.67.G01.1.454.CMB.2.raw
  modified_base (269)..(269): a, c, t, g, unknown or other
  modified_base (336)..(336): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggcctgtgtactgttcgatatagtatctagtggngcgagcgtccgtggacgaggtctagaggtggagtggagtcgggcccgtacgtcgacgaaacggaagngtaggagtagtggacgaaggtattcggaggactaagtaacttacgttacgaaccaagacgtactacgtaccgtaccggaaccgggacaacgtacgtacccttacgtacggaacgtaggaaaccggaaccgttaggaaacgtaacggtacgggaaccgaccgaaccggaccaactaattaacgtttagttaggtcggacggtacggtaggggtacggggtacttacggtttaggtaacgtacttaacgttaactttactttaacgtttaccgttacgtttacggtaaccggtttcgggtaacggggaaaccggtaaaacggggtaccgtaaccgggttacccgtaacccgtccccgttacccgaccggttaacccccg

SEQ ID NO: 405963 - DNA, 633 bp, Homo sapiens
  misc_feature: GZ8MTXP02F4I0Z.21.67.G01.1.454.CMB.2.raw
  modified_base (383)..(383): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgatatagtatcagttggtgcgacaggcccttggacaagggcttgagtggatgggatggggccgacgttcgcgaacggaagatgggagtagtggtacaggaatttcgaggcagaattacctgaccangactcatcccgacgggcacgagaccctacttaggaaacttaggaacggaaacccgtagagaaagtacgggaacggaccgaacgggacccaaaccaattaagtttattagtgcggaccggaggtgggggctaaggtttagtaagtacttaactaacttatttaatttacgtttacgttacggtacgttacgtggggacgaaaaggggacccgtacggtaccgaacccgtccgtacccccgtaggacccccg

SEQ ID NO: 405964 - DNA, 615 bp, Homo sapiens
  misc_feature: GZ8MTXP02JPD6B.21.67.G01.1.454.CMB.2.raw
  modified_base (394)..(394): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttggagtggatggggatggggccgacgttcgacgaacggaaagagtggagtatggtcgaggtaatttcgagggcagtaattacctgaccacngactcactccgacgggcacagcctactacggaactggaggaacctagagaagtcggacgacacggaccacgtaactagttactgtgcgacgtaggtggggctagtttgtaagtacgtaactacttatttacgttaactttcgttacggtaccgttcggtacgggggtacgaaacggggtaccgtaacggtcgacccgttaccgtaccccgacggtaccccg

SEQ ID NO: 405965 - DNA, 605 bp, Homo sapiens
  misc_feature: GZ8MTXP02ILQ8N.21.67.G01.1.454.CMB.2.raw
  modified_base (387)..(387): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatggggatggggccgaccttcgcaacggaaagatgggagtaatggtcaggaatttcgaggggcaagattacttgaccanagactcatccacgggcacagcctactggaactgagaacctgacgaatggacgacgacggaccacgatattattgtagcgcgaggtgggggactagtttgtagacgttaacgtacttactttattaacctttcgttaggtaccgttacgtacgggggtacgtaaaacggggtccgtaaaccgggttccaacccggttcctacccccgtacgtacccccg

SEQ ID NO: 405966 - DNA, 578 bp, Homo sapiens
  misc_feature: GZ8MTXP02IMINM.21.67.G01.1.454.CMB.2.raw
  modified_base (346)..(346): a, c, t, g, unknown or other
  modified_base (382)..(382): a, c, t, g, unknown or other
  modified_base (397)..(397): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatgggatgggccgacttcgcaacggaaagatggagtanggtcaggaatttcgagggcagaattacttgaccacngactcatccacgggnacgacgcctactggaactgagaaccctgagaataggaacgacgacggacacaagtaattacttgtcgcgcgaggtggggctagtttgtagtactacgtactaattattacttacgttggtacgttacgttaggggtacgaaacgggtaccacgggttccaccggtcctcccgaactccccg

SEQ ID NO: 405967 - DNA, 557 bp, Homo sapiens
  misc_feature: GZ8MTXP02JVF1U.21.67.G01.1.454.CMB.2.raw
  modified_base (279)..(279): a, c, t, g, unknown or other
  modified_base (336)..(336): a, c, t, g, unknown or other
  modified_base (375)..(375): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagttttccgatatagtatcagttgggtncgacaggcccttggacaaggcttgagtggatgggatgggccacttcgcaacggaagntggagtatggtcaggatttgagggcagattactgaccanagactcatccgagggcacagcctattggaactggagacctagacgaatggacgacacggaccacgatatatgtgcgcgagtggggctagttgtagactacgtactagttattacttacttaggtacgtcgtaggggtacgaaagggacccgaacggtcaaccgtccgtacccgacgtccccg

SEQ ID NO: 405968 - DNA, 735 bp, Homo sapiens
  misc_feature: GZ8MTXP02JJNMC.21.67.G01.1.454.CMB.2.raw
  modified_base (242)..(242): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctntggttactagtttttccgactatagtatcagttgggtgcgacaggccttggacaagggcttgagtggatgggatggggccgaccgttcgacgaacggaaagagtgggagtagtggtacaggtaatttcgaggggcaaggtaaattaccgttagacccacgacgacgtacacgtacccgaacggggacaaaccacgggacccttaacgtttacgggaaaccgttaggaacgggtaaacccgttaggaagaaacgttagggaaaccggaaaccgaaccgggacccaaaccgtaattaaacgtttaagttaggttacggtacggaccggaaaggggttcggggggactaggtttacggtaaggtaacgtaactttaaacgttaatttaactttaccgtttagtttacgggtacgttacgtacgggggtaacgtaaaacggggaaccgtaaccgggtacccgtaaccggtaccccgtaccccgtacggtaacccccg

SEQ ID NO: 405969 - DNA, 740 bp, Homo sapiens
  misc_feature: GZ8MTXP02H2L5R.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcgggtgaaggtctccgtgcgagggcctcgtggttactagtttttccgacttatagtatcgtagttgggtgcgacaggtcccttggaccaagggcttggagtggagtggggatggggccgacttcgacgaacggaaaagagtgggagtagtggtacgaggtaagtttcgaggggcaagtaatttaaccttaggaccaacgagacctcaactacccgaacggggaccaacacgaccctaacgtcggaaacgttacggaaacggaacccgtaggaaaggtaacgtacggggaaaccgaccgaaccggacccgaactaaggttaatttaagttggtagggacggtacggtaagggtacgggggtacctaaggttttaggttaaggtaacctttaacggttaaactttaaagttttactttaaaccgtttcgtttacgggtaccgttacggttacgggggtaacgtaaaacggggtaacccgtacgggtacccgtaacccgttcccgtaccccgtaaccgacccccg

SEQ ID NO: 405970 - DNA, 583 bp, Homo sapiens
  misc_feature: GZ8MTXP02IBLCC.21.67.G01.1.454.CMB.2.raw
  modified_base (241)..(241): a, c, t, g, unknown or other
  modified_base (385)..(385): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggcctntggttactagtttttccgatatagtatcagttgggtgcgacaggcccttggacaaggcttgagtggatgggatggggccgaccttcgacaacggaaagagtggagtatggtcaggaatttcaggggcagaattacttgaccacngactcatcccgacggggcacagccctacgtggaactgaacggaactacgaagaagtacggacgacacggaccacgatattattgtgacgtcgaggtggggctagtttgtagactacttactatttattactttacgttgtacgtcgttgggacgaaacggggtacacggtcgaacccgtccgtaccgacgtacccccg

SEQ ID NO: 405971 - DNA, 771 bp, Homo sapiens
  misc_feature: GZ8MTXP02ISIH9.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcaggttgggtgcgacaggcccttggacaagggcttggagtggatgggatgggccaccgttgacgaaacggaagatgggagtagtggtacaggaaatttcgaggggacaaggtaactttaccgttagaaccctaacaggtacctacacgttacccgaacggggaccaacgaacggtacccttaacgtttacgggaaacttacgggaaacggtaaacccgttaggaaacggaaacgttcggggaaaccgtaaccgaaccggggaaccctaaaccggtaaattaacgttttacgttagggttacggtaccggaccgggtaaggggttagggggaacccttaaggttttaggtaacggtaaccttaacggtttaaaccttaagtttaactttaaacttccggtttagggtaaccgttacggttaacgggggtaaccgaaaacggggtacccgtaaccggggttacctaaccccggttacccgttacccccgaaacggttccccccg

SEQ ID NO: 405972 - DNA, 754 bp, Homo sapiens
  misc_feature: GZ8MTXP02GXJW3.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagacgccgtgggcctcggtagaaggtctccgtgcgacggtccttcgtggttactacgttttaccgacttagtagtatcgtaggttcggtagcgacgacggtccgttagggacgtaggtcttaggaggtggaggtgggacgtcggggtacccgtacgtacgaacgaaacgggaagtagtagggtagtaggtaggtaacgtaaggtaacgtttacggaacgggtaactaacgtaaacgtttacgtacgaaccgaacgacgtacctacgtaccgaccgaccggtacgacgtacggtacctaacggtaacggtaacgacggaacgtaacgtagaacggacgaacggaaccgacgaccgtaacgtacgttaacgttagttacgtggtacgggaccgtaggggtaggtccgggttaacttaggttaacggttaaacgtactttaaacgttaacgtttacgtttagttaccgtttaggtacgggttacgtacgggtaacggtaaccggtaaacggtcccgtacgtacccgacccggtccctacggaccctaaccccgg

SEQ ID NO: 405973 - DNA, 691 bp, Homo sapiens
  misc_feature: GZ8MTXP02I8J1W.21.67.G01.1.454.CMB.2.raw
  modified_base (241)..(241): a, c, t, g, unknown or other
  modified_base (282)..(282): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctgggcctcggtgaaggtctcctgcagggcctntggttactagttttccgatatagtatcaggttggtgcgacnggcccttggacgaaggcttggagtggagtgggatcggggcccgtaccgttcgacgaaaacggaagtacgtagggagtagtggtacgaggtaagtttcgagggtcaaggtaacttaccgttagaacccacgagtacctacacgtacccgacgggaccaacgacgtacctacgttacggaacgttaggacggtaaccgtagaacgaacgtcggaacgaccgacgggaccaactaattacgttagtacgtggtacgacggtagggtggggtacttagttagtacgtacttaacgttaacttatttaacgttacgttacggttacggtacgttacgggttacggggaaccggtaaaacgggtacccgtaaccggtacccgtaccggttacccgtaccccggtacgtacccccg

SEQ ID NO: 405974 - DNA, 582 bp, Homo sapiens
  misc_feature: GZ8MTXP02JZ320.21.67.G01.1.454.CMB.2.raw
  modified_base (385)..(385): a, c, t, g, unknown or other
  modified_base (468)..(468): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgactatagtatcagttgggtgcgacaggcccttggacaagggcttggagtggatgggatgggccgacttcgacaacggaaagagtgggagtatggtcaggtattcgaggcagaattactgaccangactcatccgacgggcacagcctacgttaggaactggaacggtaacctgaagaagtggaacgacgacggccacatattattgngcgcgaggtgggggactagttgtagtactaacgtacttatttattacgttcgttaggtacgtcgtaggggacgaaacgggaccgacggtccgaccgtcctacccgacgtccccg

SEQ ID NO: 405975 - DNA, 796 bp, Homo sapiens
  misc_feature: GZ8MTXP02H5FAB.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgattatagtatcagttgggtgcgacaggcccttggacaagggcttggagtggagtgggatggggccgtacttcggacaaacgggaaagagtagggagttagtgggtacgaagggtaaagtttcgaaggggctaaaggtaaactttaacccgtttaggaacccaaccgaggtaaccttacaacgttacccgacgggggaccaacacgacccttaacgtacggtaaacgtaggaaacgggaaccctaggaaacggaaagttaacggggaaccggaccgaaccgggacccaaacgtaagttaagttttaaagttggttacgggacggacgggtaaacggggttggggggtaccttaaggttttaggttaaacgtaaacggttaaaaccgtttaaccgtttaaaatttttaacgttttaaaccgttttacggtttacggggttaaccgttacggttaacggggggtaacgaaaaacgggggtacccgtaaaaccggggttccgtaaaccccggttcccgttacccccggtacgtacccccgg

SEQ ID NO: 405976 - DNA, 566 bp, Homo sapiens
  misc_feature: GZ8MTXP02GUP91.21.67.G01.1.454.CMB.2.raw
  modified_base (386)..(386): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatgggccgacgtcgcaacggaagatggagtagtggtcaggaatttcgagggcagtaattaccttgaccacngactcatccgacgggcacagcctagtgactgagaaccgtgagaatagacgacgacgacacagtattatgtgcgcgagtggggcagttgagtactacgtactagttattacttacgttggtacgttcgtagggtacgaaacgggtaccgacggtaccaccgtcctaccccgacgtaccccg

SEQ ID NO: 405977 - DNA, 642 bp, Homo sapiens
  misc_feature: GZ8MTXP02JBNQP.21.67.G01.1.454.CMB.2.raw
  modified_base (284)..(284): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagttttccgatatagtatcagttggtgcgacnggcccttggacaagggcttgagtggatggggatggggccgtaccttcggacaaacgggaaagagtagggagtagtgggtacaaggtaatttcgagggtacagtaacttaccgttgaaccacagactcgatacccgacgggcacgacgacctacgtggaactaggaacggaaacccgtagacgaagtacgggaacgacgacgggaccaactaagttattagttggtacggcgtacggtagggtgggggactagtttaggtaagtacttaacttactatttagttacgtttagttacggtacgttcgtaggggacgaaacgggtacctacggtacacccgtacctccccgacgtaccccg

SEQ ID NO: 405978 - DNA, 707 bp, Homo sapiens
  misc_feature: GZ8MTXP02F5YAV.21.67.G01.1.454.CMB.2.raw
  modified_base (242)..(242): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctntggttactagttttccgactatagtatcagttggtgcgacaggcccttggacaaggcttgagtggatgggatgggccgaccttcgacgaaacggaaagagtagggagtagtggtacaggtaatttcgagggacagtaattacttgaaccacagactcaactcccgacggggacaacgacgtaccctacgttacggaactaggaacggtaaccctaggaagaaagtaggaacgaacgacggaccaacaattacttaagttgtacggacggaccgtaaggggtacgggggtactaggtttaggtaacgggtacttaaacgttaaccttaaattttaacgtttaaccgtttaccgtttacgggtaaccggtttacggtacgggggtaacgtaaaaacgggggtacccctaaaccggggttaccctaaccccggttacccgtaaccccccgtaacggttaacccccccg

SEQ ID NO: 405979 - DNA, 571 bp, Homo sapiens
  misc_feature: GZ8MTXP02FSMXW.21.67.G01.1.454.CMB.2.raw
  modified_base (384)..(384): a, c, t, g, unknown or other
  modified_base (460)..(460): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaaggcttgagtggatgggatggggccgaccttcgcaacggaaagatgggagtagtggtcaggaatttcgagggcagaatacttgaccacngactcatccacgggcacagcctactggaactgaggaacctgacgaagtggacgacacggaccacatattattgtgngcgaggtggggctagttgtagactacgtacttattattactttacgttcggtacgtcgtaggggacaaacggggacccacggtaccaccggtcctaccccgacgtaccccg

SEQ ID NO: 405980 - DNA, 711 bp, Homo sapiens
  misc_feature: GZ8MTXP02IMFSM.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatcccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaaggcttgagtggatgggatgggcgaccttcgacaacggaagatgggagtatggtcaggaatttcgagggcagattaccttgaccacagactcagtcccacggggtcaacgagtaccctacgtttaggaaaccgtaggaacgggaaacccgttaggaacggaaagttacgggaaccgaaccgaaccgggacccgaacaaagttaacgtttaagttacggttggaccggcggtaacgggttggggggaccttaagtttaggttaacgtaacgttaacgttaaccgtttaagttttaactttacgttttacgtttacgggtaccgggttaccgttagggggtaccgtaaaagggggtaaccccgtaaccgggttaccgtaacccggttacccgttacccccgaaccggttacccccgg

SEQ ID NO: 405981 - DNA, 761 bp, Homo sapiens
  misc_feature: GZ8MTXP02JMHEJ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcagggcctcgtggttactagtttttccgactatagtatcagttggtgcgacaggcccttggacgaaggcttggagtggagtgggagtgggccgaccgttcgacgaacggaagagtgggagtagtggtcaggtaatttcgagggcagtaattaccgttgaaccacagactacacgtacccgacgggacacgacggtacccttacgttacggaaccgtaggaacggtaaacccgtaggaacgtaaacgttacgggaaaccggaaccgaacccggggaacccgtaacctaaaggttaacttttaacgttacgggttacgggtaccggaccgggtaaagggggttcggggggtaccttaaggttttagggtaacgttaaccgttaaaccgtttaaacctttaaagtttttaaacgtttaaccctttacggtttacggggtaccgttacgggtttaacgggggaacgtaaaacggggtacccgtaaccgggttacccgaacccggttccccttaccccgaccgttaacccccg

SEQ ID NO: 405982 - DNA, 748 bp, Homo sapiens
  misc_feature: GZ8MTXP02F6XMS.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttggtgcgacaggccttggacaagggcttgagtggagtgggatggggccgtaccgttcgacgaaacggaaagagtagggagtagtggtacgaaggtaaatttcgaagggtacaagtaacttaccgttagaaccctaacgacgactacacgtacccgacggggtacaaccgacgtaccttaacgttaggaactaggaacggtaacctaggacgtaaagtacggaacgaaccgaccgggaccaaacgtaattaagtttagttacgggttacgggaccggtaccggtaaggggttacggggggtaccttaaggttttaggtaacggtaacttaacggttaaactttattttaaacgttttactttacggtttacgggtaccggtttacggtacgggggtaaaccgtaaaacgggggtaacccgtaaccgggttacccgtaaccccggtttaccgtacccccggtaacggtacccccg

SEQ ID NO: 405983 - DNA, 592 bp, Homo sapiens
  misc_feature: GZ8MTXP02F69YS.21.67.G01.1.454.CMB.2.raw
  modified_base (489)..(489): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttacagtttttccgactatagtatcagttggtgcgacaggcccttggacaagggcttgagtggatgggatgggccgaccgttcgacaacggaaagagtagggagtagtggtcgaggtaatttcagggacagaattaccttgaccactagactcatccgacgggacacacgacctattaggaactagacgaacctagacgaaagtggaacgacacggaccaacataattatgtagcgacgaggngggctagttgagactactaactattagttacttcgttaggacgttacgttggggacgaaagggtacccgacggtacctaaccggtcctacccgacgtaccccg

SEQ ID NO: 405984 - DNA, 670 bp, Homo sapiens
  misc_feature: GZ8MTXP02GC6XP.21.67.G01.1.454.CMB.2.raw
  modified_base (389)..(389): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctccgtgcagggcctcgtggttactagtttttccgactatagtatcgagttgggtgcgacaggcccttggacaggcttgagtggatgggatgggccacgttcgacaaacggaagagtagggagtagtggtcaggtaatttgagggcagtaattactgaccangactcactccacgggacacgacgacctacgttacggaactaggaacgaacccgtaggacgtaagtacgggaacgaccgacggaccaactagttaactttagtagttacggacgcggaagggttcgggggtactaggtttacgtacggtaacttacgttaaacttagtttaaactttacgtttacgttacgggtacgttcgggtacgggggtaaaccgtaaaacggggttcccgaacgggttacccgtaccccgttaccgtacccccgtacggtaacccccg

SEQ ID NO: 405985 - DNA, 721 bp, Homo sapiens
  misc_feature: GZ8MTXP02JOEDV.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagtttttccgacttatagtatcaggttggtgcgacaggcccttggacgaagggcttggagtggagtgggagtggggccgtacgtcgacgaacggaaagagtaggagtagtggtacgtaggtaatttcgacgggctaagtacttaccgttagaccaacgtacgacctcgaacgtcccgacgggactacgacgtacctacgttacggaaacgttggaacggaaacccgtagaacgaaaggtacgggaacgaaccgaccggaccaacgtaattaacgttagttacggtaccggaggtagggtagggggtacctaagtttacggtaacggtacgttaaacttaacgtttaaattttagtttaccgtttaccgttaggtacggttacggtacggggtaaccggtaaaacggggtaaccgtaaccggtaccgtacccggttacccgtaccccgtaccgtacccgtaaccccgg

SEQ ID NO: 405986 - DNA, 745 bp, Homo sapiens
  misc_feature: GZ8MTXP02HVAPY.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccacttcgcaacggaagatggagtatggcaggatttcgagggcaggtaattaccttagaccacagacttacactcccgaacggggccaaccacgacccttaacgttacggaaacttagggaacggtaacccgttaggaaggtaaacgtacgggaaccgacgaccgggaccctaacctaagttaagtttaagttggttacggaccggtaccgggaaggggttcggggggtaccgtaaggtttttacggtaaaggttaacgtttaaacggttttaaccgtttaaatttttaaagttttaaaccgttttacggttttacggggtaaccggtttaccggtttacgggggacgtaaaaacgggggtacccgtaaaccggggtttacccgaaccccggtttacccgtacccccccgtacggtaaccccccg

SEQ ID NO: 405987 - DNA, 554 bp, Homo sapiens
  misc_feature: GZ8MTXP02JQNKG.21.67.G01.1.454.CMB.2.raw
  modified_base (380)..(380): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcgggtgaaggtctcctgcagggcctcgtggttactagtttttccgactatagtatcagttgggtgcgacaggcccttggacaagggcttgagtggatgggatgggccgaccgttgcaacggaagatggagtatggtcaggattcagggcagaatactgaccangactcatccgacgggcacagcctactggaactgacgacctgagaatgacgacacggcacgatactatgtgcgcgaggtggggctagttgtagactacgtactattattacgttcttaggacgtcgtgggacaacgggacctacggtaccaccggtcctaccccgacgtaccccg

SEQ ID NO: 405988 - DNA, 775 bp, Homo sapiens
  misc_feature: GZ8MTXP02GXF4O.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctctggttactagtttttccgactatagtatcgtaggttggtgcgacaggccccttggacgaaggcttgagtggagtgggatggggccgaccttcgacgaaacgggaaagagtgggagtagtggtacgaggtaatttcgaggggacaagtaacttacctacggaacctacgagtactcactaccgacgggcacacgacctacgttacggaactaggaacggaaccgtaggacgaacgtagggaccgacgaaccggaccaacgtaacttagttaacgtttaggtaggtaccggtaccgggtaagggtacggggggtaccttaacgggttttaggtaaacgggtaaccgtttaaaacctttaacggtttaaacttttaaacgttttaaaccttttaccggtttaacggggttaacccggtttaccggggttacgggggtaaacccggtaaaaacgggggttaacccccggttaaccggggttacccgttaaacccccgggtttaccctacccccccggtaacggtaacccccccgg

SEQ ID NO: 405989 - DNA, 696 bp, Homo sapiens
  misc_feature: GZ8MTXP02JIIE4.21.67.G01.1.454.CMB.2.raw
  modified_base (243)..(243): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctntggttactagtttttccgactatagtatcagttgggtgcgacaggcccttggacaaggacttgagtggatgggatgggccaccgttcgcaaacggaaagatgggagtagtggtcaggaatttcgagggtcaagacttaccttgaacctacagaccttcgactcccgaacggggacacacgaccctacttacggaactacggaggaaacccgttagaagaaagtgggaaccgacgaccgggaccaaaccgattaacgttaattcggttcggacgtccgggaaggttcggggggtacctaggtttacggtaacggtaaacgttaacgtaaaccgtttaagtttaactttaaccgtttaccgtttacgggttaccggttacgttacgggggtaacgtaaaacggggaccgtaacggggtacctacccgggttacctacccccgacggtaacccccg

SEQ ID NO: 405990 - DNA, 618 bp, Homo sapiens
  misc_feature: GZ8MTXP02JLD1J.21.67.G01.1.454.CMB.2.raw
  modified_base (242)..(242): a, c, t, g, unknown or other
  modified_base (488)..(488): a, c, t, g, unknown or other
  modified_base (493)..(493): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctcggtgaaggtctcctgcagggcctntggttactagttttccgactatagtatcagttgggtgcgacaggccctggacaaggcttgagtggatgggatgggccgaccgttcgacgaacggaaagagtggagtagtggtacgaggtaagtttcgaggggacaagtaatttaccgttagaaccacagactcactaccgacgggacaacgagaccctactaggaaccgtgaacggaaccgtagagaagtacggacgacgacggacactataactnttagngtacgacgaggtcgggggatagtttgtacgtactacgtacttattattacgttacttacggacgttacgtcgggtacgaaacgggtaccgtacggtacctaccggtcctaccccgacgtaccccg

SEQ ID NO: 405991 - DNA, 543 bp, Homo sapiens
  misc_feature: GZ8MTXP02JMYS2.21.67.G01.1.454.CMB.2.raw
  modified_base (201)..(201): a, c, t, g, unknown or other
  modified_base (315)..(315): a, c, t, g, unknown or other
  modified_base (324)..(324): a, c, t, g, unknown or other
  modified_base (367)..(367): a, c, t, g, unknown or other
  modified_base (435)..(435): a, c, t, g, unknown or other
  modified_base (446)..(446): a, c, t, g, unknown or other
  modified_base (475)..(475): a, c, t, g, unknown or other
tcagtcgtcgctcgcacgaccggtgctcgatttagagtatacatattggggtttggggacccaaaaaccacacccctccttgggagattccctagatcacagcccctcaccatggactggacctggagcatccttttcctggtggcagcagcaacaggtgcccactcccagactcaactggtgcagtctggacctgaggtnaagaagcctggggcctcggtgaaggtctcctgcagggcctctggttacagttttcgatatagtatcagtggtgcgacaggccttggacaaggctgagtgatggatgggcactgnaacggaagntgagtatggtcaggaattcagggcagatacctgacactgactnatccaggcacagcctacttggaactgagaacctgagaatggacgactacggacacatattacttgagngcgagtggggnagtttgacgtactactactattatacttnttcggtacgtcgtgggaccgaaaggggacccacggtaccaccggttaccgtacccaacggtacccccg

SEQ ID NO: 405992 - DNA, 547 bp, Homo sapiens
  misc_feature: GZ8MTXP02HUJYH.21.67.G01.1.454.CMB.2.raw
  modified_base (383)..(383): a, c, t, g, unknown or other
  modified_base (496)..(496): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgacttcgcaacggaaagatggagtatggtcaggaattcgagggcagtaattaccttgaccanagactcatccacgggcacagcctactgaactgaggaactgagaagtgacgacacggcacatattatagtgcgcgaggtggggcagtttgtagactactactatttattacttnttggtacgtcgtagggcaaacggacacggtcaccgtctacccgacgtaccc

SEQ ID NO: 405993 - DNA, 819 bp, Homo sapiens
  misc_feature: GZ8MTXP02ICYX0.21.67.G01.1.454.CMB.2.raw
  modified_base (243)..(243): a, c, t, g, unknown or other
  modified_base (278)..(278): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctntggttacagtttttccgactatagtatcagttggngcgacaggcccttggacaaggcttgagtggatgggatggggccgaccttcgacaaacggaagatgggagtagtggtacagggaaatttcgaaggggacaaagtaaacgtttaccgtttaggaacccaacgacggtaacttacgaacttaccccgaaaccggggcaaaaccacgggaccctttaaacgtagggtaaaacccttggaaacgggtaaaccccgttaggaaacggaaaagttacggggaaaccgaaccgaaaccggggacccaaaacccggtaactttaaacgttttaaaacgttcgggtttaaggccggttaccgggaaacgggtttgggggggaccttaaggttttaccggtaagggtaaaacccgtttaaaacgtttaacccgttaaaagtttttaaacgtttaaaccttttcggtttacggggttaaccggtttaccggtttaagggggtaaccgaaaaacgggggtaaccctaaaccggggtttacccgaaaaccccggttcccgttaccccccgtaaaaggtccccccg

SEQ ID NO: 405994 - DNA, 573 bp, Homo sapiens
  misc_feature: GZ8MTXP02HK4KL.21.67.G01.1.454.CMB.2.raw
  modified_base (382)..(382): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgacttcgcaacggaaagatgggagtatggtcaggatttcagggcagaataccttgaccanagactcatctacgggcacagcctactgaactgaggacctgagaatggacgacacggacacatattatagtgcgtcgaggtggggctagttgagtactactacttattacttactttcgttaggtacgttcgtaggggtaccgaaaggggacccgtacgggtacctaaccggtcctaccccgtacgtccccg

SEQ ID NO: 405995 - DNA, 676 bp, Homo sapiens
  misc_feature: GZ8MTXP02JAKH3.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggagtgggatggggccgacgttcgacgaacggaagagtgggagtagtggtacaggtaaatttcgagggcagtaattaccgttagaccacagactcacgtcccgacgggcacacgacctacgtaggaacgtagaacggaaccgtagagaagtacggacgaccgacggaccaactagttaatttagttagtaggaccgacggtaggggtcgggggtactaaggtttggtaagtaaccgttaacgttaacttaatttaactttacgtttacgtttacgggtaccgttcggtacgggggtaaccgtaaaacggggtaccccgtaccgggtacccgtaacccggttacccgtacccccgtacggttaccccccg

SEQ ID NO: 405996 - DNA, 685 bp, Homo sapiens
  misc_feature: GZ8MTXP02FWK3P.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagttttccgactatagtatcgagttgggtgcgacaggcccttggacaagggcttggagtggatgggatggggccgacgttcgacgaaacggaaagagtggagtagtggtacgaggtaatttcgagggcaagtaattaccttagacctacagactcacgtacccgacgggcaacacgacctacgttacggaactggaacggaacctagaagaagtacgggaacgaacgacggaccaacgtaattacgttaagttgtacggcggacggaggggtacgggggtacttagttaggtaacgtaacttaacgttaacttaagtttactttaaaccgtttcgttacgggtaccgttacggtacgggggtaacgaaaaccggggtaaccctaacgggtacccgtaaccggttacccgtacccccgtacggtaacccccg

SEQ ID NO: 405997 - DNA, 577 bp, Homo sapiens
  misc_feature: GZ8MTXP02IS3KT.21.67.G01.1.454.CMB.2.raw
  modified_base (470)..(470): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcagggcctctggttactagtttttccgatatagtatcagttggtgcgacaggcccttggacaagggcttgagtggatgggatggggccgaccttcgcaacggaaagatgggagtatgggtcaggaatttcgagggcagaattaccttgaccacagactcatccacggggcacagctatgactggagaactagagaatggacgacacggccacatattattgtgcgcggaggtgggggntagtttgtaagactacttaacttatttattactttacgttcggtacgttacgtggggacgtaaaacgggtaccacgggttacaacccgtcttaccccacggtacccc

SEQ ID NO: 405998 - DNA, 560 bp, Homo sapiens
  misc_feature: GZ8MTXP02FX9IY.21.67.G01.1.454.CMB.2.raw
  modified_base (388)..(388): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatggggccgacttcggcaacggaaagatgggagtagtggtcaggaatttcgaggggcagaattacctgaccangactcatccacgggcacagcctacttggaactgagaacctgagaatggacgacacggccgaacaatacttatgtgcgacgaggtggggctagttgagactatacgtattattacttcttggacgtcgtgggacaaagggaccgacggtccgaccgtcctacccgagtacccc

SEQ ID NO: 405999 - DNA, 570 bp, Homo sapiens
  misc_feature: GZ8MTXP02HECIR.21.67.G01.1.454.CMB.2.raw
  modified_base (394)..(394): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgacttatagtatcagttgggtgcgacaggcccttggacaagggcttgagtggatgggatgggccgaccttcgcaacggaaagagtgggagtagtggtacaggtaatttcgaggggtcaagaattacctgaccacngactcatccgacgggcacagcctacgttaggactagaggaacctagagaagtggaacgacgacggaccacatacttatgtgacgcgaggtggggactagttagagtatactacgtattattacttgtacgtacgtcgtgggacgaaggacacggtcaccgtcctcccgacgtaccc

SEQ ID NO: 406000 - DNA, 558 bp, Homo sapiens
  misc_feature: GZ8MTXP02FHIFB.21.67.G01.1.454.CMB.2.raw
  modified_base (384)..(384): a, c, t, g, unknown or other
  modified_base (388)..(388): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttgggacaagggcttgagtggatgggatggggccgaccttcgcaaacggaagatgggagtatggtcaggatttcagggcagaattacctgaccangctnatccacggcacagcctacttggaactgaggacctagagaatggacgacgacggcacatattatgtagcgcgaggtgggggctagttgagactactactattattacttcttacggacgtcgtggggacgaaacggggacacggtcaccggtcctccccgacgtacccccg

SEQ ID NO: 406001 - DNA, 592 bp, Homo sapiens
  misc_feature: GZ8MTXP02JFZMH.21.67.G01.1.454.CMB.2.raw
  modified_base (390)..(390): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttgggtgcgtacaggcccttggacaagggcttgagtggatgggatgggccgaccgttcgacaacggaagagtgggagtagtggtacaggtaatttcgagggcagaattaccttgaccangactcacgtccacgggcacgacgacctactggaactgaaggaacctagagaatggacgacgacggaccaacatattagtgtacgcgcggaggtggggctagttgtagtactacgttacttacgttattacttgttacggtacgtcggtaggggacgaaacgggtaccgtaacggtccaccggtcctaccccgacgtaccccg

SEQ ID NO: 406002 - DNA, 581 bp, Homo sapiens
  misc_feature: GZ8MTXP02GN296.21.67.G01.1.454.CMB.2.raw
  modified_base (448)..(448): a, c, t, g, unknown or other
  modified_base (462)..(462): a, c, t, g, unknown or other
  modified_base (475)..(475): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggagtggggatggggccgaccttcggacgaacggaaagagtggagtagtggtcgaggtaatttcgaggcagtaagttaccttaggaccacagactcatccgacgggcacagcctacgttaggactagaggaacctagagagnggacgacacgacanatattatgtgcgngaggtgggctagtttgtagactaacgtacttaattattacgttcgttaggtacgtacgtgggacgtaacggaccgacggtcaccgtccgtaccccgacgtaccccg

SEQ ID NO: 406003 - DNA, 733 bp, Homo sapiens
  misc_feature: GZ8MTXP02JCGCP.21.67.G01.1.454.CMB.2.raw
  modified_base (356)..(356): a, c, t, g, unknown or other
  modified_base (400)..(400): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctggtgaaggtctccgtgcagggcctgtggttactagtttttccgatatagtatcaggttgggtgcgacacggcccttggacaagggcttgaggtggagtgggatgggccgacttcgacgaacggaaagagtgggagtagnggtcaaggtaatttcgacgggcaaggtaacttacgttgacctancgactcacgtaccgacggggtcacgacgtcctaacgttacggaactaggaacgaaccgttagaagaagtacgggaaccgacgtaccgggacctaaacgtaaggttaatttaagttcggtagggtaccgacgggggtaacggggttcgggggttaccttaagggttttaggtaaaccgttacgttaaaccggtttaaactttaacgttttaaacgtttaacgtttacggtttacgggtacggttaccggggttaagggggtaccgtaaaacgggggtacccgtaacgggttacccgtaacccggttccccgtaacccccgacgttaaccccccg

SEQ ID NO: 406004 - DNA, 768 bp, Homo sapiens
  misc_feature: GZ8MTXP02G29J1.21.67.G01.1.454.CMB.2.raw
  modified_base (242)..(242): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcgagggcctntggttactagtttttccgactatagtatcgaggttgggtgcgacaggccccttggacaagggcttggaggtggagtggggtatggggcccgtaccgttcggacgtaaacgggaaagtagtagggaagttagtggtacgaggtaatttcgaggggactaaggtaaactttacccgttgaacccgtaacgtacggtaccttacgaacgttaccccgaaccgggggaccaaaccggaccgtacccgttaacgttaacgggtaaacctacgggaaacgggaacccgttaaggaacggtaaacgttacggggaaccgaaccgaccgggaccaacctaagttacttagttcggtaggccggaccggagggtcgggggtctagtttaggtaacgtaacgttaacgttaacgttatttaacgttacgtttacgttacgggtaccgttcggttaacgggggaacgtaaaacgggggtaccctaaccgggggttacctaaccccggttcccgttacccccggaacgtaaccccccg

SEQ ID NO: 406005 - DNA, 743 bp, Homo sapiens
  misc_feature: GZ8MTXP02JU5A4.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttggtgcgacaggcccttggacaaggcttgagtggatgggatgggccgtacgttcgacgaacggaagagtgggagtagtggtacgaggtaatttcgagggcaaggtattaccgttagacctacgagtactcaacgtcccgtaacggggcaacgacgtacccttaacgttacggaaacgtcggtaacgggaacccttaggaacgtaaagtaacggaaccgaccgaacccgggaaccaactaacgtttaacgtttaagtttaggttacggaccggtacgggtaagggttcgggggtacgttacggtttaggtaacggtaaacgtaacgttaacttaaacgtttaacgttttaacgtttaccgtttacggggttaccggttaccggttacgggggtaacggtaaaacggggtacccggtaaaccgggttacccgtaccccggttacccgttacccccggtaacgttaccccccgg

SEQ ID NO: 406006 - DNA, 756 bp, Homo sapiens
  misc_feature: GZ8MTXP02JVYAV.21.67.G01.1.454.CMB.2.raw
tcagtcgtcgctcgcacgaccggtgctcgatttagagtatacatattgggtttgggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcagggcctcgtggttactagtttttccgacttatagtatcgtagttgggtgcgacaggcccttggacaaggcttggagtggatggggatggggcccgtaccgttcgacgaaacggaaagagtaggagtagtggtacgaaggtaaatttcgacggggctaagtaacgttacccgttgaacccaagacggaacctacgtactacccgacggggacccaacgacgtacccgttaaacgtttacgggaaacgttacggaacgggtaaacccgttaggaacgaaagtacgggaacgaaccgaccgggaaccaactaagttaagtttaacgttaggtacggtacggaccggtaaggggtcggggggtattaaggttttacggtaagtaaccgtttaaaacttaacgtttaatttaactttaaaccgtttcgttacgggtaccgttacggtaacgggggtaacgtaaaaccgggggtacccgtaaccggtacccgtaacccggtccccgttaccccgacgtaacccccg

SEQ ID NO: 406007 - DNA, 561 bp, Homo sapiens
  misc_feature: GZ8MTXP02IW4GW.21.67.G01.1.454.CMB.2.raw
  modified_base (385)..(385): a, c, t, g, unknown or other
  modified_base (504)..(504): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcagggcctctggttactagtttttccgactatagtatcagttgggtgcgacaggcccttggacaagggcttgagtggatgggatggggccgaccttcgacaacggaaagatggagtatggtcaggaatttcgaggcagaattaccttgaccanagactcatccacggggcacgagcctactgaactgaggaacctgagaatggacgacgacggcacatacttatgtgcgcgaggtggggctagttgtagactacgtactagtttattacttnttacggtacgtcgtgggacgaaagggaccgacggtccaccgtcctcccgacgtcccg

SEQ ID NO: 406008 - DNA, 593 bp, Homo sapiens
  misc_feature: GZ8MTXP02JE8P0.21.67.G01.1.454.CMB.2.raw
  modified_base (385)..(385): a, c, t, g, unknown or other
  modified_base (452)..(452): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgaccttcgacaacggaagatggagtatggtacaggaatttcgagggcagaattacttgaccacngactcatccacgggcacagcctacttggaactgaggaacctgagaagtaggaacgacgacggccaanacgtattattgtgcgcgaggtgggggactagttgtagtactaacgttacttaatttattacgttacgttacggtacgttacgtacggggtacgaaagggtacccgaacggtccgaaccgtccctaccccgacgtacccccg

SEQ ID NO: 406009 - DNA, 587 bp, Homo sapiens
  misc_feature: GZ8MTXP02JZC5T.21.67.G01.1.454.CMB.2.raw
  modified_base (487)..(487): a, c, t, g, unknown or other
  modified_base (489)..(489): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcgtagttgggtgcgacaggcccttggacaagggcttgagtggagtgggatggggccgtaccgttcgacgaaacggaaagagtagggagtagtgggtcaagggtaatttcgaggggcaagtaacttaccttggaaccacgagactcatcccgacgggacacacgcctacgttcgaactgaacggaacctgagaagtgacgacgacgcacatagtatgngngcgaggtgggctagttgagtactatactattattacttcgttacgtacgtcgtaggggacgaacggaccgacggtcaccgtcctacccgacgtccccg

SEQ ID NO: 406010 - DNA, 581 bp, Homo sapiens
  misc_feature: GZ8MTXP02IYSO7.21.67.G01.1.454.CMB.2.raw
  modified_base (383)..(383): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggccttggacaagggcttgagtggatgggatgggccgaccttcgacaacggaaagatggagtatggtcaggaatttcagggcagattaccttgaccacngactcatccacggggcacagccctattggaactggaggaaacctagacgaatcgggacgacgacggaccaaccagtaattagttagtgcgagacggtgggggctagttgtagacttacgtactatttagttactttacgttggtacgtcgtggggtagaaacgggacgacggtacaccgtcctacccgacgtaccccg

SEQ ID NO: 406011 - DNA, 678 bp, Homo sapiens
  misc_feature: GZ8MTXP02JMN2X.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctccgtgcagggcccttgtggttactagtttttccgactatagtatcgaggttggtgcgacaggccccttggacaggcttggagtggatgggatcgggccgcgtcgacgtaacggaagagtggagtagtggactaggtaatttcgagggtacaggaactttaccgttaggaaccacgaggtacctacgaacgttcccgaaggggaccaacgacgtaccccgtagtttacggaaaccgttagaaacgggaaccctaggacgaaagttcggaacgaccgacggacccaacgtacttaatttaagtggtaggacccggtgtagggtagggggtctaggttagtacgtacgtacgttaacttagttacttacgttacggtacggttacgttacggtaacgggtaacgtaaacggtaccgtaccggtaccgtacccgtaccgtaccccgacgtcccg

SEQ ID NO: 406012 - DNA, 732 bp, Homo sapiens
  misc_feature: GZ8MTXP02FSCND.21.67.G01.1.454.CMB.2.raw
  modified_base (353)..(353): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgactatagtatcagttggtgcgacaggcccttggacgaagggtcttaggagtggagtgggatggggccgtaccgttcgacgaaacggaaagngtagggagtagtggtacgaaggtaaatttcgagggtacaagtaaactttaccgttagaaccaacgacgtacctactaacgtacccgaacggggaccaacgtacgtacccttaacgttacggaaactacggaacggtaaacccgtaggaacgtaaagtacgggaaccgaaaccgaccggacctaaacgtaattaacgtttagttaggtacggacggaccggtagggtcgggggtacttaagtttaggtaacgtaacgtaacgttaacttaagtttaacgtttacgttacgttacggtaccggttacggtacgggggtaacgtaaaacggggtacccgtaccggtaccgtacccgttacccgtaccccgtacgtacccccg

SEQ ID NO: 406013 - DNA, 628 bp, Homo sapiens
  misc_feature: GZ8MTXP02GN9AQ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttggtgcgacaggcccttggacaagggcttgagtggatgggatgggccgacttcgacaacggaagagtagggagtagtggtcaggtatttcgagggcagtaacttacttgaccacgagactcactccgacgggcacgacgcctacgttaggaactaggaacggaaccgtagacgaagtacgggaacgacgacggaccaacaattactttagtgtacgcgcggaggtggggctagtttgagtacgtactacttagtttacttacgttcgttacggtaccgttacgtacgggggtaacgtaaaacggggtacccgtacggttaccgacccggttaccgtaccccgaacggtcccccg

SEQ ID NO: 406014 - DNA, 728 bp, Homo sapiens
  misc_feature: GZ8MTXP02IEFV2.21.67.G01.1.454.CMB.2.raw
  modified_base (342)..(342): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggagtgggatgggccgaccttcgacgaacggaaagngtagggagtagtggtacgaggtaatttcgagggactagtaaacttaccgttgacccaacgacgactacaacgttaccccgaacgggggccaaccgaacggtacccttacgttacgggaaacctacggaacgggtaaaccccgttaggaaaccgggtaaaagttacggggaaaccggaacgacccgggacccgaaaccgtaaacgttaaagtttaacgtttaggtcggtcggaccgggaagggttggggggactaggtttacgtaagtaacgttaactaaccttaatttaactttacgtttacgtttacggtacgttcggttacggggtacgaaaacggggtacccgaacggttccacccggttaccctaccccgacggtacccccg

SEQ ID NO: 406015 - DNA, 572 bp, Homo sapiens
  misc_feature: GZ8MTXP02IOBLK.21.67.G01.1.454.CMB.2.raw
  modified_base (241)..(241): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcagggcctntggttactagtttttccgacttatagtatcagttgggtgcgacaggcccttggacaaggcttgagtggatgggatgggccgaccttcgcaacggaagatggagtatggtcaggatttcagggcagattaccttgaccacagactcactccacgggcacagcctactgactgagacctagagaagtggacgacacggccacgtatattatgtgtcgcgagtggggcagtttgtagactacgtaactatttattacttacgttcggtacgttacgtcggggacgtaaaacgggtaccgacggtacctaaccgtcctaccccgacgtacccccg

SEQ ID NO: 406016 - DNA, 664 bp, Homo sapiens
  misc_feature: GZ8MTXP02IOQNC.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatcagttgggtgcgacaggcccttggacaagggcttgagtggatggggatggggccgaccgttcgacgaacggaaagacgtgggagtagtggtacgaggtaaatttcgaggggtacaaggtaaactttaaccgttgaaccctaagacgaccttcgaactacccgaacggggcaaacgacgtaccctacgttaggaacttggaacggtaacccgtagaagaaacgtgggaaccgacgaccgggaccaacgtattaagtttagttacggtggacgacgtagggtgggggtactagtttgtaaggtactaacgttacttaatttagttaactttcgttacggtacgttcgtaggggacaaagggacacggtcaccggtccacccgtacgaccccg

SEQ ID NO: 406017 - DNA, 602 bp, Homo sapiens
  misc_feature: GZ8MTXP02HS823.21.67.G01.1.454.CMB.2.raw
  modified_base (404)..(404): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttggagtggagtggggatcggggcccgtaccgtttcggacgaaacgggaaaagagtagggagtagtggtcaggtaatttcgagggcaagattaccgttgaccangactcatccgacggcacacgcctactggaactgagaacctgagaagtgacgacgacggacacgaatattattgtgcgcgaggtggggctagtttgagactacgtacttatttacttactttcgttacggtacgttcggtacggggtacgaaaacgggaccgtaccggtaccgaccgttcctaccccgtacgtaccccg

SEQ ID NO: 406018 - DNA, 788 bp, Homo sapiens
  misc_feature: GZ8MTXP02FVZ3C.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcagggcctctggttacagtttttccgactatagtatcgagttgggtgcgacaggcccttggacaaggcttgagtggatgggatgggccgacttcgcaacggaagagtgggagtagtggtacgaggtaatttcgaggggcagtaacttaccgttgaaccacagactacgatcccgacgggtacaacgacgacccttaacgttacggtaaacttcgggaaacggtaaacccgttaggaagtaaacggttacggggaaaccgaaccgaaccggggacccctaaaccgtaaaggtttaaacctttaagtttacgggttacgggaccgggtaccgggtaagggggttacggggggacctttaagggttttacggtaaacgggtaacccggtttaaacgtttaaaaccgtttaaattttaacgtttaacccgttttacggtttaccggggtaaccggtttaccgggttaacggggggtaaccgtaaaaacgggggtacccgtaaccggggtttacccgtaaacccccggtttccgttaccccccgacgggttaacccccccg

SEQ ID NO: 406019 - DNA, 757 bp, Homo sapiens
  misc_feature: GZ8MTXP02GQPRI.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctgtggttactagttttccgactatagtatcgagttggtgcgacaggcccttggacgaaggcttgagtggagtgggagtgggccgaccgttcgacgaacggaagagtggagtagtggtcaggtatttcgaggcagtaacttaccgttgaccagacgactacactccgacgggacacgacgtaccgtacgttacggaacgttacggaacggaaacccgtaggaacgtaacgtacgggaaacgaaccgaccggaccgaacgtaaacttagtttacgttacgggtacgaccgggtacggtaacggggtcgggggtacttaaaggttttacgggtaaacgtaaacgtttaaccgtttaaactttaaacgttttaaacgtttttaaaccgttttaccggtttaacggggttacggtttaccgggttaacgggggttaaccggtaaaacgggggtaaccccgtaaccggggttaccccgttaacccggttacccccgttacccccggtaaccgtaaccccccgg

SEQ ID NO: 406020 - DNA, 604 bp, Homo sapiens
  misc_feature: GZ8MTXP02I9NGT.21.67.G01.1.454.CMB.2.raw
  modified_base (242)..(242): a, c, t, g, unknown or other
  modified_base (393)..(393): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctntggttacagtttttccgactatagtatcagttgggtgcgacaggcccttggacaagggcttggagtggatgggatgggccgaccttcgacgaacggaaagagtgggagtagtggtcaggtaatttcgagggcagtaattaccttgacctangactacactccgacggcacacgcctacgttacggaactagaacggaaccgtagacgaagtaggaacgacgacgaccaactatatttactagtcgacgcgaggtggggactagttgtagtactacgttacttatttattactttcgttacggtacgtacgtggggacgaaacgggtaccgtacggtaccaccgtcctacccgacgtaccccg

SEQ ID NO: 406021 - DNA, 609 bp, Homo sapiens
  misc_feature: GZ8MTXP02GZX4K.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttggtgcgacaggcccttggacaaggcttgagtggatgggatgggccgacgttcgcgaacggaagagtggagtatggtacaggaatttcgagggcagtaattaccgttgaaccacagtacctacactccgaacggggcaacacgtccctaacgttacggaaactggaacggaaccctagacgaagtacggaacgacgacggaccacatacttagttagtgacgcgaggtggggctagtttgagacttacgtactattattaacgtttcttacggtacgtcgtacgggggtacgaaaggggacccacggtaccaccgtccgtaccccgacgtacccccg

SEQ ID NO: 406022 - DNA, 744 bp, Homo sapiens
  misc_feature: GZ8MTXP02JWUB6.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagtttttccgacttatagtatcgtaggttggtgcgacgaggtccccttaggaccgaaggtcttggagtggagtgggagtgggacccgtacgttacgacgaaacggaagagtaggtagtagtggtacgaggtaagtttacgagggtactaagtacttaccgtagaccacgacgacgtacacgtccgacgggcaacgacgtaccgtacgtaggaaaccgtggaacggaaccgtaggaacgtaaggtacggaaccgaccgaccgggacctaactaacgtttaatttacggttggtacgggtacccgggtgggtaacgggggtacgggggttaccttaaggttttacggtaacgttaaaccgtttactttaaaacctttaagtttaaacgtttacgtttacgtttacgggtaccggttacgggttacggggtaaacggtaaacgggtacccgtaccggtacctaacccggtcccgttacccgaccgttaccccg

SEQ ID NO: 406023 - DNA, 552 bp, Homo sapiens
  misc_feature: GZ8MTXP02I9UK2.21.67.G01.1.454.CMB.2.raw
  modified_base (380)..(380): a, c, t, g, unknown or other
  modified_base (540)..(540): a, c, t, g, unknown or other
tcagtcgtcgctcgcacgaccggtgctcgatttagagtatacatattgggtttggggacccaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatgggccgacttgcaacggaagatggagtatggtcaggaatttcaggggcagaattacttgaccacngactcatccacggggcacagcctacttggaactgaggaaccctgagaatggacgacacggccacatattattagtgtcgcgagtgggggcaagtttgtagactacgtactattattacttcttcggtacgtctggggcaaagggccacggtcaccgtccncccacggtaccc

SEQ ID NO: 406024 - DNA, 570 bp, Homo sapiens
  misc_feature: GZ8MTXP02JTL0E.21.67.G01.1.454.CMB.2.raw
  modified_base (383)..(383): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgatatagtatcagttgggtgcgacaggcccttggacaagggcttgagtggatgggatggggccgacttcgcaacggaagatggagtatggtcaggaatttcgagggcagaattaccttgaccacngactcatccacgggcacagcctacttggaactgaggaacctgagaagtggacgacgacggaccacatattatgtgcgcgaggtgggggctagtttggtacgacgtactacttattattacttcgttacggtacgttcgtggggacgaaagggtaccgacggtcgaccgtcctaccccgacgtccccg

SEQ ID NO: 406025 - DNA, 581 bp, Homo sapiens
  misc_feature: GZ8MTXP02HXQPT.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggctgagtggatgggatggggccacttcgacaacggaaagatgggagtatggtcaggaatttcgagggcagtaattaccgttgaccacagactcactccgacgggcacacgcctattggaactgaggaacctgagaagtaggacgacacggacacgattacttatgtgcgcgaggtgggggactagtttgtagacttactacgttatttattacttcgttagtacgtacgtaggggacaaacggggtaccgtacggtccaccgtccgtacccgtacgtacccg

SEQ ID NO: 406026 - DNA, 552 bp, Homo sapiens
  misc_feature: GZ8MTXP02FG5UX.21.67.G01.1.454.CMB.2.raw
  modified_base (386)..(386): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttgggacaagggcttgagtggatgggatgggccgaccttcgcaacggaaagatggagtatggtcaggaatttcaggggcagaattaccttgaccacngactcatccacgggcacagcctactggaactgaggaacctgagaatggacgacacggccacatatatgtgcgcgagtgggggcagttgagactactactattattacttcttggacgtctggggtacgaaaggggaccacggtcaaccgtcgtaccccacgtcccc

SEQ ID NO: 406027 - DNA, 769 bp, Homo sapiens
  misc_feature: GZ8MTXP02FVU7N.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgactatagtatcgaggttgggtgcgacaggcccttggacaagggcttgagtggatgggatgggcctaccgttcgacgaacggaaagagtgggagtagtggtacgaggtaaatttcgagggactaagtaaactttaccgttaggaacccaacgaggtaacctacaacgtaccccgaacgggggaccaaacgacggtacccttaacgtttacggaaaccgttaggaacgggtaaacccttaggaaacgtaaagtaacggaacgaaccgaaccgggacccaaactaattaacgtttagttaggtacggaccggtaccggtaaggggtcgggggacttaaggtttggtaaacggtaaccgttaacttaaaccgtttaaagttttaactttaaaccgtttcgtttacggggtaaccgtttaccggtacgggggttaaaccgaaaacgggggtaaccccgtaaccggggttacccgtaacccggttccccgtacccccgtaacggtaccccccg

SEQ ID NO: 406028 - DNA, 576 bp, Homo sapiens
  misc_feature: GZ8MTXP02FFDXG.21.67.G01.1.454.CMB.2.raw
  modified_base (240)..(240): a, c, t, g, unknown or other
  modified_base (311)..(311): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagaatcaactggtgcagtctggacctgaggtgaagagcctgggcctcggtgaaggtctcctgcagggcctntggttactgttttccgactatagtatcaggttggtgcgacaggcccttggacaaggctgagtgagtgggangggccactcgacgaacggaagagtggagtagtggtcaggtattcgagggcagattactgaccacgtgactcagtcccgaggctacgacgtacctacgttaggaacctaggacggtaacccgtagaacgtaagcggacgaccgacggtaccacgtatattagtgtacgcgcggaggtggggtctagttagtacgtactactactattattacctgtaggacgtcgtagggacgaacggcacggtacaccggtcacccgcgaccccg

SEQ ID NO: 406029 - DNA, 847 bp, Homo sapiens
  misc_feature: GZ8MTXP02H88IR.21.67.G01.1.454.CMB.2.raw
tcagtcgtcgctcgcacgaccggtgctcgatttagagtatacatattgggtttgggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgacttatagtatcgagttgggtgcgtacaggcccttggacaaggcttgagtggatgggatgggccaccttcgcgaacggaaagatgggagtagtggtcaggtaatttcgaggggcaggtaaacttaccgttggaaccctaagacgacttacaacgttccccgaaccgggggacaaccgaacgtaccccgttaacgtttacgggaaaaccgttagggaaacgggaaaccccgtttagggaaaggtaaaacgttacggggaaacccgggtaaaccgtaacccggggtaccccaaacccggtaaactttaaaacgtttttaacggtttaggtttacggggaccgggtaccgggtaagggggttaccgggggggtaccttaaacggtttttggggtaaaacggttaaccgtttaaaaccggtttaaccgtttaaaatttttaaaccgttttaaacgtttttaccgttaaggggttaccggttaccgggttttacggggggaaaccggttaaaacggggggtaccccgtaaaccgggggttaccgtaaaaccccggggtttcccctttaccccccggaacggttaacccccccgg

SEQ ID NO: 406030 - DNA, 582 bp, Homo sapiens
  misc_feature: GZ8MTXP02FOJGR.21.67.G01.1.454.CMB.2.raw
  modified_base (385)..(385): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttggtgcgacaggcccttggacaagggcttgagtggatgggatgggccgacttcgcaacggaaagatggagtatggtcagggaatttcgagggtcagaattaccttgacctacngactcatccagggcacagcctattggaactgaggaacctgagaagtaggacacgacgaccgaacatattattgtaggcgcggaggtgggggctagtttgtacgacgtaactacgtatttattactttacttggtaacgttcgtaggggtacaaaggggaaccctacggtcctaaccggtctacccccaggtaccccg

SEQ ID NO: 406031 - DNA, 753 bp, Homo sapiens
  misc_feature: GZ8MTXP02F49OW.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagttttccgactatagtatcaggttgggtgcgacgacggcccttgggacaaggtcttggagtggagtgggagtcggggcccgtaccgttcgacgaaacggaaagtagtagggagtagtggtacgaaggtaactttcggaagggacaagtaaacttaccgttagaaccagacgtacctcgacgtaccgacgggacaaccgacgtaccttacgttacggaacgtaggaaacggaaccgttaggaagtaacggtacgggaaccgaaccgaccggaccctaaactaacgttaatttagttacggtacggaccggtacggtaaggggtgggggtacttaaggtttaggtaacgttaacgttaacgttaaactttaagttttaacgtttaacccgtttaggttacgggtaccgtttacgggtacgggggttaaaccggaaaacggggtacccgtaaacggggttaccctaaccccgggttaccctacccccgtacggttaacccccg

SEQ ID NO: 406032 - DNA, 630 bp, Homo sapiens
  misc_feature: GZ8MTXP02G8WJS.21.67.G01.1.454.CMB.2.raw
  modified_base (241)..(241): a, c, t, g, unknown or other
tcagtcgtcgctcgcacgaccggtgctcgatttagagtatacatattgggtttggggacccaaaaaccacacccctctttgggagattcccctagatcacagcccctcaccatggactggacctggagcatccttttcctggtggcagcagcaacaggtgcccactcccagactcaactggtgcagtctggacctgaggtgaagagcctggggcctggtgaaggtctcctgcgagggcctntggttactagtttttccgactatagtatcagttggtgcgacaggccttggacaagggcttgagtggatgggatgggccgacttcgacgtaacggaaagatggagtagtggtacaggaatttcgagggacagtaacttacttgaccacgagactcataccgacgggacacacgtcctacttacggaactggaacggaaaccctagaaccgaaagtacgggaacgaaccgacggaccgaaccaagttacgttaattgttagacgccggtaaggtgggggtactagtttagtaagtactaacgtaaccttattatttacgttcgttaggtacgtcgttgggacgaaacgggtacgaccggtacgtaccgtccgttaccccgagtaacccccg

SEQ ID NO: 406033 - DNA, 563 bp, Homo sapiens
  misc_feature: GZ8MTXP02JN2Z9.21.67.G01.1.454.CMB.2.raw
  modified_base (389)..(389): a, c, t, g, unknown or other
  modified_base (452)..(452): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctctggttactagtttttccgactatagtatcagttgggtgcgacaggcccttggacaagggcttgagtggatgggatgggccgacttcgcaacggaaagatgggagtatggtacaggaatttcgagggcaggaattaccttgaccacngactcatccagggcacagcctattggaactgaggaaccctgacgaatggacgacgacggccanatacttatgtgcgcgaggtgggggctagttacgtagtacgtactactattattacttgttaggtacgtcgtgggactaaacgggcacggtcgaccgtctccccagtccccg

SEQ ID NO: 406034 - DNA, 738 bp, Homo sapiens
  misc_feature: GZ8MTXP02II9VX.21.67.G01.1.454.CMB.2.raw
  modified_base (240)..(240): a, c, t, g, unknown or other
  modified_base (286)..(286): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctggtgaggtctcctgcagggcctntggttactagtttttccgattatagtatcgtaggttgggtgcgacnggtcccttggacgaaggcttggagtggagtgggatcggggccgaccgttcggacgaacgggaaagagtagggagtagtggtacgaggtaatttcggagggtactaagtaacgtttaccttaggaacccaacgacgtactacaacgtcccgaacggggcaacgacgtacccgttaagttacgggaaactcgggtaaacggaacccgtaggaacgtaaaggtacgggaaccgaaccgaaccgggaccaaacgttaattaacgtttaagttgggtcggtacggacgggtaagggtgggggtacttaaggttttaggtaacgtaacttaacgtttaaacgtttactttaacgtttacgttttacgttacggggtaccgtttacggttacggggaacgaaacggggtacccgtaacgggttcccaacccgttcccgtaccccgtacggtaacccccg

SEQ ID NO: 406035 - DNA, 620 bp, Homo sapiens
  misc_feature: GZ8MTXP02IBGCT.21.67.G01.1.454.CMB.2.raw
  modified_base (389)..(389): a, c, t, g, unknown or other
  modified_base (442)..(442): a, c, t, g, unknown or other
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctctggttacagttttttccgactatagtatctagttggtgcgacaggcccttggacaaggcttgagtggagtgggatgggccgccttcgacgaacggaaagatggagtatggtcgaggtatttcgaggcagtaattacttgaccacngactcactaccacgggacacacgccctagtcggaactgacgaacctgaagaanggaacgacgacggaccactaagtactttaagttgagtcgacggtagggtgggggtactaaggtttgtaagtacttacttaaacttatttaactttacgtttaccgttagggtaccgtcggttaggggacgtaaaacgggacccgaacggttccaccgtccgtacccgacgtacccccg

SEQ ID NO: 406036 - DNA, 741 bp, Homo sapiens
  misc_feature: GZ8MTXP02IK110.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgaggcctctggttactagtttttccgactatagtatcgaggttgggtgcgacaggcccttggacgaagggcttggagtggagtggggagtcggggcccgtacgttcggacgaaacggaaagagtggagtagtgggtacgaaggtaagtttcgacggggtacaaagtaactttaccgttagaaccctaacgacgtacctacgaaccgttaccccggaaccggggaccaaacgtacgtaccccttaacgttacggtaaaccgtacggaaacggtaaacccgtaggaaacgtaaagtacgggaaaccgaccgaacccgggaccaaactaagttaatttagttaggtcgacggtcggtacgggtgggggtactaggtttaggaagtacttaaccgttaacgttacttttaaagtttacgtttacgttacgggtaccgttacggtacggggtaacgtaaacgggtacccgtaaccggtaccgacccgtcccgtaccccgtacgtacccccg

SEQ ID NO: 406037 - DNA, 637 bp, Homo sapiens
  misc_feature: GZ8MTXP02IW808.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatggggccgaccttcgacgaacggaaagagtagggagtagtggtacgaggtaatttcgacgggcaagtaaacgttaccttggaccacgagacttcacgtacccgacggggtcaacgacgtacctacgttacgaacgtgaacggaacctagacgaagtcggaacgacgacggaccacatagttatgtagcgtacgaggtcggggactagttgtaagtacgtactaacttagtttacttacgtttacgttacggtacgttacgtggggtaacgaaacgggtaccgtacggtacccgacccggttcctaccccgacgtacccccg

SEQ ID NO: 406038 - DNA, 552 bp, Homo sapiens
  misc_feature: GZ8MTXP02IRS80.21.67.G01.1.454.CMB.2.raw
  modified_base (250)..(250): a, c, t, g, unknown or other
  modified_base (435)..(435): a, c, t, g, unknown or other
  modified_base (476)..(476): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacngtttttccgactatagtatcagttgggtgcgacaggcccttggacaaggcttgatggatgggatgggccacttcgcaacggaagatggagtatggtacagggaatttcagggcagaattacctggaccacagctacatacccagggcaacgagacctacttggaacctgaaggaacctgaagaanaggacgacgacggaccaacatattatgtgcagagtgggggnattgtagatactactattattactcttggagtcgtgggacgaaaggacgacgtacgtaaccgtctcccacgacccc

SEQ ID NO: 406039 - DNA, 823 bp, Homo sapiens
  misc_feature: GZ8MTXP02GER0U.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagttttccgactatagtatcgagttggtgcgacaggcccttggacaagggcttggagtggagtgggatggggccgtaccgttcgacgaaacgggaaaagacgtagggaagtagtgggtaccaagggtaaacttttcggacggggactaaggtaaactttaccgttacggaaacccaacgacggtaaccttaccgtaaacgttaccccgaaccgggggtaccaaaccgtaacggtacccccgttaaaccggtttacgggaaaaccgttacgggaaacccgggtaaaacccgttaagggaaaccgggtaaaaggttacgggggaaaaccggaaaccgaacccggggacccaaaaccggtaacttaaacgttttaacgtttagggtacgggtacccgggtaaccggtaaggggttcgggggtaccttaaggttttacggtaacgggtaaccttaaccgttaaacgtttacgtttaaactttaccgtttacgttacgggtacgtaccgttagggggtaccgtaaaacgggtacccgtaacggtaccgacccgttacctacccccgacgtaacccccg

SEQ ID NO: 406040 - DNA, 748 bp, Homo sapiens
  misc_feature: GZ8MTXP02F4TMT.21.67.G01.1.454.CMB.2.raw
tcagtcgtcgctcgcacgaccggtgctcgatttagagtatacatattgggtttggggacccaaaaaccacacccctccttgggagattcccctagattacagcccctcaccatggactggacctggagcatccttttcctggtggcagcagcaacaggtgcccactcccagactcaactggtgcagtctggacctgaggtgaagaagcctggggcctcgggtgaaggtctccgtgcgagggcctcgtggttactagttttttccgactatagtatctaggttgggtgcgacgacggtcccttggacgaagggtcttggagtggaagtggggagtgggccgtaccgttcgacgaacggaagagtggagtagtggtacaggtaatttcgagggcaaggtaacttaccgttacgaaccaacgaaggtaccttacaacgtacccgaaccggggccaaacgaccgtacccttaacgttacggaaaccgttaggaaacgtaacccgtaggtaaacggaacgtacgggaaaccgaacgaaccgggtctaaaccgtaaattacgtttaaggttagtacggtacgggtaccggtaggggtgggggtactaagttttaggtaacgaacgtttaacttaacgttacgtttacgtttacgtttacgttcgggtaaccggtttcggtaacgggggaccgtaaaacggggaacccgtacggtacgtaccccggtcctacccccgacgtcccctaaaccccgg

SEQ ID NO: 406041 - DNA, 826 bp, Homo sapiens
  misc_feature: GZ8MTXP02FZSGT.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagttttccgactatagtatcgaggttgggtgcgacaggcccttggacgaagggcttgaggtggagtggggatcggggccgtaccgttcgacgaaacggaaagagtgggagtagtggtacgaggtaagtttcgaggggactaagtaattaccgttagacccaacgagactacaagtcccgaacggggaccaacgtacgtacccttacgttacggtaaacgtacgggaacggaacccgttagaacggtaaacgttacgggaacccgaaaccgaccggggtaaccctaaaccgaaacgttttaaagtttaacgtttcgggtacgggtaccggtaccggggtaaggggttacggggggtaccgtttaacggttttagggttaaaacggttaacctttaaaacggtttaaaacctttaatttttaaacgtttttaaccggttttacggtttacgggggttaaccgggtttaccggttaacggggggtaaaaccgaaaaccgggggttaacccggtaaaaccggggtttcccgtaaccccggtttacccggttaccccccgacggttaaacccccccgg

SEQ ID NO: 406042 - DNA, 558 bp, Homo sapiens
  misc_feature: GZ8MTXP02IZS2Z.21.67.G01.1.454.CMB.2.raw
  modified_base (375)..(375): a, c, t, g, unknown or other
  modified_base (439)..(439): a, c, t, g, unknown or other
tcagtcgtcgctcgcacgaccggtgctcgatttagagtatacatattgggtttggggacccaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagttttccgactatagtatcagttgggtgcgacaggcccttggacaagggcttgagtggatgggatgggcgactcgcaacggaagatggagtatggtcaggaatttcaggcagataccttgaccacngactcaatccagggcacagcctactggaactgagaacctgagaatggacgacacggaccacganacttatgtagcgtcgagtggggcagttgtagactagtactattattacttacttcgtacgtccgttggggactaaaggggaccgtacggtacgtaccggtacctcccgaacgtcccccg

SEQ ID NO: 406043 - DNA, 675 bp, Homo sapiens
  misc_feature: GZ8MTXP02G96DL.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagttttccgactatagtatcgtaggttgggtgcgacgacggtcccgttaggacgaagggtcttggaggtggagtgggagtcggggcccgtaccgttcggacgaaacggaaagagtagggagtagtggtacgaaggtaattcgagggactaagtaaacttaccgtacggtaaccaacgacgtactacgacgtacccgaccggggtaccaaccgacgtacccgttacgtaacggaacgtaggaacggtaaccgtaggaacgaagtacggaacgacgacggaccaactagtacttagtgtggacgcgtagggtcgggtactagtttgagtacttactaacttatttacttacgttagtacggtcgtacggtagggaacgtaacgggtacccgtacggtaccaccgtccctacccgtacgtccccg

SEQ ID NO: 406044 - DNA, 580 bp, Homo sapiens
  misc_feature: GZ8MTXP02G0ZLD.21.67.G01.1.454.CMB.2.raw
  modified_base (250)..(250): a, c, t, g, unknown or other
  modified_base (387)..(387): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacngtttttccgactatagtatcagttgggtgcgacaggcccttggacgaagggcttggagtggatggggatgggccgaccttcgacaacggaaagatgggagtagtggtcaggatttcgaggcagaattacctgaccangactcactccacgggcacacgcctacttcggaactgacggaacctagacgaagtacggacgacacggaccacgatattatgtgcgcgaggtggggcagtttgagactactacgtattattacttcgttaggtacgtacgtgggtaacgaaacgggtacgaccggttacgccgtaccgtccccgacgtaccccg

SEQ ID NO: 406045 - DNA, 595 bp, Homo sapiens
  misc_feature: GZ8MTXP02F92VG.21.67.G01.1.454.CMB.2.raw
  modified_base (387)..(387): a, c, t, g, unknown or other
  modified_base (579)..(579): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggccccttggacaagggcttgagtggagtgggatgggccgaccttcgacaacggaagatggagtatggtcaggaatttcagggacagaattaccttgacctanagactcatccacggggcacagcctactggaactagacggaacctagacgaagtaggacgaacgacggaccgaacaattacttaattgtggacgacgaggtgggggctagtttggtagtactacgtaactatttaattactttacgttaggtacgtacgtggggacaaaacgggacgaacggtcaccgttccnccccgtacgtaccccg

SEQ ID NO: 406046 - DNA, 776 bp, Homo sapiens
  misc_feature: GZ8MTXP02GUERP.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagttttccgactatagtatcgtagttgggtgcgacaggcccttggacaagggcttggagtggagtggggatggggccgaccgttcgacgaaacggaaagagtagggagttagtggtacgaggtaaagttttcgaggggtacaaggtaaactttaccgttagaaccaacgagtactcacgtacccgacggggtacacgacgtcctacgtttacggaaacgtacggaacggtaacccgtagaacggtaacgttacggggaaccgaaacccggaacccgggaacccgaacctaaagttaacgtttaagttcgggtaacgggtccggtaccggggtaggggttacggggggtcctttaaaggttttgggtaaacgttaacgttaaacctttaacgtttaacgttttaaacgtttaaccgttttcgttacgggttaccggtttaccggttacgggggtaaccgtaaaacgggggtacccctaaccggggttcccgtaaaccggttcccctacccccgaacgttacccccg

SEQ ID NO: 406047 - DNA, 780 bp, Homo sapiens
  misc_feature: GZ8MTXP02IPE48.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagctggggcctcggtgaaggtctcctgcagggcctgtgttacttacgttttccgattatagtatcgtaggttgggtgacgacgacggtccgttggacgaggtcttaggtaggtggagtgggagtcggggacccgtaccgttcgacgaaacggaaagtagtagggagtagtggtacgaggtaatttcggacgggactaaggtaactttaccgttcgaaacccacgacgtacctacgacgtacccgaccggggacaaaccgacgtacccgttaacgttcggtaaacgacggtaacggtaacctaggaacgtaagtacgggaaccgacgaccgggacccaaataaacgtttagtttacgttacggttacgggaccggtacggggtagggggtcgggggtactttaaggttttacggtaacgtaacctttaaacgtttaacctttaaattttaacgttttaccgttttacggttacgggttaaccgtttacgggggttacggggtaaaccgggtaaaacgggtacccccgtaacgggttaccctacccggttacccctaccccgtacccgtaacccccg

SEQ ID NO: 406048 - DNA, 857 bp, Homo sapiens
  misc_feature: GZ8MTXP02JH5CE.21.67.G01.1.454.CMB.2.raw
  modified_base (280)..(280): a, c, t, g, unknown or other
  modified_base (285)..(285): a, c, t, g, unknown or other
  modified_base (344)..(344): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctcggtgaaggtctcctgcagggcctcgtggttactagttttccgatatagtatcgtagttggtncgacnggcctggacaggcttggagtggagtgggatcgggccgtacttcggacgaaacggaaagngtagggaagttagtcgggtacgtaagggtaatttcggaacggggtactaaaggtaactttaccgttacgaaaccgtaacgtacggtaaccttcgaaacgtaccccggaaccgggggacctaaaccggtacggtaaccccgtttaacggttaccgggtaaaaccggttacgggaaaccgggtaaacccgtagggtaaacggtaaacggttaacggggaaacccgaacccgggaaacccggggtacccgtaaaccttaaaggtttaaacgtttaacgtttacggtacggggttaccggaaccgggtaagggggttaccgggggtacgtttaaggttttacggtaaccgtaacgttaaaaccggttacctttaagttttaacgtttaaccgttttaccggttacgggttaacccgggttacggttaacgggggaaccgttaaaacgggggaccccgttaaacggggttacccccgacccgtttaccccggttacccccggaccggtaaaccccccg

SEQ ID NO: 406049 - DNA, 682 bp, Homo sapiens
  misc_feature: GZ8MTXP02FXSHP.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttggtgcgacaggcccttggacaaggcttgagtggatgggatgggccgtaccgttcgacaaacggaagagtgggagtagtggtcaggtaatttcgagggacagtaattacttgaccacagactcagtccgacggggacacacgtccctaacgttaggaaactagaacggaaaccctaggaacgtaaagacgggaacgaaccgaccgggaacccaacgaattaagtttagttggttacggaccgtacggaagggtcgggggtacgttaagtttcggtaaacgacgttaaaccgttaacgttaactttaatttaaaccgtttcgttacggtaccgttcggtacgggggtaacgaaaacggggtacccgtaacggtaccgtacccgtacccgttacccccgacgtacccccg

SEQ ID NO: 406050 - DNA, 820 bp, Homo sapiens
  misc_feature: GZ8MTXP02HTW3L.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgacttatagtatcgagttgggtgcgacaggcccttggacaagggcttgagtggatgggatggggccgacgttcgacgaaacgggaaagagtgggagttagtgggtacgaagggtaaatttcgaaggggactaaggtaaactttaccgttaggaaccctaacgacggtaaccttacaacgttaccccgaacgggggaccaaccgaacggtaccccttaacgtttacggggaaaaccttacggggaaacggggtaaaccccgttagggaaaccggtaaaaggttacgggggaaaacccggaaccggaaccggggacccaaaccggtaaatttaacgttttaaggtttacggttacgggacccggtaccggggtaaaggggttcgggggggtaccttaaggtttttacgggttaaacgggtaaacccttaacggtttaacctttaaagttttacgtttaaccgtttacgtttacgggtacgttcggttacgggggtaaccgtaaaacggggtacccgaacgggttacccgtaacccgttcccgtacccccgtacgacccccg

SEQ ID NO: 406051 - DNA, 627 bp, Homo sapiens
  misc_feature: GZ8MTXP02JP77D.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctccgtgcgagggcctctggttactagttttccgacttatagtatcaggttgggtgcgacaggcccttggacaagggcttgagtggatgggatggggccgacgttcgcgaacggaaagatgggagtagtggtacaggtaaatttcgaggcaagtaattacctgaccacagactcactaccgacgggcaacgacgaccctacgtaggaacgtgaacggaacctagtaacgaagtcggaacgacgacggaccaacgtataacttagtcgtagcgacgaggtagggggactagttgtaagtacgtaactacgtaagttactttacgtttcgttaggtacgtcggtagggaacgtaaacgggtaccgaacggtaccgtaccggtcctaccccgtacgtaccccg

SEQ ID NO: 406052 - DNA, 644 bp, Homo sapiens
  misc_feature: GZ8MTXP02IWAZX.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctccgtgcgagggcctcgtggttacttacgtttttccgattatagtatcgtaggttgggtgcgacaggcccttggacgaagggcttggagtggagtgggatggggcctacgtcgacgaaacggaagagtgggagtagtggtactaaggtaagtttcgaggggacaagtaacttaccgttagaacccagacgactacacgtcccgacgggcaacgacgtccctagttaggaactggaacgaacctgaagaagtacggacgacgacggaccaataactagttagttgaggcgacggaggtaggggctagtttaggagtactaacgtacttatttacgttacgtttacgtacggttacgtcggtaggggtaacgaaacggtacgaccggttaccacccgtaccgtacccgacgtaccccg

SEQ ID NO: 406053 - DNA, 704 bp, Homo sapiens
  misc_feature: GZ8MTXP02JKPNG.21.67.G01.1.454.CMB.2.raw
  modified_base (399)..(399): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttgggtgcgacaggccccttggacaagggcttgagtggagtgggatgggccgaccttcgacgaacggaaagagtgggagtagtggtacgaggtatttcgagggcagtaattaccttgaacctacngactacacgtccgacgggcacacgcctacgttacggaactaggacggtaacccgtagaacggtaaacgtacgggaacgacccgaacgggtacccgaacgaattaagttagtttaggtcggaccggtacggacgggttgggggaccttaggtttggtaagtaccgttaacgttaaccgtttagtttaaaccgtttacgtttaccgttacgggttaccgttacggttacgggggaaccgtaaaacgggggtacccgtaaccgggtacccgtaacccggttcccgttacccccgacggtaaccccccg

SEQ ID NO: 406054 - DNA, 827 bp, Homo sapiens
  misc_feature: GZ8MTXP02IFGGN.21.67.G01.1.454.CMB.2.raw
  modified_base (288)..(288): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctccgtgcgagggtcctcgtggttactagtttttccgacttatagtatcgtaggttgggtncgacacggtcccgttggacaaggcttggagttggagtggggatcggggaccgtaccgttcggacgaaacgggaaaaggagttaggggagttagtgggtacgaaggtaagttttccgaaggggacctaaggtaactttaccgttaggaaccccacgaggtaccttacaaaccgttaccccgaaccggggaccaacgtacgggtaccctttaacgttacggaaaacttcgggaaacggttaaacccgtaggaaacggttaaaagtcggggaaacccggaaacccgacccggggttaccccgaaaacgttaaagtttaaactttttacggtttaacggggtacgggtaccggggtacggggtaacgggggttacgggggttacggtttaacggtttaacggttaacgttaaacgttaacgtttaaacgtttaacgttttaacgtttaacgtttacggttacggttacggttacggtacgggtaacggtaaacgggtaaccggtaccggtaccgtacccgtacccgtacccgtaccgtacccg

SEQ ID NO: 406055 - DNA, 583 bp, Homo sapiens
  misc_feature: GZ8MTXP02JOF45.21.67.G01.1.454.CMB.2.raw
  modified_base (387)..(387): a, c, t, g, unknown or other
  modified_base (392)..(392): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggagtggggatggggccgaccgttcgacaacggaaagagtggagtatggtcaggtaattcgaggcagaattacctgaccangactnatccgacgggcacagcctacgttggaactgaggaaccctgagaatacggacgacgacggaccacgatacttatgtgcgacggaggtgggggactagttgtagtacgtactactattattacttacgttcgtacgttcgtagggacgtaaacgggaccgacggtacgtaccgtccgtaccccgacgtacccg

SEQ ID NO: 406056 - DNA, 743 bp, Homo sapiens
  misc_feature: GZ8MTXP02GNG8L.21.67.G01.1.454.CMB.2.raw
  modified_base (403)..(403): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctcgtggttactagtttttccgactatagtatcagttggtgcgacaggcccttggacaaggcttgagtggagtgggagtggggccgaccgttcgacgaaacggaaagagtgggagtagtggtacgaggtaaatttcgagggcagtaattaccgttgaacccanacgactacacgtcccgacgggcacgacgtacctacgttaggaacttcggaggaacccgtagagtaagtacgggaacgacgaacggacccaactaacgttagtttaagttcggttacggaccggtaccgggtaaggggttcggggggtaccttaaggttttacggtaacggtaaacccgtttaaaccggtttaaacctttaaagttttaaacgttttaacccgttttacggtttacgggttaaccggtttaccggttacgggggtaaaccgtaaaacgggggtaacccggtaaccgggttacccgaccccggttaccgtacccccgtaacggtaccccccg

SEQ ID NO: 406057 - DNA, 657 bp, Homo sapiens
  misc_feature: GZ8MTXP02J2HB5.21.67.G01.1.454.CMB.2.raw
  modified_base (280)..(280): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtncgacaggcccttggacaagggcttgagtggatgggagtgggccgacgttcgacgaaacggaaagagtgggatagtggtacgaaggtaatttcgaggggacagtaactttaccgttagaccacgacgactacgatccgacgggcacgacgaccctacgttacggaacgtggaacgtaaccgtgaagaacgtaagaaccgacgacggcccaagtataacgttattaggtacgtacggcggtaggtgggggactagtttaggtaagtacttaacgtacttaacgtttacttaacgtttcttagggtaaccgtcggtacgggggaacgtaaaacgggaccgtaaccggtacgtaccccgtaccgtacccccgacgtccccg

SEQ ID NO: 406058 - DNA, 761 bp, Homo sapiens
  misc_feature: GZ8MTXP02G1NUK.21.67.G01.1.454.CMB.2.raw
  modified_base (358)..(358): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctgtggttactagttttccgactatagtatcgtaggttggtgcgacgacggcccgttggacgaaggcttagagtggagtgggagtcggggcccgtaccgttcgacgaaacggaaagngtagggagtagtggtacgtaaggtaagtttcgagggtactaagtaactttaccgttacgaacccaacgacgtacctacaacgtacccgaacggggacaacgacgtacccttaacgttacggaaactaggaaacggtaacccgtagaacgaagtacgggaacgaaccgaaccggaccaaacgtaattaacgttaagttggtacggacggtacggtaaggggtacgggggtacttaaggtttagtaaacggtaaccttaacgtttaaacctttaagttttaactttaaccgtttacggttacgggtaaccggtttacggtacgggggtaaaccgtaaaaccggggtacccgtaaccgggttacccgtaccccgttaccccgtacccccgtacggttaaccccccg

SEQ ID NO: 406059 - DNA, 846 bp, Homo sapiens
  misc_feature: GZ8MTXP02H80IT.21.67.G01.1.454.CMB.2.raw
  modified_base (353)..(353): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagaagccgtggggcctcggtgaaggtctccgtgcgagggcctcgtggttactagtttttccgattatagtatcgtaggttgggtgcgacgaggtccccttaggacaaggcttgagtggatgggatgggccgacttcgacgaacggaaagntaggagtatggtacgaaggtaatttcgaggggactaaaggtaaactttaccgttaggaacccaagacgacttacaacgttacccgaacggggaccaaacgaacggtacccttaaaccgtttagggaaacccgttaggaaacggaaacccgttaggaaacggtaaagtacggggaaaaccggaccgaaaccgggacccgaaaccgtaaatttaaacgttttaaagttcgggttaggaccggacccggggtaaaggggtcggggggacttaaagggtttttaggaaacgggtaaaaccgttaaaaccgttttaaaaccgttaaaacgtttttaaattttaaaccccgttttacggtttaagggggtaaacccggttttacccgggttaaggggggtaaacccggtaaaaacgggggacccccgtaaaacgggggtttaccccgaaaacccccggttcccccgtttacccccccgaaacgggtttaaccccccccg

SEQ ID NO: 406060 - DNA, 696 bp, Homo sapiens
  misc_feature: GZ8MTXP02F4H1P.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggcctgtggttactagttttccgactatagtatcgaggttggtgcgacaggcccttaggacgaagggcttggaggtggaagtggggagtcggggacccgtaccgttcggacgaaacggaaagagtagggagtagtggtacgaggtaactttcgagggctaagtaacgttaccgttgaacctacgagactcgactcccgacgggacaacgacgtaccttaacgttacggaactaggaacggaacccgtaggaacgtaagtacggaacgaaccgacggaaccactaaagttactttagtggtacggacggacggtagggtacggggtacgttaagtttagtaacggtacttaacgttaacgttaagtttaactttacgttacgttacggtaccgttcggtacggggtaaacgaaacggtaacccgtacggtaccacccggtcctacccgtacgtacccccg

SEQ ID NO: 406061 - DNA, 717 bp, Homo sapiens
  misc_feature: GZ8MTXP02G5EEZ.21.67.G01.1.454.CMB.2.raw
  modified_base (395)..(395): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctggtgaaggtctcctgcgagggcctctggttactagtttttccgacttatagtatcagttgggtgcgacaggcccttggacaaggcttgagtggatgggatggggccgacgttcgactaacggaagagtagggagtagtggtcaggaatttcgaggggacagtaattaccgtgacctacngactcatcccgacgggcacacgacctacgttggaaactggaacggaccgtagaacgaagtagggaaccgacgaaccgggacaaccgtaattaacttagttagtacggacggtaccggtagggtacgggggtctaacggttttagtaacgggtaaccttaaaacgtttacggttaaacttttaacgtttaaaccgttttaccgtttacggggttaaacccggtttcggttaacggggggtaaccgtaaaaccgggggtaaacccgtaacggggttacccgtaaaacccggttccccgtttacccccgaacccggttacccccg

SEQ ID NO: 406062 - DNA, 734 bp, Homo sapiens
  misc_feature: GZ8MTXP02GVPOA.21.67.G01.1.454.CMB.2.raw
  modified_base (346)..(346): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcagggcctctggttactagttttccgactatagtatcgagttggtgcgacaggcccttggacaagggcttggagtggagtgggatggggccgaccttcggacgaaacggaaagngtagggagtagtggtacgaggtaatttcgacggggcaagtaactttaccgttagaaccaacgaggtacctacactcccgaacggggcaacgacgtaccctacgttacggaactacgggaaacggtaacccgttaggaacgtaaacgtacggggaaccgaaccgaccgggaccaaactaacgttaagtttaagttcggttacggaccggaccggtaaggggttcgggggtacgttagtttaggtacggtaacttaaccggttaacttaacggtttactttaaaccgtttcgttacgggtaccgttacggtacgggggtaaccgtaaaagggggtaccccgtaacgggttacccgtaacccggtcccgtacccccgaacggttacccccg

SEQ ID NO: 406063 - DNA, 788 bp, Homo sapiens
  misc_feature: GZ8MTXP02JL7GY.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcgtagttggtgcgacgaggcccttggacgaagggcttggagtggagtggggatggggcccgaccgttcgacgaaacggaaagagtgggagtagtggtacgaggtaatttcgaggggacaagtaacttaccgttaggaaccctaacgacggacctacgaacgtacccgaacggggaccaacgacgtacccttaacgttacggaaacgtacggacggaaacccgtagaacggaagtacgggaaccgaccgaaccgggacccaacgtaacttaagtttaacgttacggtacggtaccggtacggtaacggggtacgggggtcgttaaggtttacggttaacggtaaacgttaacgtttaaaccgtttaagttttaacgttttaaaccgttttaccggtttacgggttaaccggtttaccgggttaacgggggtaaccggtaaaaacgggggtaaccccgtaacccgggttacccggtaaaccccggttccccgttaccccccggtaacggtaaccccccg

SEQ ID NO: 406064 - DNA, 556 bp, Homo sapiens
  misc_feature: GZ8MTXP02JOIU2.21.67.G01.1.454.CMB.2.raw
  modified_base (242)..(242): a, c, t, g, unknown or other
  modified_base (385)..(385): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctntggttacagtttttccgactatagtatcagttgggtgcgacaggcccttggacaagggcttgagtggatgggatggggccacttgcaacggaagagtgggagtatggtcaggtaatttcgagggcagaattaccttgaccacngactcactccgacgggcacacgcctacgttggaactggacgaacctgagatggacgacgacggcacatacttatgtgcgcgaggtggggctagttgtagactactactattattacttcgttacggtactcgtagggacaagggccacggtcaccgtcctacccacgtccc

SEQ ID NO: 406065 - DNA, 629 bp, Homo sapiens
  misc_feature: GZ8MTXP02IKG2A.21.67.G01.1.454.CMB.2.raw
  modified_base (341)..(341): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctggtgaaggtctcctgcagggcctctggttactagtttttccgacttatagtatcagttggtgcgacaggccttggacaagggcttgagtggagtgggagtgggccgacttcgacgaaggaaagngtagggagtagtggtacgaggtaatttcgagggtacagtaaacttaccgttgaaccacgtacgtacctacaacgtaccccgacgggtacacgacgtcctacgtacggaactggaacggaaccgtagacgtaagtggaacgacgacggaccacgtaatattattgcgacgcggaggtcggggtactagttgtaagtactacttaactatttaattactttgtacggtacgttacggtgggtaacgaaacgggtccgtaacggtacacccgtcctacccgacgtaccccg

SEQ ID NO: 406066 - DNA, 779 bp, Homo sapiens
  misc_feature: GZ8MTXP02HRWAX.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatcgaggttggtgcgacaggcccttggacaaggcttgagtggagtgggatggggccgaccgttcgacgaaacggaaagagtagggagtagtggtacaagggtaatttcgaaggggacaaggtaaactttaccgttagaaccaacgagaaccttacgaactcccgaacggggacaaaccgacgtacccttaacgttacggaaaccgttaggaacggtaaacccgttaggaaaggaaaacgttacggggaaaccggaccgaaccgggacccgtaaaccgtaaatttaaagtttaaccgttagggttacggaccggttaccgggaagggttcggggggtaccttaaggttttaggtaaacgtaaaccgttaaaccgtttaaacgtttaaacttttaacgtttaaccgtttacgtttacgggttaaccgttacggttacgggggaacgtaaaacggggtacccgaaccgggttaccaaacccggttccccttaccccgtaacgtacccccg

SEQ ID NO: 406067 - DNA, 589 bp, Homo sapiens
  misc_feature: GZ8MTXP02GTGSQ.21.67.G01.1.454.CMB.2.raw
  modified_base (278)..(278): a, c, t, g, unknown or other
  modified_base (447)..(447): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtncgacaggcccttggacaagggcttgagtggatgggatgggccgaccgttcgcaacggaaagatgggagtagtggtcagggaatttcgagggcagtaacttaccgtgaccagagtactcatccgacggcacgacgcctacgttggaactggaacgaacctagaagtaagnggaacgacacggtaccacagtatttatgtgacgcggaggtggggactagttgtacgtactacgtaacttattatttaacttcgttaggtactcgtaggggacgaaagggaccacggtacaccgtcctaccccacggtacccc

SEQ ID NO: 406068 - DNA, 637 bp, Homo sapiens
  misc_feature: GZ8MTXP02IB2QE.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggctgcagcaacaggtgcccactcccagactcaactggtgcagtctggacctgaggtgaagaagcctggggcctcggtgaaggtctcctgcagggcctctggttacagtttttccgactatagtatcgagttggtgcgacaggcccttggacaagggcttggagtggatgggatggggccgacgttcgacaacggaaagatgggagtagtggtacaggtaatttcgagggacagtaattaccttgaccacagtactacacgtcccacggggacacgacgcctacgtggaactggaacggaaccctagaacgtaatacgggaacgaccgacggaccaacctagttaattattcggtagccggcgtagggtgggggctagtttgtagtacgttaacttacttaactttattactttacgttacggtacgttaccgtggggtacgaaaacgggaccgaacggttaccgaacccggtcctacccccgacgtacccccg

SEQ ID NO: 406069 - DNA, 686 bp, Homo sapiens
  misc_feature: GZ8MTXP02ISA6A.21.67.G01.1.454.CMB.2.raw
  modified_base (413)..(413): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaggtctcctgcagggcctcgtggttactagtttttccgactatagtatcgagttgggtgcgacaggcccttggacgaagggtcttggagtggagtgggatcggggccgtaccgttcgacgaacggtaaagagtgggagttagtggtcgaggtaagtttcgaggggacaggtaacttaccgttcgaacccacngtacttcacgtcccgacggggcaacgcgtaccttactaggaactaggtaacggaacctaggacgaaagtcggaacgacgaccggaccaactaacttaagtttagttggtacggcggtacggtagggtgggggtacttagtttaggaacgtacgttacttaaacttagttttacttacgttttcgttacggtaacgttcggtacggggtaacggtaaaacggggtacccgtaccggttaccgtacccgtacccgttaccccgacgtaacccccg

SEQ ID NO: 406070 - DNA, 602 bp, Homo sapiens
  misc_feature: GZ8MTXP02I9L66.21.67.G01.1.454.CMB.2.raw
  modified_base (140)..(140): a, c, t, g, unknown or other
  modified_base (402)..(402): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttccnggtggcagcagcaacaggtgcccactcccagactcaactggtgcagtctggacctgaggtgaagaagccgtgggcctcggtgaaggtcctccgtgcgagggcctgtggttaactagtttttccgacttatagttatctaggttgggtgcgacaggcccttggaacgaagggcttagaggtggagtgggatggggccaccgttcgacaaacgggaagagtgggaagtagtggtcaaggtattcgaggcagacttactgaccanagactcactccgacgggcaaccagacctacgttaggaacgtgaaggaaccctaggccgaaatgggacgacaacgggccacgagtattattgtagtcggcgagttggggggcagtttgtagactagtactattagttacttcttggacgtactggggtcaaaggggaccaacggggtcaaccggtctcccccgagtccccg

SEQ ID NO: 406071 - DNA, 585 bp, Homo sapiens
  misc_feature: GZ8MTXP02IYUSQ.21.67.G01.1.454.CMB.2.raw
  modified_base (281)..(281): a, c, t, g, unknown or other
  modified_base (391)..(391): a, c, t, g, unknown or other
  modified_base (396)..(396): a, c, t, g, unknown or other
  modified_base (447)..(447): a, c, t, g, unknown or other
  modified_base (455)..(455): a, c, t, g, unknown or other
  modified_base (467)..(467): a, c, t, g, unknown or other
  modified_base (475)..(475): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcagggcctcgtggttactagtttttccgactatagtatcaggttgggngcgacaggcccttggacaagggcttggagtggatgggagtggggccgacgttcggacgaacggaagagtagggagtagtggactaggattcgaggacagtaacttacgtnaccangactcactcgacggcacgagacctatgaactgaacgacgtgagatgacganacgaccanatattagtgtgngacgaggnggggtctagttgagtacgtattaacgtatttattacttaccgttaggtaccgtcgtaggggacgtaaacggtacgtaccggtacgacccgttacctcccgacgtaccccg

SEQ ID NO: 406072 - DNA, 588 bp, Homo sapiens
  misc_feature: GZ8MTXP02FPFQH.21.67.G01.1.454.CMB.2.raw
  modified_base (385)..(385): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgaccttcgcaacggaaagatgggagtatggtcaggaatttcagggcagaattacttgaccacngactcatccgacgggcacgagcctacttggaactggaggaacctagagaatggacgacacggcacatattattgtagcgcgaggtgggggactagtttgtagtacgtactaactattacttactttacgttggtacgttcgtaggggacgtaaaacgggaccgtaacgggtccgtaacccgtccgtaccccgacgtacccccg

SEQ ID NO: 406073 - DNA, 646 bp, Homo sapiens
  misc_feature: GZ8MTXP02HBY3Y.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagttttccgactatagtatcagttggtgcgacaggcccttggacgaaggcttggaggtggagtgggagtcgggccgtaccgttcggacgaaacggaaagagtagggagtagtggtacgaggtaatttcgagggtacaagtaacttacgtacgaaccacgagtactacaacgtcccgaacgggaccaacgacgtaccgttacgttacggaactaggaacggaacgtagaagaacgtacggacgaccgacggaccaactattagttatggtagccggagagggtcggggtctagttgagtactacttaactatttattacgttcgtaggtacgttaccggagggtaacgaaagggtccgtaaccggtacgtaacccggtccctacccgacgtacccg

SEQ ID NO: 406074 - DNA, 650 bp, Homo sapiens
  misc_feature: GZ8MTXP02GSP59.21.67.G01.1.454.CMB.2.raw
  modified_base (356)..(356): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctggggcctcggtgaaggtctcctgcagggcctgtggttactagttttccgactatagtatctaggttgggtgcgacgaggtcccttgggacaagggcttggaggtggagtgggagtcggggccgtaccgttcggacgaaacggaaagngtagggagtagtggtacgaggtaatttcgagggactaaggtaacttaccgttagaacctaacgacgtactacacgtacccgacgggacaccgacgtacctagttacggaacgtggaacgaccgtagaagagtacggacgacgacgacatactattagtgtagcgacgaggtgggactagttagtagtactaacgttacttatttacttacgttacgttacggtacgttaccggtaggggtaccggaaacggtaccgtaccggtaccgaacccgtccctacccgacgtacccccg

SEQ ID NO: 406075 - DNA, 622 bp, Homo sapiens
  misc_feature: GZ8MTXP02HXZDG.21.67.G01.1.454.CMB.2.raw
  modified_base (416)..(416): a, c, t, g, unknown or other
  modified_base (510)..(510): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatctaggttggtgcgacacggtcccttaggacgaagggtcttaggagtggagtgggagtggggcccgacgttcgacgaaacggaaagagtaggagtagtggactaggtaatttcgagggtacaagtaagtttaccgttgaccanagactacaatcccgaggcacgacgacctacgttaggaacgtgaacgaacccgtagagaagtaggacgacgaccggaccactaatatttagtggnacgcgaggtaggggctagttgaagtactatacttatttacttacttacgtaggtacgttcgtagggacgaaacggtactacggtccgaaccgtccctacccgtaacgccccg

SEQ ID NO: 406076 - DNA, 616 bp, Homo sapiens
  misc_feature: GZ8MTXP02II2MX.21.67.G01.1.454.CMB.2.raw
  modified_base (285)..(285): a, c, t, g, unknown or other
  modified_base (341)..(341): a, c, t, g, unknown or other
  modified_base (350)..(350): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgacttatagtatcagttggtgcgacnggcccttggacaagggcttgagtggatgggatgggccgaccttcgacacggaaagntggagttanggtcaggaatttcgagggacagtaattaccttgaccacagactcatcccacgggcacacgcctatggaactgaaggaacctgagaatggacgacacggccaacgactattagttgtagcgacggaggtgggggctagttgtagtacgtacttaacgttattactttactttacgttacgggtaccgttaccggttggggaacgtaaaacggggtaacccgtaaccgggttaccgtaaccggtcccttacccccgacggtacccccg

SEQ ID NO: 406077 - DNA, 744 bp, Homo sapiens
  misc_feature: GZ8MTXP02JVVMV.21.67.G01.1.454.CMB.2.raw
  modified_base (280)..(280): a, c, t, g, unknown or other
  modified_base (304)..(304): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagttttccgactatagtatcaggttgggtncgacaggtcccttggacgaagggnttggagtggagtgggatggggccgaccgttcggacaaacggaaagagtgggtaagttagtggtacgaaggtaatttcgaaggggctaaggtaattaccgtagaaccacaggactacgacgtaccgacgggtcaaccacgtcccgtaacgttacggaaccgtaggaacgtaacccgtaggaacggaaacggttacgggaaccgaacgacccgggacccaacgtaaacgttaagtttagttacggtacggtcggtacgggtaaggggtacggggggtattaacggtttaggtaacgttaaacgttaacctttaaacgttaactttaacgtttaaccggtttacgttacggggtaccgttacgggttaacgggggtaacgaaaaccgggggtacccgtaaccgggtaccgtacccggtacccgttcccccgaacggtcccccg

SEQ ID NO: 406078 - DNA, 711 bp, Homo sapiens
  misc_feature: GZ8MTXP02FPNIS.21.67.G01.1.454.CMB.2.raw
  modified_base (251)..(251): a, c, t, g, unknown or other
  modified_base (393)..(393): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttacngttttccgactatagtatcaggttggtgcgacaggcccttgggacaagggcttggagtggagtgggatgggccgacgttcggacaacggaagatgggagtagtggtcgaggtaatttcgagggcagaacttaccgtgaccangactcatccgacgggacacgacgtcctacgttacggaacgtagaacggaacccgtaggaacgtaaacgtacggaacggtaacgaccggtacccaacgtaacgttaacgttaagtttcggtacggtacggtaccgggtaagggtacgggggtacgttacggtttaggtaacggtaaccgtttaaaccgttaaaccgttaagtttaaacgtttacgtttaccgtttacgggtaacccgttacgtacgggggtaaccgtaaaacggggtacccgtaacggtaccgtaacccggtttccgtacccccgtacggttacccccg

SEQ ID NO: 406079 - DNA, 760 bp, Homo sapiens
  misc_feature: GZ8MTXP02JOQN6.21.67.G01.1.454.CMB.2.raw
  modified_base (286)..(286): a, c, t, g, unknown or other
  modified_base (307)..(307): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgactatagtatcaggttggtgcgacnggcccttggacaagggcttgngtgagtgggatgggccgaccttcgacgaaacggaaagagtagggagtagtgggtacgaggtaaagtttcgaaggggtcaaggtaaactttaccgttaggaaccctaacgacgtacctacacgtacccgacggggacaacgacggtacccttaacgttacggaacttacgggaacggtaaacccgtaggaaacggtaacggtaacgggaaccgaaccgacccgggaacccaaacgttaaacttaagtttagttacggttacgggacgtaccgggtaggggttacgggggtacgttacggtttaaggtaacgttaacgttaacgtttaaacttaacgttttaactttacgtttacgtttacgggttaccggttacgggttacggggtaaccggtaaaacgggtaacccgtaaccgggtaccgtaacccggttcccgacccccgtacgtacccccg

SEQ ID NO: 406080 - DNA, 724 bp, Homo sapiens
  misc_feature: GZ8MTXP02HXG15.21.67.G01.1.454.CMB.2.raw
  modified_base (401)..(401): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctggtgaaggtctcctgcagggcctgtggttactagttttccgattatagtatcgtagttgggtgcgacgaggcccttggacgaaggcttggagtggagtgggatcggggccgtacgttcgacgaacggaagagtggagtagtggtcgaaggtatttcgagggacaagtaacttacgttgaccangactcaacgtcccgacggggcaccgtacgtaccttaacgtacggaacgtacggaacggtaaccgtagaacggtaagtacggaaccgacgaccggacctaactaattaagtttagttaggtacggtaccggtagggtacgggtacggggtacttaggttttacggtaacggtaacgttaacgttaactttaaacgttttaacgtttacgtttacggtttacggtacggttaccgggttacggggtaaaccggtaaaaccgggtacccggtaaccggttaccccggtaacccgtttaccccgtaaccccgttaccgtaacccccg

SEQ ID NO: 406081 - DNA, 794 bp, Homo sapiens
  misc_feature: GZ8MTXP02JAN1Q.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctgggcctcggtgaaggtctccgtgcgagggcctcgtggttactagttttccgacttatagtatcgtaggttgggtcgcgacgacggtcccttgggaaccgaaggggcttaggaggtgggtagtggggaagtcggggcccgtaccgttcggacgtaaaacggaaaggagtacgggtaagtagtgggtacgtaagggtaagtttacggacggggtactaagtaaacgtttaccgttacgaaccgaacagtacctcaaaccgttccgaacggggactaacgaccgtaccttacgttaaacggtaaacgtacggtaacggtaacccgtaggaaacgtaacgtacgggaaaaccgacccgaacccggtacccgaaacctaaagttaacgtttaagttcggtacggtaccggacgggtaggggttagggggtacttaaggtttacggtaaacgtacttaaacgttaacgtttaaactttagtttaccgttgttaacggtacggttacgggttaacggggaaccggaaaacggggtaccctaaccggggttcccgtaacccgttaccccgtacccccggtacgtaacccccg

SEQ ID NO: 406082 - DNA, 567 bp, Homo sapiens
  misc_feature: GZ8MTXP02J24V4.21.67.G01.1.454.CMB.2.raw
  modified_base (339)..(339): a, c, t, g, unknown or other
  modified_base (382)..(382): a, c, t, g, unknown or other
  modified_base (507)..(507): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgacttatagtatcaggttgggtgcgacaggcccttggacaagggcttgagtggatgggatggggcacttgcaacggaagntggagtatggtcaaggatttcgagggcagtaattactgaccangactcatccacgggacacagcctacttaggaactagacggaacctggagaagtggaacgacacggaccacatattatgtgcgcgaggttgggggactagttgtagacgtactactattatacttnttggtacgtcgttagggacgtaaaggggacctacggtcaccgtcctacccgacgtacccc

SEQ ID NO: 406083 - DNA, 798 bp, Homo sapiens
  misc_feature: GZ8MTXP02G1YA8.21.67.G01.1.454.CMB.2.raw
tcagtcgtcgctcgcacgaccggtgctcgatttagagtatacataagttaggggtttcggggaacccaaaaaccaccacccctccgttgggagacttcccctagatcacagcccctcaccatggactggacctggagcatccttttcctggtggcagcagcaacaggtgcccactcccagacgtcaactggtgcagtctggacctgaggtgaagaagccgtggggcctcggtgaaggtctcctgcgacgggcctcgtggttactacgttttccgactatagtatctagttggtgcgacacggcccgttggacgaaggtcttaggaggtggagtggggagtcggggtcccgtaccgtttcggaccgaacgggaaacgtagtagggtaagtacgttagggtaccgtaagggtaacgtttcggaacggggtacgaaaggttaacgtttacccggttaggaacccaacgtacggtacctacaacgttaccccggaacggggcaaaccgtaccgacccgttaacgttacggaaactacgggaaacggtaacccgttaggaacggtaagttacgggaaccgtacgaaccggggacctaaccgtaagtaacgtttacgttacggtacgggaccgtaccgggtagggtacgggggttaccttaggtttcggtaaccgggtaacttaccgttaaccggtttactttaacgtttacctttcggtacggttaccgtacggttacggggtaacgaacgggtacccgtaaccggtccgtaccggtaccctaccccggtaacgtacccccgg

SEQ ID NO: 406084 - DNA, 600 bp, Homo sapiens
  misc_feature: GZ8MTXP02JQJTJ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgacttcggcaacggaaagatggagtatggcaggaatttcgagggcaagtaacttaccttgaaccacgacgactacactccgaccggggcacacgcctactaggaactgacggaacctagagaagtggaacgacgacgacacacgtattatagtagcgcggtaggtcgggggactagttgtagtactacgtactattattacttcgttacggtacgtacgtaggggacgaaacgggaccgtacggtaccgtaccgtcccgtaccccgtacggaaccccg

SEQ ID NO: 406085 - DNA, 753 bp, Homo sapiens
  misc_feature: GZ8MTXP02F8UD5.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggctcggtgaaggtctcctgcagggcctgtggttactagtttttccgactatagtatcgagttggtgcgacaggcccttgggacaaggggcttggagtggatcggggatggggcccaccgttcgacgaaacggaaagagtaggtagtagtgggtacaaggtaaagtttcgaaggggtccaaggtaactttaccttcgaaccactagactcatccgacggacacacgaccttacgtaggaacgtaggaacggaaccgtaggaagtaaacggtcgggaaaccgggaaaccgaaccgggtaacccaaccgtaaattaaactttaagtttccgggttaggacccgggttacgggaaggggttccggggggtacttaaaggtttttccggaaaggttaacttaacctttaaaccggttaaattttaacgtttaccgtttacgttacgggttacgttacccgggttaggggtaaccgtaaaacgggggtacccctaacggggttaccccgtaacccggtttccctacccccgaccgttaacccccgg

SEQ ID NO: 406086 - DNA, 664 bp, Homo sapiens
  misc_feature: GZ8MTXP02HSMNW.21.67.G01.1.454.CMB.2.raw
  modified_base (393)..(393): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgacttatagtatcgagttgggtgcgacaggcccttggacaagggcttgagtgatgggatgggccacgttcgacgaacggaagatggagtagtaggtacaggaatttcgagggcagtaattaccgttgaccangtactacactacccgacgggcaacgtacgacctaacgttacggaaactaggacggtaacccgttaggaacgtaagtacggaacgacgaaccgggaccactaagttatttacgttgtaggaccgacggagggtagggggtactaggttttggtaacgtacgttaactacgttaagtttaactttactttacgttacggtacgttacgtagggggtacgaaaacggggtacctaaccgggttaccaccgtacccgtacccgtaccgtaccccg

SEQ ID NO: 406087 - DNA, 603 bp, Homo sapiens
  misc_feature: GZ8MTXP02GJ0GD.21.67.G01.1.454.CMB.2.raw
  modified_base (386)..(386): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagttttccgactatagtatcagttgggtgcgacaggcccttggacaagggcttgagtggatgggatgggccgacttcgcaacggaaagatggagtagtggtacaggaatttcgagggcagaattaccttgacctanagactcatccgacgggacacgagccctacttggaactagaacggaaccctagaagaagtaggaacgacgacggaccaaccaattacttattagtggacgacggaggtgggggactagttagagtactacgtactatttagttacttcgttacggtacgtacgtaggggacgaaacgggaccgtaacggtccgaaccgtcctaccccgacgtaccccg

SEQ ID NO: 406088 - DNA, 613 bp, Homo sapiens
  misc_feature: GZ8MTXP02IXXQD.21.67.G01.1.454.CMB.2.raw
  modified_base (468)..(468): a, c, t, g, unknown or other
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtaaagaagcctggggcctcggtgaaggtctcctgcgagggcctcgtggttactagttttccgactatagtatcagttgggtgcgacaggcccttggacagggcttgagtggagtgggagtcgggccgtaccgttcgacgaacggaagagtggagtatggtcaaggtatttcgaggaccaagtaattaccgttagaccacgagctcactccgacggacacacgcctagtcggaactgaacggacctagagacgtagacgacgacgacanattattgtgcggcgacggaggtgggggtactaggtttagacgtactaacgtacttatttacttactttcgttacgtacggttcgtacggggacgtaaacggggctaccggtacctaccgtacctccccgaacggtcccctaaccg

SEQ ID NO: 406089 - DNA, 649 bp, Homo sapiens
  misc_feature: GZ8MTXP02IQFXL.21.67.G01.1.454.CMB.2.raw
  modified_base (431)..(431): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgccccactcccagactcaactggtgcagtctggacctgaggtgaagaagccgtggggcctcggtgaaggtctcctgcgagggcctctggttactagtttttccgacttatagtatcgtaggttgggtgtcgacgacggtccccttgggaacgaagggtcttggaggtggagtggggatcggggcccgtaccgtttcggaccgtaaacgggaaagagtacgggagtagtggtacaggtaaagtttcgagggtcagtaacttacctagaccacngactcacgtccacggcacacgtacctacgttaggaactaggacgaaccgtagagagtacggaacgacgacgacactagtatttagtcgtgcgacgtaggtgggcttaaggttgtaacgtacgtattacgtatttacgttacttacgttaggttacgtcggtacggggacgtaaacggccgtacggttaccaccgttaccctacccgtacgtacccccg

SEQ ID NO: 406090 - DNA, 659 bp, Homo sapiens
  misc_feature: GZ8MTXP02IVLUN.21.67.G01.1.454.CMB.2.raw
  modified_base (345)..(345): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatcagttgggtgcgacaggcccttggaccaagggcttgagtggatgggatggggccacttcgacaacggaagngtggagtatggtcaggtattcgagggcaagtaacttacttagaccacagtctcaactcccgacgggcaacgtgaccctacgttaggaactaggaggaaacagtaggaagaagtacggacgtacgaacggacctaactaattaactttagttaggtacgcgtacggtagggtcgggggtactagtttggtaaacgactttaaacgtactttaaagtttactttaaaccgtttcgtttacgggtaaccgttccggttagggggaacgtaaaacggggacccgttacggtacctaacccggttcctaccccgtaccg

SEQ ID NO: 406091 - DNA, 588 bp, Homo sapiens
  misc_feature: GZ8MTXP02HRF5G.21.67.G01.1.454.CMB.2.raw
  modified_base (242)..(242): a, c, t, g, unknown or other
  modified_base (341)..(341): a, c, t, g, unknown or other
  modified_base (385)..(385): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctntggttactagtttttccgactatagtatcagttggtgcgacaggcccttggacaagggcttgagtggatgggatggggccgacttcgacaacggaaagngtaggagtatggcaggatttcgagggcagtaattacttgaccangactcatccgaggcacacgcctactggaactgagaacctgaacgaatggacgacacggaccacatattatgtcgcgcgagggttggggctagttagagtacgtaacttacttaatttacttactttcgttacggtaccgtcgttaggggactaaaaggggtaccgaacgggttacgaccgtacccgtaccctacggacccccg

SEQ ID NO: 406092 - DNA, 681 bp, Homo sapiens
  misc_feature: GZ8MTXP02HPDD4.21.67.G01.1.454.CMB.2.raw
  modified_base (222)..(222): a, c, t, g, unknown or other
  modified_base (565)..(565): a, c, t, g, unknown or other
  modified_base (572)..(572): a, c, t, g, unknown or other
  modified_base (578)..(578): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggngaaggtctcctgcagggcctctggttactagtttttccgatatagtatcgagttggtgcgacaggcccttggacgaaggcttggagtggagtgggatggggccgtaccgttcgacgaaacggaaagagtagggagtagtggtacgaagggtaatttcgaggggactaaaggtaactttaccgttgaaccctaacgtacggaaccttacgaacgttccccgaacggggtaccaaacgaccgtacccgttaaacgttacggaaacttacgggaacggtaaacccgttaggaaacgtaaagtacggaacgaaccgtaccggacaaacgtatatttagtcgtgacgnggtaggnggggtntagtttggatacgtacttacgtatttatactttacgtagtacgtacgttacgggacgtaaacggaccgtacggtaccaaccggttcctacccgacgtaccccg

SEQ ID NO: 406093 - DNA, 699 bp, Homo sapiens
  misc_feature: GZ8MTXP02JD7XU.21.67.G01.1.454.CMB.2.raw
  modified_base (243)..(243): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctntggttactagttttccgactatagtatcagttggtgcgacaggcccttggacaagggcttgagtgagtgggatggggccgacgttcgctaaggaaagagtggagtatggtacaggtaatttcgagggcagaactttaccttaggaccacacgtactcaacgtcccgaacggggtcaaacgacgacccttaacgttacggtaaactacggaaacgggtaaacccgttaggaggtaaacgttacgggaaccgaaacgaccggacccgaaacacttaatttagttgttaggaccgacgggaaggtggggggtacctaggtttggtaagtacgttaacttaccgttaaagtttacgtttaacgtttaccgttagggtaccgttacgtagggggaccgtaaaacggggtaccgaacccgggttaccgtacccgtaccgttacccccgtacggtaacccccg

SEQ ID NO: 406094 - DNA, 528 bp, Homo sapiens
  misc_feature: GZ8MTXP02IPIU4.21.67.G01.1.454.CMB.2.raw
  modified_base (280)..(280): a, c, t, g, unknown or other
  modified_base (327)..(327): a, c, t, g, unknown or other
  modified_base (342)..(342): a, c, t, g, unknown or other
  modified_base (348)..(348): a, c, t, g, unknown or other
  modified_base (383)..(383): a, c, t, g, unknown or other
  modified_base (389)..(389): a, c, t, g, unknown or other
  modified_base (411)..(411): a, c, t, g, unknown or other
  modified_base (425)..(425): a, c, t, g, unknown or other
  modified_base (440)..(440): a, c, t, g, unknown or other
  modified_base (450)..(450): a, c, t, g, unknown or other
  modified_base (452)..(452): a, c, t, g, unknown or other
  modified_base (456)..(456): a, c, t, g, unknown or other
  modified_base (459)..(459): a, c, t, g, unknown or other
  modified_base (527)..(527): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgatatagtatcaagttgggtancgacaggcccttggacaaggcttgagtggatggatgggcgacctganaacggaaagatgganattggnaggtaatttcaggcaagaattacctagaccaacanatacanaccacgggcacagcacttaganagagaacagagaanagagacacgaccaanatatatatgngngagnggngtatagtagatatactattattactagtacgtacgtacgtagacgaagacgacgacacgcctaccacnc

SEQ ID NO: 406095 - DNA, 685 bp, Homo sapiens
  misc_feature: GZ8MTXP02HU11H.21.67.G01.1.454.CMB.2.raw
  modified_base (368)..(368): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactacaactggtgcagtctggactgaggtagaagaagccgtggggcctggtagaaggtctccgtgcgaggcctgtggttactacgtttttcgattatagtatcgtaggttggtgcgacacggtcccttagggacgaagggtctaggaggtggaagtgggagtcggggccgtaccgttcggacgaaacgggaaaagngtagggagtagtggtacgaggtaattcggaggtactaagtaacttacgtagaaccgacgacgtactacgacctaccggaacggacaacgacggtacctaacgttaagaacgtaggaaacgtaaccgtaggaacgagacggaacgacgaaccgtacaaactattagttacgtgtaggcgaggacggtggggaattaggttagtaacgtaacttaacttaacttaatttacgttaactttggtacggtacgttcggtaacggggaacgtaaaacgggaccctacgggtacccaacccggtcctaccccgaacgtccccg

SEQ ID NO: 406096 - DNA, 673 bp, Homo sapiens
  misc_feature: GZ8MTXP02HGFST.21.67.G01.1.454.CMB.2.raw
  modified_base (410)..(410): a, c, t, g, unknown or other
  modified_base (427)..(427): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatcctttttcctggtggcagcagcaacaggtgcccactcccagactcaactggtgcagtctggacctgaggtgaagagccgtggggcctcggtgaaggtctcctgcgaggcctctggttactagtttttccgattatagtatcgagttgggtgcgcaggcccttggacaagggcttgagtggagtgggatcgggccgtaccgttcgacgaacggaaagagtagggtagtagtggtcaaggtatttcgagggcaagtaacttacgttagaaccacagacctnacgtaccgacgggcacncgacctacgtaggactggacgaacgtagacgaagtaggacgtacgacggaccacgtaatacgtttatggtagcggcgagggtacggggtcaggttttaggaacgtaacgtttaacgtacgttaacgtttactttttacgttcgttacgggtaaccggttacggttacggggaaaccggtaaaacggggtacccgtaaccggggttaccctaacccgttacccgtaccccgtacgggttaacccccg

SEQ ID NO: 406097 - DNA, 624 bp, Homo sapiens
  misc_feature: GZ8MTXP02ILYQW.21.67.G01.1.454.CMB.2.raw
  modified_base (501)..(501): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctctggttactagtttttccgactatagtatcagttgggtgcgacaggcccttggacaagggcttgagtggatgggatggggccgtaccttcggacaacggaaaagagtgggagttagtggtacgaggtaaatttcgaggggacagtaaacttaccgttggaaccacagtaactcacgtacccacggggcacgagcctacgtacggactagaggaacctggaacgaagtaggaacgacgacgaccacatattatgtagcgngacggtaggggctagttgtaagtacgtaacttacttatttaacttactttacgtaggtacgttcgtaggggtacgtaaaacggggactaccggtccgaccgtccttccccgaacgtacccccg

SEQ ID NO: 406098 - DNA, 681 bp, Homo sapiens
  misc_feature: GZ8MTXP02GXF6O.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactgtttttccgactatagtatcagttggtgcgacaggcccttggacaagggcttgagtggagtgggatggggccgaccgttcggacgaaacgggaaaagagtgggagtagtgggtacaagggtaatttcgaacggggcaaggtaatttaccgttagaacctaacaggaacctacaacgttcccgaacggggcaaacacgtaccctagtttacggaaactacggaacggtaacccgtaggaacgaagtacgggaacgaccgacggaccaacaattacttagtgtgacgcgaggtgggggactagttgtaacgactaacgttacttaacgtttattacgtttacgttacggtacgttacgtagggggacgtaaacggggtaacccgtacggggttacccacccgggttaccctacccccgtacggtacccccg

SEQ ID NO: 406099 - DNA, 739 bp, Homo sapiens
  misc_feature: GZ8MTXP02JNXVJ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctggtgaaggtctcctgcagggcctcgtggttactagtttttccgacttatagtatcgtaggttgggtgcgacaggtccccttgggactaagggcttggaggtggagtggggatcggggcccgtaccgttcgacgaaacggtaaagagtagggagtagtggtacgaaggtaatttcgagggtacaagtaacgttaaccgttggaacctaacgacgtactacgaacgtcccgaacgggacaacgacgtacccttaacgttacggaacgtagaacggtaaccgtagagtaagtcggaacgacgacggaccaagtactagttacgtgtacggacgtcggtagggtcgggggtactaggtttacggtaaagtaccgttaacgtttaacggttaacttttaacgtttaccgtttacgttacgggggttaaccgttccggggttaacggggtaaccggtaaacgggggtacccggtaaaccggtaccgtaaaccccggttcccttaacccccggacgttaaccccccgg

SEQ ID NO: 406100 - DNA, 859 bp, Homo sapiens
  misc_feature: GZ8MTXP02FS2X5.21.67.G01.1.454.CMB.2.raw
  modified_base (289)..(289): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctgtggttactagtttttccgacttatagtatcgtaggttgggtgcganacggccctggacaaggcttggaggtggagtggggatggggacccgtaccttacggaccgaaacgggaaacgagtgggtaacgttaggttagggtacgaaggtaaatttcgacggggtacctaagtaaacgtttaacccttggaaacccctaacgacgtacctccgtaaacgttaccccggaaccggggacaaacccgacgtacccgttaaacggttacggtaaaccgtacggtaaacggtaaacccgttaggaacggtaaacgtacggggaaaccgaacccggaaccggaaaccccgtaacgtaaactttaaacgtttagtttacgggtttacgggaccggtacgggttaacggggtcggggggtacctttaacggttttagggaaacgtttaaacccgttaacgtttaacctttaaacggttttaaacttttaaaccggtttcgtttaacgggggttaaccccgtttacgggtacgggggttaaccggaaaaccgggggttaccccggtaaccgggttaccccgtaaaaccccggtttcccgtaccccccggtaaacggttccccccgg

SEQ ID NO: 406101 - DNA, 719 bp, Homo sapiens
  misc_feature: GZ8MTXP02F5CU3.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcagggcctgtggttactagttttccgatatagtatcgaggttggtgcgacaggcccttggacgaaggtctgagtggatgggatggggccgaccgttcgacaaacggaagagtggagtagtaggtcgaggtaatttcgaggtcaagtaatttaccttagaacccacaggactacaacgtcccgaacggggcaacgacgtacctacgttacggaacgtaggaacggaaccgtagaacgtaagtacgggaacgaacgaccggaccctaacgtaacttaagtttagttcgttacgggaccggtaccgggtaaaggggttcgggggtaccgttaaggttttaggtaaacgtaacgttaaacgttaaaccgtttaatttaacgtttaaccgtttacgttaacgggtacgttacggtacgggggtaacgtaaaacggggacccgtaaacggtaccggtaacccggttacccgtacccccgtacgtaacccccg

SEQ ID NO: 406102 - DNA, 834 bp, Homo sapiens
  misc_feature: GZ8MTXP02JZM1L.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgacttatagtatcaggttgggtgcgacaggcccgttggacaagggcttggagtggatgggatgggccgtaccttcgacgaaacggaagagtagggagttagtgggtactaaggtaagtttcgaggggtaccaagtaaacgtttacccgttggaaccccgtaactacgggtaacctactaacgtacccgaaccgggggaccaaccgtacggacccgttaacgttacgggaaaccgttacgggaacgggtaaacccgtaggaaggtaaagtacggggaaaccggaccggtaacccgggacccgtaaacgtaaacgttaaagtttacggtttacggacgggtaccggacggggtaacgggggttcggggggtaccctttaaaggtttacggggttaaacgtaaaccgtttaaccgttaaccctttaaaagttttaacgtttaacccggttttacgtttaacggggtaaccggttaccgggttaacgggggtaaccgtaaaaccgggggtaccccgtaaaccgggggtacccgtaacccccggttaccccgttacccccgaccggttaaccccccgg

SEQ ID NO: 406103 - DNA, 657 bp, Homo sapiens
  misc_feature: GZ8MTXP02H1I35.21.67.G01.1.454.CMB.2.raw
  modified_base (403)..(403): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagtttttccgattatagtatcgagttgggtgcgacaggcccttggacaagggcttggagtggagtgggatggggccgaccgttcgacgaacggaaagagtggagtagtggtcaggaatttcgaggggcagtaacttaccgttgaccacngactcactccgacggcacagcctactggaactgaaaagacctagaagaatacggacgacgacggccaacgaattagtttaattcggtagcgacggagggtgggggactagtttggtaagtaacttaacgttaacttaaagttttactttaaacgtttcgttacggtacgttacggtagggggtaaccgtaaaacggggtacccgtaaaccgggttaccgaaccccggttccgttacccccgaaacggtcccccg

SEQ ID NO: 406104 - DNA, 710 bp, Homo sapiens
  misc_feature: GZ8MTXP02H6MC9.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagtttttccgattatagtatcgtagttgggtgcgacgaggcccttggacaagggcttggaggtggagtggggatggggaccgacgttcggagaaacgggaaaaggagtagggagttagtagggtcaagggtaaattttcggaagggtacaaagtaactttaaccgttgaacctaacaggtaacctactactacccgaacgggggacctaaacgacgtaccctagttacggaacgtggaacggaaacccgtagacgtaaagacggtaacgacaccgggacaacgtaatagtttaagttgtacggtacgacggtaagggtgggggtactaagttttacggaagtacgttaacgtacttagtttaatttactttacgttaggtaccgtacgttagggggaccgtaaaacgggtaccggaaccggttaccgaacccgtccgtacccgaacgtaacccccg

SEQ ID NO: 406105 - DNA, 662 bp, Homo sapiens
  misc_feature: GZ8MTXP02JKJGZ.21.67.G01.1.454.CMB.2.raw
  modified_base (404)..(404): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgacttatagtatcagttgggtgcgacaggcccttggacagggcttggagtggagtgggatggggccgaccgttcgcgaacggaagagtgggagtagtggtacaggtaatttcgaaggggccaagtaaacttaccgttagaaccacngacctcacgtcccgaacgggcacgacgcccgtaacgttcggaaacgtgaaggtaaccctaggaagaacgtcggaacacgacgacccaactattaacttagttagtcgtcgacgggtaggtgggggtactagtttacgtagtacgttacttaccttaagtttactttacgttcgtttacggtaccgttacgttacggggacgtaaaaggggtaccctacgggttaccctaaccggtccctacccccgtacgtacccccg

SEQ ID NO: 406106 - DNA, 617 bp, Homo sapiens
  misc_feature: GZ8MTXP02G7U5F.21.67.G01.1.454.CMB.2.raw
  modified_base (284)..(284): a, c, t, g, unknown or other
  modified_base (396)..(396): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctgggcctcggtgaaggtctcctgcgagggcctctggttactagtttttccgactatagtatcagttggtgcgacnggcccttggacaagggcttgagtggatggggatggggccgaccgttcgcaaacggaagagtgggagtagtggtcgaaggaatttcgagggcaagtaattaccgtcgaccacngaccttcactccgacgggacacagacctagttggaactgacggaacctagacgaagtggaacgacgacggaccacagtattattgtggtcgcggaaggtcgggggactagtttgtaagtacttaacgttaacttactttatttactttacgttacggtacgttcgtaggggaccgaaagggtaccgtacggtcgtacccgtcgtacccccgtagtaccccg

SEQ ID NO: 406107 - DNA, 863 bp, Homo sapiens
  misc_feature: GZ8MTXP02H3I5F.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagagccgtgggcctggtgaaggtctccgtgcgaggtcctgtggttactcgttttccgattatagtatcgtaggttggtgacgacgacggtcccgttagggacgtaaggtctaggagtggagtgggacgtcggggaccgtaccgttacggaacgaacggaaagtagtagggtagttagtaggtaacgtaggtaacgtttcggacgggtacgtaacgttaaacttacccggttacgaaccgtaacgtacggtaaccttaccgtaacccgtacccggaaccggggtaccaaccgtaaccgtacccgttaacggttaacggaaccgtacggtaaaccggtaaaccgtaagggtaaacgtaaacggtaaccggggaaaccgacccggaaccggtaaccctaacgttaaaccgtttaagtttacgttacgggtacgggtaccccgggtaggggttaacgggggttaccgggggtttaagttaacggttttaacggtaaccggttaaacctttaaacgtttaaactttaacgtttttaaacgtttaccgtttaccgggttagggttaacccggttacggggttaacggggaacccggttaaaacgggtacccggtaaccgggtaccccttacccgtacccccgtacccggtaacccgtaacccccgg

SEQ ID NO: 406108 - DNA, 826 bp, Homo sapiens
  misc_feature: GZ8MTXP02GRLV5.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggcctgtggttactagttttccgactatagtatcgtaggttggtgcgacgacggcccgttggacgaagggcttggaggtggagtggggagtcggggaccgtaccgttcggacgaaacgggaaagagtagggagtagtgggtacgaaggtaatttcggagggtacgaagttaacttaccgttacgacccgtacgtacggtacctacgtaacgtacccgaacggggtaccaacgtaccggtacccgttaacgttacggtaaacgtacggaaacggtaacccgtaggaaacgtaaagtaacggaaccgaaccgaaccggaaccctaaccgtaaacgttagtttaacgttacggttacgggaccgggtaaccgggtaagggggttacgggggtaccgtttaaggttttacggtaaacggttaacctttaaccggtttaaactttaacgttttaacgttttacccgttttacggttaccggggttaaccggttaccgggttacgggggtaaaccggtaaaacgggggtaccccgttaaccgggtaccccgtaccccggtaccccgttacccccggtaaaccgtttaccccccgg

SEQ ID NO: 406109 - DNA, 561 bp, Homo sapiens
  misc_feature: GZ8MTXP02FKLNC.21.67.G01.1.454.CMB.2.raw
  modified_base (380)..(380): a, c, t, g, unknown or other
  modified_base (465)..(465): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagctggggcctcggtgaaggtctcctgcagggcctctggttacagtttttccgactatagtatcagttgggtgcgacaggcccttggacaagggcttgagtggatgggatggggccacttgacgaacggaagatgggatagtggtcaggaatttcgagggcagattactgaccangactcatccgagggcacgagcctagttaggaactgaacggaacctagaagaagtacggacgacgacggaccacattatatgtcgngcgaggtggggctagtttgaagtctactaactattattacttcgtacggtacgtcgtagggacaaacgggcacggtcaccgtccaccctgaccccg

SEQ ID NO: 406110 - DNA, 784 bp, Homo sapiens
  misc_feature: GZ8MTXP02GAA8E.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggcctggtgaaggtctcctgcgagggcctcgtggttactagtttttccgactatagtatcgtaggttggtgcgacacggtccccttggacgagggtcttaggagtggagtggggagtggggacccgtaccgttacggacgaaacgggaaagagtagggtaagttaggtgggtacgtaagggttaaacgtttcggaacggggtacctaagttaaacgtttaccccgtttacgaaaccccgtaacgtaccgggtaacctacgaaccgttaccccggaaccgggggtaccgaaaccgtacgtacccgttaacgtttacggaaaccgttagggaaacggtaaacccgtaggaacgtaaacgtacgggaccgaccgaccggaccgaacgttaattaacgtttagttaggtagggaccggacgggtaggggtcgggggtacttaggtttagtaacgtacttaaacgttacgtttaatttaactttacgttttacgttacgggttaaccggttcggtgggggaaacgtaaacggggtaccctacgggtacctacccgttaccgtaccccgtacgtaccccg

SEQ ID NO: 406111 - DNA, 683 bp, Homo sapiens
  misc_feature: GZ8MTXP02HK9GG.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttggtgcgacaggcccttggacaagggcttgagtggatgggatgggccgtaccttcgacgaaacggaaagatgggagtagtggtactaggtaatttcgagggctaagaatttacgttagacccacaggacctcatacccgacggggcaacgacgtaccctacgttacggaaacgttacggaacggaacccgttaggaagaaagtacgggaaccgaacgacccgggtaccaaccgtaattaagtttagttaggttcgggacggccggtaggggtcgggggactagtttaggtaagtaccttacgttaacttatttactttaacttcgttacgggtaccgttcgtacgggggaacgtaaaacgggtaccgaaccggggttacaacccgttccgtacccccgtaagtcccccg

SEQ ID NO: 406112 - DNA, 733 bp, Homo sapiens
  misc_feature: GZ8MTXP02IV0D1.21.67.G01.1.454.CMB.2.raw
  modified_base (397)..(397): a, c, t, g, unknown or other
  modified_base (496)..(496): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaaacaggtgcccactcccagactcaactggtgcagtctggacctgaggtgaagagccgtgggcctcggtgaaggtctccgtgcgacgggtcctcgttggttactacgtttttccgacttatagtatcgaggttgggtgcgacgacggtcccttggacgaagggctggagtggagtgggatcgggccgtacgttcgacgaaacggaaagccgtaggagttagtcggacgtagtagttcgagggtnaagtaagtttacctagtaaccacgcgtaactacgaactcccggacgggtcaaccgtacgacctacgttacgaaagtcgaacggaccgtaggacgtaagngggaacgacgaccgaccgaactaagtactttagacgttacgggacggtacggtaagggtcgggggtacttaaggtttaggtacgtaaaccgttaaacgtttaacttaacgtttaaactttacccgtttggttacgggtaaccggttacgggtaccgggggtaaaccggtaaaacggggtaacccgttaccggggtacccgtaccccggttacccccgtacccgaccggttacccccg

SEQ ID NO: 406113 - DNA, 609 bp, Homo sapiens
  misc_feature: GZ8MTXP02I7UJG.21.67.G01.1.454.CMB.2.raw
  modified_base (392)..(392): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttgggtgcgacaggcccttggacaagggcttgagtggatgggatggggccgaccgttcgcgaacggaaagagtgggagtatggtcaggtaatttcgagggcagaattaccgttgaccacngactcatccgtacggcacacgacctacgttggaactagacggaaccgtagacgaagtcggacgacgacggaccaacgatattatgtgacgcgaggtcggggactagttgtagtacgttacgttaacttatttaacttactttcgttaggtacgttcgtcggggaacgtaaacgggaccgacggttaccgaacccgttccgtacccctacgtaccccg

SEQ ID NO: 406114 - DNA, 640 bp, Homo sapiens
  misc_feature: GZ8MTXP02IE6PH.21.67.G01.1.454.CMB.2.raw
  modified_base (327)..(327): a, c, t, g, unknown or other
  modified_base (386)..(386): a, c, t, g, unknown or other
  modified_base (504)..(504): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactgtttttccgattatagtatcagttgggtgcgacaggcccttggacaagggctgagtggatgggatgggcacttcganaacggaaagatggagtatggtacaggtatttcgagggcaggtaattaccgttagaccanacgtactacactacccgacggggcacgacgtcctaactggaaacgtggacggtaaacctaggaacgtaagtacgaacgaacgacggaccgaacctaattactttaagttgttagacgnggtaacggtgggggacttaggttagtacgaacttacttacgttaatttatttacttcgttacggtacgttcgttaggggacgtaaaacgggacccgtaacgggtacgacccgttacccgtaccccgacgtaccccg

SEQ ID NO: 406115 - DNA, 696 bp, Homo sapiens
  misc_feature: GZ8MTXP02JA0OI.21.67.G01.1.454.CMB.2.raw
  modified_base (243)..(243): a, c, t, g, unknown or other
tcagtcgtcgctcgccacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcagggcctntggttactagttttccgatatagtatctagttgggtgcgacaggcccgttaggacgaaggcttggagtggagtgggatgggcccgtacgttcgacgaacggaaagagtagggagtagtggtacgtaggtaatttcgaacggggtcaaggtaactttacccgttgaacccaagacgaccttacgaacgtcccgaacgggcaacgtacgtacccttaacgttacgggaaacgttacggaacggtaaacccgtaggaaggtaagtacgggaaccgacgaacccgggaccaacgtagttaacgttagttaggtacggaccggtacggtagggtcgggggtacttagtttaggtaacgtacttaacgttacttaatttactttacttcgttacggacgttcgacggggacgtaaagggaccgtacggtaccgaaccgtcccgtacccgacgtaccccg

SEQ ID NO: 406116 - DNA, 655 bp, Homo sapiens
  misc_feature: GZ8MTXP02H70Z2.21.67.G01.1.454.CMB.2.raw
  modified_base (428)..(428): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggtcctcgtggttactagtttttccgattatagtatcaggttgggtgcgacacgggtccccttgggaccaagggcttaggaggtggagtggggagtcggggcccgtaccgttcggacgaaacgggaaaagtagtgggagttagtggtacgaggtaatttcgagggacaagtaacttaccgttagaaccanagactcaacgtcccgaacggggcaacgtacgacccttacgtaggaactggaacgggaaacctaggaagaagtacgggaacgacgacgaccagtataatttatgtgcgcggagggtggggctagttgtagacttactaacttatttatttacgttcgttacggtacgtcggtacgggtacgaaacggggtacctacggtacctacccggtcctacccgacgtaccccg

SEQ ID NO: 406117 - DNA, 756 bp, Homo sapiens
  misc_feature: GZ8MTXP02JNM3P.21.67.G01.1.454.CMB.2.raw
  modified_base (221)..(221): a, c, t, g, unknown or other
  modified_base (240)..(240): a, c, t, g, unknown or other
  modified_base (275)..(275): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggngaaggtctctgcaggcctntgttactagttttcgactatagtatcgagttgggngcgacaggcccttggacgaagggcttggagtggagtgggatggggccacttcgacaacggaagagtagggagtagtggtactaaggtaagtttcgaggggactaaggtaactttaaccgttgaaccaacgagtacctactaacgtcccgaacgggggacaacgacgtacccttacgttagggaaccttaggaacggtaaacccgtagaacgtaaagtcggaacgaccgacgggaccaactaagttaatttaagttggtagacggtacggaagggtcgggggtactaaggtttaggtaacggtaaaccgtaaacctttaacgtttaaaattttacgtttaaaacgttttcccgggtttagggttaacccgggttaccggtttaagggggaaacccggtaaaacgggggtaaaccccgtaacccgggggttacccgtaacccggttaccccgtttaacccccggacgggtttaaacccccccg

SEQ ID NO: 406118 - DNA, 669 bp, Homo sapiens
  misc_feature: GZ8MTXP02H686X.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctcgtggttactagtttttccgactatagtatcaggttgggtagcgtacaggccccttggacgaagggcttggaggtgggatggggatggggacccgaccgtttcgacgaacggaaaaggacgtgggagtagtggtacaggtaaatttcgaagggcagtaacttaccttagaccacacgactcaacttccgacgggcacacgacccttaagttcggaaacgttgaaccgggaacctaggagaaagtaggaaccgacgaccggacaaccgattacttattcgtaggcgcggaggtgggggactagtttggtaagtacgttacttaactaacgtttagtttaacctttcggttacggtacgttcggttacgggggaacgaaacggggtacctaacgggtccaacccggttccctaccccgacggtcccccg

SEQ ID NO: 406119 - DNA, 724 bp, Homo sapiens
  misc_feature: GZ8MTXP02I6SH1.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctctggttactagtttttccgactatagtatcgtaggttggtgcgacgacggtcccttggacaagggcttggaggtggagtggggtagtcggggcccgtaccgttcgacgaaacggaaagagtgggagtagtggtagaggtaagtttcgacgggacagtaattaccgttagaaccacagactacactccgacgggtacacgtacgtacctacgttacggaactacggaacggaacccgtaggaacgtaagtacgggaaccgaaccgaccggacctaaacgtaacttaacgtttagttcggtacggtaccgggtacggtaggggtacgggggtacttaaggtttaggtaacgtaacgttaacttaaacgtttatttaaacgtttacgtttacgttacgggtaccgttacggtacgggggtaacgaaaacggggtacccgtaacgggtacccgtacccgttacccgtaccccgtacgtacccccg

SEQ ID NO: 406120 - DNA, 769 bp, Homo sapiens
  misc_feature: GZ8MTXP02ISUFG.21.67.G01.1.454.CMB.2.raw
  modified_base (283)..(283): a, c, t, g, unknown or other
  modified_base (353)..(353): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtggggctggtgaaggtctcctgcgagggcctctggttactagtttttccgactatagtatcaggttggtgcgacnggcccttgggacgaagggtcttaggaggtggagtgggatcggggccgtaccgttcgacgaaacggaaagngtagggagtagtggtacaggtaacgtttcgacggggtcaggtaactttaccgttacggaaccacgacgactacacgtccgaaccggggtacaaccgacgtacccgttaacgttacggtaaactacgggaacggtaaccgtaggaacggtaagtacgggaacgaccgaccgggacctaaacgtaagttacgtttaagttacgggtacggaccgggtacggtaggggtacgggggtaccgtttaaaggttttacggtaaacgtaaaccgtttaaacctttaaacgtttaacgttttaactttaacgtttttacggttacgggttaccggttacgggtacgggggtaaaccgtaaaacggggtacccggtaacgggttacccgtaacccggttccccgttacccgaccggttacccccg

SEQ ID NO: 406121 - DNA, 754 bp, Homo sapiens
  misc_feature: GZ8MTXP02G2QZM.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatcctttcctggtggcagcagcaacaggtgcccactcccagactcaactggtgcagtctggacctgaggtgaagaagcctggggcctcggtgaaggtctcctgcgaggcctctggttactagtttttccgacttatagtatcagttgggtgacgacgacggtccccgttaggacgaagggcttggaggtggagtgggagtggggccgtaccgttcgacgaacggaaagagtagggagtagtggtacgaggtaacgtttcgacgggtacaagtaacgttaccttagaacccacgaggtacctaccgtactcccgaccggggtacaaccgacggtaccctacgtttaacggaacgtacggaacggaaacccgtaggaacggtaagtacgggaacgaacgacccggaccaacgtaattagttagttaggtaggaccggtacggtaagggtgggggtacctaaggtttaggtaacgtacgttaaccgttaaccgtttaagtttaactttaacgtttacggttaacgggttaccgttaccggttacgggggtaaaccgtaaaacggggtacccgtaaaccggggttacccgtaaccccggtttcccctacccccggtacgtaccccccgg

SEQ ID NO: 406122 - DNA, 639 bp, Homo sapiens
  misc_feature: GZ8MTXP02G9CL8.21.67.G01.1.454.CMB.2.raw
  modified_base (281)..(281): a, c, t, g, unknown or other
  modified_base (321)..(321): a, c, t, g, unknown or other
  modified_base (395)..(395): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaagggtctcctgcgagggcctctggttactagtttttccgactatagtatcagttgggngcgacaggcccttggacaagggcttggagtggagtggganggggccgacttcgacaaacggaagatggagtagtggtacaggtattcgaggggcagtaacttactgacctaacngacctcactcccgagggcacgacgccgtactggaactgaacggaaccgtaggagaagtacggaacgaccgaacggaccaacgtatagtttagttgtagcggaggaggtcgggggtactagtttgtaacgtacgtacttaacttaagtttattacgtttcgttacggtacgttacggtcggggtaacgtaaaacggggacccgtaacggtaccgtaacccggtcctacccccgtacgtacccccg

SEQ ID NO: 406123 - DNA, 749 bp, Homo sapiens
  misc_feature: GZ8MTXP02F4T3K.21.67.G01.1.454.CMB.2.raw
  modified_base (285)..(285): a, c, t, g, unknown or other
tcagtcgtcgctcgcacgaccggtgctcgatttagagtatacatattggggtttggggacccaaaaaccacacccctccttgggagattcccctagatcacagcccctcaccatggactggacctggagcatcctttcctggtggcagcagcaacaggtgccccactcccagacctcaactggtgcagtctggacctgaggtgaagagcctggggcctcggtgaagtctcctgcagggcctcgtggttactgttttccgactatagtatcgaggttggtgcgacnggccctggacaaggcttggagtggacgtagggacgtggggtcccgtacttcggacgaaacggtaagtacgtacgggagtagttacgggtacgtaaggtaactttacggacggggtactaacggtaactttaccgtaggaccctaagccgtaactacgtactacccgacgggacacgtacgtaccgtaacgttacggaactacggggaaacgtaacccgtaggaacgtaagggttcggaaccgaaacgaccgggtactaaacctatacgtttaagtcgggttaacgccggtacggtaagggtcggggtacttaacgtttgggaacgttaaacgttactaacggttaacttttacgtttaaacccgttggttacgggtaaccggttcggttacgggggtaaaccgaaaacgggggtaccctaacgggtccctaacccggtttcccgtacccgacgtttaacccccg

SEQ ID NO: 406124 - DNA, 818 bp, Homo sapiens
  misc_feature: GZ8MTXP02JIUYF.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagagccgtggggcctggagaggtctctgcgagggcctgtggttactagtttttccattatagtatcgtaggttgggtgcgacaggccccttggacgaagggcttaggacggtggagttggggatcggggaccctacgttcggacgaaacggtaaagagtacgggtagtagtggtacgtaagggtaatttcggaacggggtacaaggtaaactttaccgttacggaaacccgaacgtacggtaaaccgttaccgtaaacgttacccccgggaacgggggtacccaaaccgtaaccgggtaccccgtttaaaccggttacgggtaaaacccgttacgggaaacgggtaaaaccccgttagggaaacggtaaaacgttaccggggaaaccgtaaaccggaccgggttaaacccaaaccgttaaatttaaaccgtttagtacggttacgggaccggtacggtaaggggtacgggggtacttaggtttcgaaaggtacttaacgtaaactttagttaactttacgttacgttacgggtaccgttacggtacggggaaaccgaaaggggtacccctacggggtacccacccggtttacccgacccccgtacgtaacccccg

SEQ ID NO: 406125 - DNA, 609 bp, Homo sapiens
  misc_feature: GZ8MTXP02G4XQQ.21.67.G01.1.454.CMB.2.raw
  modified_base (386)..(386): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgaggcctctggttactagtttttccgactatagtatcagttgggtgcgacaggcccttggacaagggcttgagtggatgggatgggccgacttcgacaacggaagatgggagtagtggtcaggtatttcgagggcagaattactgaccanagactacatccgacgggacaccgagtccgtacgttacggaacgtgaacggaaccgtaggacgaatacgggacgacgacggaccacgtagtacttaagtgttagcgacggaggtcgggggactagttgtaagactagtaactatttagttacttcgttaggtacgtcgtaggggaacgtaaggtacgtaacggttccgaaccggtcctacccgtacgtaccccg

SEQ ID NO: 406126 - DNA, 819 bp, Homo sapiens
  misc_feature: GZ8MTXP02J3LKC.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctggtgaggtctcctgcagggcctcgtggttactagtttttccgattatagtatcgtaggttgggtgcgacgacggtccccgttagggaccgtaaggggtcttaggaggtagggtagtggggtacgtcggggtaccccgtaccgtttaccggacgtaaaaccgggaaaaggtgtaggggtaagttagtggtaccgtaaagggtaactttcggaacggggtacaagtaacttaccgttacgacccgaagacgacttaccacgtacccgacgggacccaaacgtccgtacccttaacggtacggtaaccgttacgggaaaccggtaaacccgtaggaaacgaaacggtacgggaaacccgtacgaccccgggaacctaaacctaacgttaagtttaaccgttaggccgggttaccggtaccggagggggttacgggggtaccttaaggtttacgggtaaaccttaaccggttaacttaaacggtttaacgtttaacttacccggtttacgttaccggacgttaccgggttaacggggaaccgtaaaacggggtacccgtacggttacccgaaccccggttccctaacccccggtactaccccccgg

SEQ ID NO: 406127 - DNA, 839 bp, Homo sapiens
  misc_feature: GZ8MTXP02HGWNL.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctctgcagggcctcgtggttactagttttccgactatagtatcagttgggtgcgacaggcccttggacaagggcttgagtggatggggatggggccgaccttcgacgaacggaaagagtgggagtagtgggtacaggtaatttcgacggggtcagtaagttaaccttggaaccctaacgacgaacgttcaacgttacccgaaccgggggtacaaaccgtacggtacccttaaacgtttacgggaaaacctacgggtaacgggtaaaaccccgttagggaaaccggtaaaggttacggggtaaaacccgggaaacccgtaacccgggggtaccccaaacgtaaacccgttaagttttaaaccgtttaggttacgggaccggtaccgggaaacgggttcgggggggtaccgtaaggtttttacgggttaacgggtaaaacctttaaaccggtttaaacctttaagttttaaagttttaaccgttttaccggtttacggggtaacccggtttaccggttacgggggtaaccgtaaaaacgggggttacccgtaaacccgggggttaccgtaaccccggtttacccggttacccccgaaaccggttacccccccgg

SEQ ID NO: 406128 - DNA, 676 bp, Homo sapiens
  misc_feature: GZ8MTXP02HKMXR.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctcggtgaaggtctcctgcagggcctgtggttactagttttcgactatagtatcgagttgggtgacgacaggcccttggacaagggcttggagtggagtgggatcggggccgtacgtcgacgaaacggaaagagtgggagtagtggtacgtaggtaatttcgaggacagtaattaccgttagaaccacagtactacactaccgacgggacacgtacgaccgttaacgtacggtaaactggaacggtaaacccgttagggaataagtacgggaaaccgacgtaacggaccaactaagttagttttaagtgttacggcgtacggtagggtaggggacttagtttagaagtaacttaacttagttaattttaacttaccgtttagtacggttacgtacggtaggggtacgaaaacggtacccgtacgggttacccaccggtaccctccccgttacggtacccccg

SEQ ID NO: 406129 - DNA, 865 bp, Homo sapiens
  misc_feature: GZ8MTXP02FHU83.21.67.G01.1.454.CMB.2.raw
  modified_base (276)..(276): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcctgggcctcggtgaaggtctcctgcaggcctcgtggttactagttttccgatatagtatcagttgggtncgacaggcccttggacaagggcttaggaggtcggagtggggaagtcggggacccgtacccgttcggaccgaaaacgggtaaagacgtagggtaggtaacgtgggtacaagggtaactttcggaacggggtacctaaggtaaactttacccgttacggaacccctaacgtacggtaccttacacgttacccgaaccggggacaaccgtacggtaccctaacgtttacgggaacgttacggaacgggtaacccgtaggaacggtaaacgtacggggaaccgaaacccgtaacccgggacccgtaaaccgtaaagtttaaccgtttaaggtttacgggttaccgggtacccgggtaaccgggtacgggggttacggggggtaccctttaaggtttcgggtaaaaccggttaaccgttaaaccgttaaaccgtttaaactttttaaacgtttaacccgtttaaccgggtttacgggtaacccgggtttaccggtaaccggggggtaacctaaaaccgggggtaacccgttaccccggggttacccggtaaaccccggtttccccgttaacccccgaccgtttaaaccccccgg

SEQ ID NO: 406130 - DNA, 593 bp, Homo sapiens
  misc_feature: GZ8MTXP02JRB51.21.67.G01.1.454.CMB.2.raw
  modified_base (383)..(383): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgactatagtatcagttgggtgcgacaggcccttggacaagggcttgagtggatgggatgggccgacttcgcaacggaagatgggagtatggtcaggaatttcgagggcagaattactgaccangactcactccgacgggcacagcctacgtggaactgaggaaccgtagagaagtggacgacgacggacacgatacttagttgtggcgcggaggtgggggtctagtttgtagtactacgtactatttattacttcgttacggtacgttcgtaggggacgaaacggggtacccgtaacgggtaccaccgtaccgtaccccgtacgtaacccccg

SEQ ID NO: 406131 - DNA, 621 bp, Homo sapiens
  misc_feature: GZ8MTXP02F3O4N.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgccccactcccagactcaactggtgcagtctggacctgaggtgaagaagcctgggcctcggtgaaggtctcctgcaggggcctctggttactagttttccgatatagtatcagttgggtgcgacaggcccttggacgaagggcttgagtgagtggatgggccgacgttcgacgaaacggaaagagtaggagtagtggtacaggtaatttcaggtcaagtaattaccttgaacctacgagactcaacgtccgacgggacaacgacacctacgttaggaacctaggaacggtaaacccgagaacgaagtacggacgaacgaccggactaacaagtatttaatgtagcgacgaggtggggctagttgaagtactaactactagttatttacgtacgttaggtacgttacgtggggtaacaaagggtaccctacggttcccaccggtacctccccgaacgtccccg

SEQ ID NO: 406132 - DNA, 799 bp, Homo sapiens
  misc_feature: GZ8MTXP02GNO7P.21.67.G01.1.454.CMB.2.raw
  modified_base (362)..(362): a, c, t, g, unknown or other
  modified_base (395)..(395): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctgtggttactagttttccgactatagtatcaggttgggtgcgacacggtccccttggacgaagggtcttaggaggtggagtggggagtcggggcccgtaccgttcgacgaaacggaaagngtagggagtagtggtacgaggtaattcgagggnaagtaacttaccgtagaccaagcgactcacgtcccgaacggggtaccaacgtacgtacccttaacgtttacggaaacgtcggaaacgggtaaaccctagggaaacgtaaggtacgggaaaccgaccgaaccgggtacccaaacgtaagtttaacgtttagtttggtacggtaccgggtaccggtaggggttacgggggtacttaagggttttacggtaaacggttaacgttaaaccgtttaaacgtttaacgttttaaaccgtttttaaaccgttttacggtttaacgggttaaccggtttaccgggttaacgggggtaaaccgtaaaaccgggggtaccccgttaaaccgggttaccccgtaaacccgggttcccctaacccccggtaccgttaaccccccgg

SEQ ID NO: 406133 - DNA, 673 bp, Homo sapiens
  misc_feature: GZ8MTXP02H57G0.21.67.G01.1.454.CMB.2.raw
  modified_base (440)..(440): a, c, t, g, unknown or other
  modified_base (555)..(555): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtagaaggtctctgcgaggcctctggttactagttttccgacttatagtatcgtaggttgggtggcgacgacggtccccgttagggaaccgaaagggcttaggaggtaggagttagggagtcggggtacccgtaccgttcgacgtaaacggaaagagtagggaagtagtcggtagaaggtaagtttcgagggacaaagtaacgttaccttagaaccgtanacgactacgactccgaacggacaacgacgacccttaacgtaggaactaggacgtaaccgtaggaacgaagtacggaacgacgaaccggacaactaatattaacgtgtacgaccgngtagggtaggggctaggttagtaagtacgttaatacttattacttacgttcgtaggtacgtacgtagggtaaccgaagggtacccacggtaccgaccgtccctacccgtaacgccccg

SEQ ID NO: 406134 - DNA, 545 bp, Homo sapiens
  misc_feature: GZ8MTXP02J0KP9.21.67.G01.1.454.CMB.2.raw
  modified_base (217)..(217): a, c, t, g, unknown or other
  modified_base (246)..(246): a, c, t, g, unknown or other
  modified_base (265)..(265): a, c, t, g, unknown or other
  modified_base (273)..(273): a, c, t, g, unknown or other
  modified_base (373)..(373): a, c, t, g, unknown or other
  modified_base (475)..(475): a, c, t, g, unknown or other
tcagtcgtcgctcgcacgaccggtgctcgatttagagtatacatattgggtttgggggacccaaaaaccacacccctccttggagattcccctagatcacagcccctcaccatggactggacctggagcatccttttcctggtggcagcagcaacaggtgcccatcccagactcaactggtgcagtctggacctgaggtgagagcctgggcctcggnaaggtctcctgcaggggcctctggttacngtttttcccgatatagtancagtgggncgacaggcccttggacaagggcttgagtggatgggatgggccgacctcgcacggaaagatgggagtatggtcaggaatttcaggcagattacttgacacngactcatccagggcacagcctacttggaactgagaacccgtagaggaatagggacacgacggccacaatattattcgtagcgcgagtgggggcagttgtagntaactactattattacttcttggtacgtacgtgggacaaaggaccacgtcaccgtcctaccccacgtccc

SEQ ID NO: 406135 - DNA, 586 bp, Homo sapiens
  misc_feature: GZ8MTXP02FJYDY.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctgtggttactagtttttccgactatagtatcagttgggtgcgacaggcccttggacaagggcttgagtggatgggatggggccgacttcgacaacggaaagagtgggagtagtggtcaggtaatttcgagggcaggaattaccttgaccacagactcatccgacgggcacagacctacttaggaactgaggaacctagaagaagtaggacgacgacggaccaacatattattgtacgcgacgaggtggggctagtttagagtactactactattattacttcttacggacgttacgtggggacgaaagggaccgtacggtccaaccggtcctacccgacgtccccg

SEQ ID NO: 406136 - DNA, 756 bp, Homo sapiens
  misc_feature: GZ8MTXP02HDBFY.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcagggcctctggttactagttttccgactatagtatcaggttggtgcgacgaggcccttggacaagggtcttgaggtggagtgggatcggggccgaccgttcgacgaaacggaaagagtagggagtagtgggtacgaaggtaagtttcgacggggacgtaagtaacgtttaaccgtacggtaacccaacgtacggtacctccgaaacgttaccccgaaccggggacaaacgtaccgtaacccgttacgttacgggtaaacgtacggaaacggaacccgttaggaaacggaacgtacgggaacgaaccgaaccggaccaaactaattagtttacgtggtaggaccgacggtagggtacgggggtacttaaggtttaggtacgtaaacgttacgttaacgttaactttaagtttaaacgtttcgttacgggtaccggtttacggtacgggggtaaccgtaaaacgggggtaccccgtacgggttacccgtaccccggttacccgtacccccgtaacgtacccccg

SEQ ID NO: 406137 - DNA, 706 bp, Homo sapiens
  misc_feature: GZ8MTXP02FS823.21.67.G01.1.454.CMB.2.raw
  modified_base (358)..(358): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggcctgtggttactagttttccgactatagtatcgtaggttggtgcgacgcggcccttggacgaagggtcttggaggtggagtgggagtcgggccgtacgttcgacgaaacggaaagtagngggtagtagtggtacgaggtaattcggagggacagtaacgttacctaggaacctagacgtactacgacgtacccgacgggacctacgacgtaccgtacgttacggaactacggaacggtaaaccgtagaacggtaagtacggaacgacgaacccggactaacgtattaacttgttaggtcggacgggtacggaaggggtcgggggtactttaggttagtaacgttacgttaactttaacgtttaagtttaacgttacgtttacggttacggttaccgttacgggtaacgggaacggtaaaaccggtaccgtaacggtccgtaacccgtcccgtacccgactacccccg

SEQ ID NO: 406138 - DNA, 728 bp, Homo sapiens
  misc_feature: GZ8MTXP02FIPEN.21.67.G01.1.454.CMB.2.raw
  modified_base (243)..(243): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgccccactcccagactcaactggtgcagtctggacctgaggtgaagaagcctggggcctcggtgaaggtctcctgcgaggcctntggttactacgttttccgactatagtatcaggttggtgcgacacggcccttggacgaagggcttggagtggagtgggatgggccgtaccgtcgtacgaacggaagagaggtaggagttggtacgaggtaagttagtacggacgagtaaagtaccttacgtaccgacacgacgtctacgtaccacgggtacgacacgtaccctacgttacggtaacggtaacgtacggtaaacccgtacggacgtaaaggacggtaaccggaaccgaaccgaccccgtaactaaaacttagtttaaagttcggttagggaccggaccgggtagggtacgggggtgttaggtttacgttacggtactaaaccttacgttaactttacgttttaaacgttcgtttacggttaccggtacggttcgggggaagggtaaacccgggtaaaccggtacccgtccggtaccccggtaccttacccccgaccggtaacccccg

SEQ ID NO: 406139 - DNA, 688 bp, Homo sapiens
  misc_feature: GZ8MTXP02GGEHJ.21.67.G01.1.454.CMB.2.raw
  modified_base (321)..(321): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagttttccgactatagtatcgtagttgggtgcgacacggccttggacgaaggtctgagtggatggganggccgtactgacaaacggtaagagtaggacgtagtggtacgaggtaattcgagggtacagtaaacttaccgttggaaccctagacggacttacgaacgtacccgaacggggtacaacgtacgtacccgttaacgttacggaaccgtaggtaacggaaacccgttagaacggtaaagtacgggacaaacgcggaacccagattaattgttagacggcgacggtagggtggggacttagttcggaatacgtaacttacgttatttaacgttacgtttacgttacggtaccgttacggtaggggaaccgaaaacgggtccccgtaacggggtacctacccggtttacccaccccggtacgtaaaccccgg

SEQ ID NO: 406140 - DNA, 746 bp, Homo sapiens
  misc_feature: GZ8MTXP02IIZ8Z.21.67.G01.1.454.CMB.2.raw
  modified_base (356)..(356): a, c, t, g, unknown or other
  modified_base (368)..(368): a, c, t, g, unknown or other
  modified_base (410)..(410): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcagggcctgtggttactgtttttccgacttatagtatcgtagttgggtgcgacaggcccttaggacgaagggcttaggagtggatggggatggggccgaccgttcgaacgaacggaaaagngtagggagtagnggtacgaggtaattcgagggacagtaaacttactgaacctanggactcgactccgaacgggtacaacgacaccgttacgtaggtaactaggaacggtaacctaggaacgtaaacggacggaaccgaccgaaccggaccaaaccggtaaatttaactttaaggttcggtacgggaccgggtacgggtagggtacggggggtaccttaaggttttacgggtaaacggttaaaccgttaaaccgtttaacgtttaaacttttaacgtttaaccgttttacggtttacggggtaccgttacgggtttacgggggaccgttaaaacggggaccccgtaacgggttaccgaacccggttccctaccccggtaccgtaacccccg

SEQ ID NO: 406141 - DNA, 766 bp, Homo sapiens
  misc_feature: GZ8MTXP02GHBJU.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactccccagactcaactggtgcagtctggacctgaggtgaagaagcctggggcctcggtgaggtctcctgcagggcctctggttactacgtttttccgactatagtatcgagttggtgcgacaggcccttggacaagggcttgagtggatgggatgggccgacttcgcaacggaagagtgggagtagtggtacgaggaatttgagggacagtaagttaccttgaccagagactctacgtccgacggggtcacgacgtaccgtacgttacggaacgttacggaacgggaaacccgttaggaaacggtaaacgtacggggaaaccgaccgaaccgggacccgaaaccgtaaattacgtttaacttaggttacgggtccggacggtaagggggtgggggtaaccttaggttttacggttaagtaaccgttttaaccgtaaacgtttaacgttttaacgtttttaaccgttttaccggtttacggggttaaaccggtttccggttaccgggggtaaccgtaaaaccgggggtaaccccgttaaccgggggtaccccgttaaccccggtttaccccgttaccccccggtaacggtttaacccccccgg

SEQ ID NO: 406142 - DNA, 569 bp, Homo sapiens
  misc_feature: GZ8MTXP02GMKTO.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacagtttttccgactatagtatcagttggtgcgacaggcccttggacaagggcttgagtggatgggatgggccgaccgttcgcaacggaagatgggagtagtggtacaggaatttcgagggtcagaattacttgaccacagactcatccacgggcacagcctacttggaactgaggaacctagagagtagacgacacggaccacagtattagtgtgcgcgagtggggctagttgtagtactacgtactattattacgttacttaggtacgtacgtgggacgaaacgggaccaacggtccaccgtcctacccgacgtaccccg

SEQ ID NO: 406143 - DNA, 739 bp, Homo sapiens
  misc_feature: GZ8MTXP02JEVC5.21.67.G01.1.454.CMB.2.raw
  modified_base (281)..(281): a, c, t, g, unknown or other
  modified_base (286)..(286): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagttttccgactatagtatcaggttgggtncgacnggccccttggacaagggcttggagtggagtggggatggggcccgtaccgttcggacgaaacgggaaagacgtagggagtagtggtacgaggtaagtttcgaggggcaagtaacttaccgttgacccgaacacgactcactcccgtacggggacaacgacgtccctacgttagggaactaggaacggaaccctagaagaagtagggaaccgaacgaccggacccgaacgtaatttacgtttagttggtacgtacggaccggagggtagggggtaccttaaggttttcggaaacgttaacgttaacgtttaacgttacgttttaaacttttaccgtttacgtttacggggttacccgttacggtttaccgggggaaaccgtaaaaaccgggggtacccgttaaacccgggtccgttaaacccccgggttcccttacccccggtacgtaacccccg

SEQ ID NO: 406144 - DNA, 792 bp, Homo sapiens
  misc_feature: GZ8MTXP02I43C0.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgatatagtatcgaggttggtgcgacaggtcccttggacaagggcttggagtggatgggatggggccacgttcgacgaaacggaagagtggagtagtggtacgaggtaatttcgacggggtactaagtaactttacccgttaggaaccctaacgtacggtacctaccgtaacgttaccccgaacgggggaccctaaaccgtacggtaccccttacggttttaacgggaaaccctttaggggaaaaccggtaaacccgtaggtaaaggtaaacggtacgggggaacccggaaaccgaaccggggacccctaaacgtaaaccgtttaagtttaacgtttacgggttacgggaccggtaccgggtaaagggggttcgggggtacctttaaggtttacggtaaggtaaaccttaaacgtttacgttaattttaacgtttacgtttacgttacggtaccgttacgggtacggggtaacgtaaaacggggtacccgtaacggtacccgtaaccgtccccgtacccgtaccgtaccccg

SEQ ID NO: 406145 - DNA, 554 bp, Homo sapiens
  misc_feature: GZ8MTXP02FOA1C.21.67.G01.1.454.CMB.2.raw
  modified_base (388)..(388): a, c, t, g, unknown or other
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggtttacagtttttccgactatagtatcagttgggtgcgacaggccccttggacaagggcttgagtggatgggatgggccgaccttcgcaacggaagatgggagtatggtcaggaatttcaggggcagaattaccttgaccacngactcatccacggcacagcctacttggaactgaggaaccctgagaaatggacgacgacggccacaatattattgttagcgcgaggtgggggcattgtagactactactattattacttcttggacgtctggggcaaagggacacggtcaccgtctccccacgtccc

SEQ ID NO: 406146 - DNA, 846 bp, Homo sapiens
  misc_feature: GZ8MTXP02HQGCQ.21.67.G01.1.454.CMB.2.raw
  modified_base (241)..(241): a, c, t, g, unknown or other
  modified_base (427)..(427): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggcctntggttactagttttccgactatagtatctagttgggtgcgacgaggccccttggacgtaagggcttggagtggagtgggatgggccgacgttcgacgtaaacggaaagagtgggtagtagttagggtactaagggtaatttacgacggggtccaaaggtaactttaacccgtttagacccccgaanacggtaaccttacgaacgttaccccgaaccgggggtacaaaccgtacgacccgttaacgttagggaaccgttacgggaacggtaaacccgtagaaacggtaagtacgggaaccgaccgaaccgggaccctaaacccgtaagtttaaacgttttaacgtttagggttaccggtacgggtacccgggaaggggttcggggggtaaccgttaaggttttaggtaaaccggttaacgttaaaacccggtttaactttaacgtttttaaacttttaacccgttttaccggttttacggggttaaacccgggttccggtttaccgggggtaaccggtaaaaacgggggtaacccccggtaaccgggtttaccccggtaaccccggtttcccccggttacccccggtaaaaccgggtacccccccg

SEQ ID NO: 406147 - DNA, 700 bp, Homo sapiens
  misc_feature: GZ8MTXP02JHRS1.21.67.G01.1.454.CMB.2.raw
  modified_base (546)..(546): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagaagcctggggcctcggtgaaggtctcctgcagggcctgtggttactagtttttccgacttatagtatctaggttgggtgcgacacggtccttggacgaagggtcttggagtggacgtggggatggggccgtaccgttcgacgaaacggaagagtaggacgtatggtacaaggtacgtttagacggactaaggtaatttacccgtgaacccaactacggtaacctctaagtaccccgacggggacaccgagtacccttaagttacggaaccttaggacgtaaccgtagacgtacgtaggaccgacgacggacctaactatagtttagtacggtggtacccgnggaagggtcgggggtataggtttacgtaacgtaacgttaacgttaaccgtttaagtttacgtttaacgttacgtttagggtaccgttacgggttacggggaacgtaaaacgggccgtaacggtccgaacccgtttccacccccgtagtcccccg

SEQ ID NO: 406148 - DNA, 799 bp, Homo sapiens
  misc_feature: GZ8MTXP02FQGLL.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagttttccgactatagtatcagttgggtgcgacaggcccttggacaaggcttgagtggatgggagtgggccgaccgttcgacgaaacggaaagagtgggagtagtggtacaggtaagtttcgagggactaagaaactttaccttagaaccctaacgagtacctacaattcccgaacgggcaacacgtaccctacgttacggaaacgtacggaaacggtaacccgtaggaacgtaaagtacgggaaccggaaccgaaccggacccgaaactaacgtttaaagtttaacgttacggttacgggaccggtaaccgggtagggggttacggggggtaccgtttaaaggtttacggttaaacgggttaaacttaaaccgtttaaaacctttaagtttttaaaacgttttaaaccgttttacccggttttacggggttaaccgggtttacccggtttaaggggggtaaaccgttaaaaacgggggtaaccccgttaaacggggttacccgtaaaccccgggtttccccgtaacccccgtaccggtaaccccccg

SEQ ID NO: 406149 - DNA, 781 bp, Homo sapiens
  misc_feature: GZ8MTXP02G97CR.21.67.G01.1.454.CMB.2.raw
  modified_base (289)..(289): a, c, t, g, unknown or other
  modified_base (296)..(296): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaacggtctccgtggcgagggccttcgtggttactagtttttccgacttatagtatcgtaggttggngcgacgnggtccttggacgaggtctggagtggagtgggatcggggcctaccgtcgaacgaacgggaagtagtagggtagttagtacgggttacgaaggtaacgtttacggacggggtacctaaacggttaaactttaccggttacgaacctaacgacgtaaccgtacgtacgtcccgacgggacacgtacgtaccgttacgttacggaacttggaaacgtaacgtacgtaagaacgttacggggaacccgacgacccggtaacaaaccgttagtttacgtttaacgttcgggaccggtacggtaccgggtaagggggttacgggggttaacctttaaaggtttcccggggttaaaatacccgttaaacgtttaacgtttaacttttaacgtttacccgtttaggtacggttaccggttaccggtaggggtaacgaaacgggtccctaaccgggttaccacccggttacccgtaccccgtaggtaaccccccg

SEQ ID NO: 406150 - DNA, 789 bp, Homo sapiens
  misc_feature: GZ8MTXP02IYI19.21.67.G01.1.454.CMB.2.raw
  modified_base (238)..(238): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagctggggcctggtgaggtctcctgcagggcctntggttactagtttttccgactatagtatcagttgggtgcgacaggcccttggacgaagggcttggagtggagtgggagtggggccgtaccgttcggacgaacggaaagagtgggagtagtggtacgaggtaaatttcgagggacagtaacttaccgttagacccaacgagtaccttcaacgtacccgaccgggggacctaacgacgtacccgttaacgttacgggaaacctagggaaacggtaaacccgtaggaacggtaaagttacggggaaaccggaaccggaaccggggaccctaaacgtaaagtttaacgtttaagtttacgggtcgggtaccgggtacgggtacgggggttacggggggtacttaaggttttaggtaacggtaaccgtttaacgtttaaacgtttaacgtttttaaacgttttaccgttttacggtttacggggtaccggttacgggtttcgggggaaaccggtaaaacgggggtaccccgtaaccggggttaccctaaccccggttcccgttacccccggtacgttaccccccgg

SEQ ID NO: 406151 - DNA, 659 bp, Homo sapiens
  misc_feature: GZ8MTXP02I4JNK.21.67.G01.1.454.CMB.2.raw
  modified_base (349)..(349): a, c, t, g, unknown or other
  modified_base (401)..(401): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagtttttccgactatagtatcgagttggtgcgacaggcccttggacaagggcttgagtggatgggatcggggcctacgttcgacgtaaacggaaagngtggagtagtggtacaggtaatttcgagggactagtaacttactcggaccanagtactacactccgaggcacagtcctagttagactagaacggacctaggagaaagtcggaacgacgacggaccactagttattagtgtcggagacggtaggtacggggtactagtttgggaacgtacttaacttaacggttaatttaacgtttacgtttaacggtttcgggtaaacgttcggttaacggggaacgtaaaacggggtaccgtaaccggttaccgtaacccgtacccgttacccccgaacggtacccccg

SEQ ID NO: 406152 - DNA, 796 bp, Homo sapiens
  misc_feature: GZ8MTXP02ISD0O.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatctagttggtgcgacaggcccttggacgaaggcttggagtggagtgggatggggccgtaccttcggacgaacggaaaagtatagggagtagtggtcaggaaatttcgaggggtcaagtaactttaaccgttgtaaccgacacggacctacaagttccccgacgggggactaaccgaacgtacccgttaacttacggggaaccttagggaacggtaaacccgtagggtaacgaaagttacggggaaaccggaaccgaaccggggacccaaccgttaaagttaacgttttaacgttacggtttacggggaccggtaccggggtaggggtttacggggggggtaccttaaggttttggtaaacgggtaacctttaaccgtttaaacttacgtttttaaactttaccgtttttaccggtttaaggggtacccggtttacggtacgggggttaaacgtaaaacgggggtaaaccccgacggggtttaacccgaaccccggtttccccttacccccgggtacttaacccccgg

SEQ ID NO: 406153 - DNA, 684 bp, Homo sapiens
  misc_feature: GZ8MTXP02HGRT8.21.67.G01.1.454.CMB.2.raw
  modified_base (277)..(277): a, c, t, g, unknown or other
  modified_base (359)..(359): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctcggtgaggtctctgcgaggcctgtggttactagttttccgattatagtatcgtagttgggngcgacacggtcccttgggacaagggcttggaggtggagtgggatggggcccgaccttcgacgaacggaaagagtaggagtgnggtacaggtaaatttcgaggggactaagtaaacttaccgttcgaaccgactagacctcaaccgttacccgacgggggacaacgacgtacctacgttaggaacgtacggaacggtaaaccgtaggaacgtaatacgggaaccgacgaaccggaccaacgtaacttagtttaagttgttacggcgtacggagggtggggattacgtttgagtactacgttaaacttatttacgtttacttacgttacggtaccgttacggtagggtacgtaaaacggggtacccgtaacggtacctacccggtacccgtcccccgtacgtacccccg

SEQ ID NO: 406154 - DNA, 661 bp, Homo sapiens
  misc_feature: GZ8MTXP02FKND1.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctgtggttactagttttccgatatagtatcagttgggtgcgacaggcccttggacaagggcttgagtggatgggatgggccaccttgacaacggaaagatggagtagtggtcaggtaatttcgaagggcaagtaactttaccgttagacccaacgtagacctcaactcccgaacggggcaacgacgtacccttacgttacggaaactagggaacggaaacccgtaggtaagaaagtaggaacgacgaaccgggaccaactaataacttagttaggtagacgacggagggtcgggggactagtttgacggtaactaacgttaacttaactttaatttaccttcgttacggtacgttacggtaggggaccgtaaaacgggaccgtaaccggtacctacccggtccctaccccgacgtacccccg

SEQ ID NO: 406155 - DNA, 788 bp, Homo sapiens
  misc_feature: GZ8MTXP02HPK63.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcgggtagaaggtctccgtgcgagggcctgtggttactacgttttccgattatagtatcgtaggttgggtgtcgacgacggtcccgttagggacgtaagggtcttggaggtcgggtagtggggacgtcggggcccgtaccgttcggaaccggtaaaacggaaagtaggtacgggtagtagtaggtacgtaaggtaatttacggagggtactaagttaacttccgttagaccccgtaagtaccgtactacgacgtacccgtaaccgggacacgtaccgtcccttaacgttaggtaaccgttaggaacggtaaacccgttaggaacggtaaagtccggggaaccgacggtaaaccggccctaaacgttagtttaacggttttaagttcgggtaccggtacgggtcggtaaagggggttcgggggtactttaagggtttacgtaacgtaacgttaaactttacgttaaaagttttcttaaaccgttgtttacgggtaccgtacggtacgggggtaacgtaaaaccgggtcgtaacgggttccctaaccggtcccctacccggtacgtacccccgg

SEQ ID NO: 406156 - DNA, 607 bp, Homo sapiens
  misc_feature: GZ8MTXP02HS5AP.21.67.G01.1.454.CMB.2.raw
  modified_base (420)..(420): a, c, t, g, unknown or other
  modified_base (514)..(514): a, c, t, g, unknown or other
  modified_base (518)..(518): a, c, t, g, unknown or other
  modified_base (520)..(520): a, c, t, g, unknown or other
  modified_base (528)..(529): a, c, t, g, unknown or other
  modified_base (556)..(556): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatcccttttcctggtggcagcagcaacaggtgcccactcccagactcaactggtgcagtctggacctgaggtgaagaagccgtggggcctcggtgaaggtctcctgcgagggcctgtggttactagtttttccgattatagtatctaggttgggtgcgacagggtccccttgggactaaggcttggagtggagtggggatggggccgaccgttcgacgaaaacggaaagacgtgggaagttagtggtacgaaggtatttcgaaggggcaagtaacttaccgttgaccaagngaacttcacgtcccaaccggggcacaggccttacgtacggaacgtagacggaaaccgtgagaagtggacgacgacggacacgaatattagttgngcgngngtaggggnngttagagactatacttattattacttntcggacgtcgtggagtaaacggcacggttcaaccgtccaccgtacgacccc

SEQ ID NO: 406157 - DNA, 574 bp, Homo sapiens
  misc_feature: GZ8MTXP02GLA8M.21.67.G01.1.454.CMB.2.raw
  modified_base (284)..(284): a, c, t, g, unknown or other
  modified_base (393)..(393): a, c, t, g, unknown or other
  modified_base (422)..(422): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (456)..(456): a, c, t, g, unknown or other
tcagtcgtcgctcgcacgaccggtgctcgatttagagtatacatattgggtttggggacccaaaaaccacacccctccttgggagattcccctagattacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcganaggcccttaggacaagggcttgagtggagtgggatgggccgacttcgacaacggaaagagtggagtatgggtcaaggatttcagggccagtaacttactgacacagctnatccacggcacgagctactgaatgagacngagatggagaacncgntanatattatagtgccgngaggtgggggactagtttgtaagactactacttaatttacttactttctaggtacgtaggtacggggtaacaaaggggtaaccgacggtacacccggtcctacccacggcccaacccg

SEQ ID NO: 406158 - DNA, 662 bp, Homo sapiens
  misc_feature: GZ8MTXP02F1284.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcgagggcctctggttactagtttttccgactatagtatcagttggtgcgacaggcccttggacaaggcttgagtggagtgggagtggggccgaccttcgacgaaacgggaaagagtagggagtacgtggtacgaaggtaatttcgagggacagtaaattaccgttagacccaacagacctcaacgtacccgacggggacaaacgacgtacccttaacgttaggaaaccgttaggaaacggtaacctaggaacgtaaagtacgggaaaccgaccgaaccggacccaacgtaattaagtttacttagtaggacgacggtagggtggggactagtttagagtactataacttattatttacttcgtacggtacgtacgtggggactaaacgggcctaacggtaccgtaccgtccgtaccccgacgtaccccg

SEQ ID NO: 406159 - DNA, 678 bp, Homo sapiens
  misc_feature: GZ8MTXP02I5T4B.21.67.G01.1.454.CMB.2.raw
  modified_base (574)..(574): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggcctcggtgaaggtctcctgcgagggcctgtggttactagttttccgacttatagtatcgtaggttgggtcgcgacgaggtcccttgggaactaaggggctttaggaaggtgggtagtggggatcggggaccctacgttccggacggaaacggaaaagtgtaggagttagtggtacgaggtaagtttcgacggggataagtaaagtttacccgtagaaacccacgaggtacctacgtaactcccgaacggggacaccgtagtacccgtaagtttcggaaactaacggaacggtaaacccgtagaacggaagtacggacgaacgaccggactaacctaagtactttaagtcgtgcggagagggnggggtctagttgtacaagtctaatatttattacgtcgttacggtcgtacggtaggggtaacgaaacggccgtaacgccgtaccgtccctaccgcggtaaccccc

SEQ ID NO: 406160 - DNA, 693 bp, Homo sapiens
  misc_feature: GZ8MTXP02FNYX7.21.67.G01.1.454.CMB.2.raw
  modified_base (244)..(244): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaaacaggtgcccactcccagactcaactggtgcagtctggacctgaggtgaagaagccgtggggcctcggtgaaggtctcctgcagggcctntggttactagttttccgatatagtatcgagttgggtgcgacaggcccttggacgaagggcttggagtggagtgggatcggggcctaccgttcgacgtaaacggaaagagtagggagtagtaggtcaaggtaatttcgaggggtacaagtaaactttaccgttagaacccagtacgaccttcaacgtaccccgaacggggcaacgacggtaccctacgttacggaaccgttagaaacggtaaccctaggaacgtaaagacggaacgaccgaacggacccaagaagttaagttaagttgtacgggacgtacggtaaggtcgggggacttagtttaggaagtacgttaaaccgttattaactttatttaaccgttccgttaggtacgtaccgtggggtaactaaacggggaccgtacggttaccaccggttaccaccccgtacgtacccccg

SEQ ID NO: 406161 - DNA, 765 bp, Homo sapiens
  misc_feature: GZ8MTXP02G95Y1.21.67.G01.1.454.CMB.2.raw
  modified_base (350)..(350): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacgaggtgcccactcccagactcaactggtgcagtctggacctgaggtagaagagccgtgggcctggtgaggtctctgcgacggctgtgttactagttttcatatagtatcgtaggttgggtgcgacgacggtcccgttagggacgtaaggcttggaggtggagtgggagcgggccgtacttcgacgaaacggaagngtggaagtagtcggtaagagtaagtttcgaggggactaagtactttaccgtagaacctacgagtaccttcgacgtacccgacgggtacaacgaccgtacccgttaacgtacggtaaacacggaacggttaaaccgaggaacgtaaacggtacgggaacgtaccgaaccggaactaacgttaaattacgttttagtggtacggaccggttagggagggttacggggtactttaggttacggttaacgtaaccgttaaagttttacccttaaaagtttttaccgtttaaacctttgggttttaaaccgggtccggttacggttaaacgggggttaccggaaaaaccggggttaccccgttaaccggggttacccctaaacccccgggtttcccaaccccccgtaacgggtccccccg

SEQ ID NO: 406162 - DNA, 842 bp, Homo sapiens
  misc_feature: GZ8MTXP02G4SL7.21.67.G01.1.454.CMB.2.raw
tcagtcgtcgctcgcacgaccggtgctcgatttagagtatacatattgggtttggggacccaaaaaccacacccctccttgggagattcccctagatcacagtccctcaccatggactggacctggagcatccttttcctggtggcagcagcaacaggtgcccactcccagactcaactggtgcagtctggacctgaggtgaagaagccgtggggcctcggtgaaggtctcgttgcgagggcctgtggttactagttttccgactatagtatcgtaggttggtgcgacacggtcccttgggacaaggcttggaggtggagtggggagtcggggcccgtaccgttcggaccgaaaacggaaaggtagtagggacggttagtagggtacgtaaggtaaagtttcggaaggggtacaagtaaacgtttaccgttaggaacccgtaacgacgtaccttacgaaccgtacccggaaccggggtaccaacgtaacccgtacccgttacggttaacggtaaaccgttacgggaaaccgggtaaaacccgttaggggaaacggttaaacggtaacggggtaaccggaaacccgtaaccgggtaacccgaaaccggttaaacttaacgttttaagttacgggttacggtaccgggtaccggggtaagggttcggggggactttaagggtttaggtaaacgggttaaccttaaacgttaactttaaacgttttacgttttaaaccgtttcggtttaacggttaccggttacgggttacgggggtaacgtaaaaccggggtaccgtaccgggttaccgacccggttaccccgtaccccgaaccgttcccccgg

SEQ ID NO: 406163 - DNA, 756 bp, Homo sapiens
  misc_feature: GZ8MTXP02JDI05.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggccttcgtggttactagttttccgactagtagtatcaggttgggtgcgacaggtcccttggacgaaggtcttggagtggagtgggagtggggccgtaccgttcgacgaaacgggaaagagtagggagtagtacgggtacaagggtaatttcgacggggtacaaggtaaacttaccgttagaaccacgacgtacctacgaacgtcccgaacggggtacaaaccgacgtacccgttacgttacggaaaccgttacgggaacggtaacccgtaggaacgtaaacgtacgggaaccgtaccgaaccggaccctaaacgtaacttaacgtttaaagttcggttacggtaccggacgggtaacggggttcggggggtaacttaaggtttacggtaacgtaaccgttaacgttaacgttaatttacgttaacgtttacgttacggttacgttacgggtacgggaacgtaaacggggtacccgtaacggtcccgtaacccgtcccgtaccccgtacggtacccccg

SEQ ID NO: 406164 - DNA, 582 bp, Homo sapiens
  misc_feature: GZ8MTXP02IJGKR.21.67.G01.1.454.CMB.2.raw
  modified_base (142)..(142): a, c, t, g, unknown or other
  modified_base (223)..(223): a, c, t, g, unknown or other
  modified_base (291)..(291): a, c, t, g, unknown or other
  modified_base (324)..(324): a, c, t, g, unknown or other
  modified_base (343)..(343): a, c, t, g, unknown or other
  modified_base (391)..(391): a, c, t, g, unknown or other
  modified_base (470)..(470): a, c, t, g, unknown or other
  modified_base (472)..(472): a, c, t, g, unknown or other
tcagtcgtcgctcgcacgaccggtgctcgatttagagtatacatattgggtttggggacccaaaaaccacacccctccttgggagattcccctagatcacaggcccctcaccatggactgggacctggagcatccttttccnggtggcagcagcaacaggtgcccactcccagactcaactggtgcagtctggacctgaggtgaagaagcctggggcctcggngaaggtctcctgcagggcctctgggttactaggtttttccgattataggtatcgtagttgggtgcganacggccgttgacgaaggcttagagtgagtggangggcactgacaacggaagngtcggagtatggacgaggatttcgaggtcgagtataccttgaccacgngtacactagaccacgggcactacggaccctagttacgacagacgacttagagagtgacgagacgcacatattatccggngngagaggtagggatagttagacgtactacttacttattagttacgttacgtacggtacgtacgtagggacgaacggtacgaccgtacaccgtacccgtaccgtacgtaccg

SEQ ID NO: 406165 - DNA, 832 bp, Homo sapiens
  misc_feature: GZ8MTXP02ICMBX.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgaggcctcgtggttactacgtttttccgacttatagtatcgtaggttgggtgcgacacggtcccttggacaaggtctggaggtggagtgggagtcggggcccgtacgttcgacgaaacggaaagacgtagggacgtagtcgggtaccgtaagggtaactttacggaacgggtactaaaggttaaacgtttacccgtttagaaaccccgttaacgaccgtaaccgttaccgaaacgttacccggaaacccggggtacctaaacccgtaccggtaccccgtttaaaccgttacggggtaaaacccgttacggggaaaaccgggttaaaccccgttagggtaaaaccggtaaacggttaccggggaaaacccggttaacccggaaacccgggtaaccccgaaacgttaaaccgtttaaggttttaacgttacgggttacgggaccggtacgggtaaggggtcgggggtaacttacggtttaggaacgttaacgttaacttacttaagtttactaccgtttacgtcgggtaccgtcggttaccgggtagaaaaccgggtccgaaccggtccgtaccgtccgtaccccgtacgtacccccg

SEQ ID NO: 406166 - DNA, 745 bp, Homo sapiens
  misc_feature: GZ8MTXP02HSJVF.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctctggttactagtttttccgactatagtatcagttgggtgcgacacggcccttggacgaagggcttaggaggtggagtggggatcggggcccgtaccgttcgacgaaacggaaagagtgggagtagtggtacgaaggtaatttcgacggggacaagtaattacccgttagaacccacgacgtactacacgttcccgacggggacaacgacgtccgttaacgttacggaacgtaggaacggtaaacccgtaggtaacgaaagtacgggaaccgaaccgaccggtaccaacgtaattaagtttagttggtaggcggtacggtagggtagggggtacttaggtttacggtaagtaaccgttaaacgttaactttaacgttttaactttacgttttaccgtttacgggtaccggttaccggttacgggggtaaaccgtaaaaacgggggtaccccgtaaccgggtaccccgtaacccggttccccgtacccccgtaacggtacccccg

SEQ ID NO: 406167 - DNA, 735 bp, Homo sapiens
  misc_feature: GZ8MTXP02HXPLK.21.67.G01.1.454.CMB.2.raw
  modified_base (351)..(351): a, c, t, g, unknown or other
  modified_base (386)..(386): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgaggcctgtggttactagtttttccgactatagtactcgtaggttggtgcgacaggcccttggacgaaggctggagtggagtgggagtgggcccgtacgttcgacgaaacggaaagngtagggagtagtggtacgaggtatttcgacggganaagtacttaccgttacgaccacgtacgtactacgacgtacccgacgggcaacgaccgaccttacgttaggaacgtacggaacggtaacccgtaggaaacggtaaacgtcgggaaaccgaccgaaaccgggacccgtaaacgtaacgtttaacgtttaagttacgggttcgggacggtacggggtagggtaccgggggtacttaggtttaacggtacggttaaacttaacggttaacttaacgttttaactttaccgtttacggtttacggggtacgttacgggttaggggtaaccggtaaacgggtccgtacggtacccgaccggttaccctacccgtacgtacccccg

SEQ ID NO: 406168 - DNA, 793 bp, Homo sapiens
  misc_feature: GZ8MTXP02JZV6H.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcgggtgaaggtctccgtgcgagggcctcgtggttactagttttccgacttatagtatcgtaggttgggtgcgacgacggtcccgttagggacgaagggtcttaggaggtggagtggggagtcggggacccgtaccgttcggacgaaaacgggtaaagaggtagggtagtagtggttacgaaggtactttacggaacggggtactaaggttaaacgtttaaccgttcgaacccgtaacgtacggtaacctacgtaaccgtaccggaaccggggaccaaaccgacgtacccttaacgttacggaacgtaggaaacggtaaccgtagaaggaaacgtacgggaacgaccgaccggaaccgtaaacgtaatttaacgttagttacggttacgggaccggtacgggtaaggggttacgggggtacttaaggtttacggtaacggtaaccttaaacgtttaacttaagtttacgtttacgtttacgttacgggtaccgttacgggttacggggaaccggtaaaccgggtaacccggtacggttacccgtacccgttacccggtaccccgtacgtacccccg

SEQ ID NO: 406169 - DNA, 764 bp, Homo sapiens
  misc_feature: GZ8MTXP02IX8A2.21.67.G01.1.454.CMB.2.raw
  modified_base (280)..(280): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgagtctcgtgcgagggcctctggttactgttttaccgatatagtatcgtaggttgggtncgacgaggtccccgttggacgaagggtcttaggaggtggtaagtggggagtcggggaccgtaccgttacggacgaaaacgggaaagacggtagggaagttaagtacgggtataagggtaaacgtttcggaacggggtactaacgtaaacgtttaccgttacgaaaccgaacgacgggtaccttacgaaccgtacccgaccggggaccaacgtaacgtcccgttaaacgtacgggtaaactagggaaacggtaacccgtaggaagtaacgtacggaacgacgacggtaccaaactaattagtttacgttgacggtacggacggtaacgggtgggggtacttaggtttcgtaacgtaaacgttaccttaaaatttacgtttaactttacgtttacgttacgggtaaccgttcggtacggggtaaaccgtaaacgggaccgttaccgggtacccgtaaccgtccccgacccgttaaccggtaccccg

SEQ ID NO: 406170 - DNA, 727 bp, Homo sapiens
  misc_feature: GZ8MTXP02JF1A0.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctcgtggttactagtttttccgacttatagtatcaggttgggtgcgacacggcccctggacaagggtctgagtggatgggatggggccgtaccttcggactaaacggaaagagtgggagtagtggtacgaggtaaatttcgaagggtcagtaaatttacccgtgaaccctacagaacttcgaactaccgagggtccaaacacgaccctaacgttacggtaaactaggaacggtaaacccgtagtaacgaaagtacgggaacgaccgaccgaaccgtaacctaaagttaacttagttacggttacggaccggacggtacggttacgggggacttaaggtttaggtaacgtacgttaaaccgttaacttaaagtttaaacgtttaaccgtttacgtttacgggtaccgttccggtaaggggtaaccggtaaaacgggaccccgtaacggtaccccgtaacggtcccgttaacccccggtacgtacccccg

SEQ ID NO: 406171 - DNA, 687 bp, Homo sapiens
  misc_feature: GZ8MTXP02HLE93.21.67.G01.1.454.CMB.2.raw
  modified_base (217)..(217): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgagtgaagagcgtgggcctggngaggtctcctgcgagggcctgtggttactcgttttccgattagtagtatcgtaggttggtgcgacgcggtccgttaggacgaaggtcttaggagtggaagtgggagtcgggccgtaccgttcgacgaaacggaaagacgtagggagtgtggacgtaaggtaacgtttagacgggactaaagtaactttaccgtagaacccgtaagacgtaccttacgacgtacccgacgggaacaccgtacgtaccttacgtaacggacgtacggaacgtaacgtagaaggacgtaacgggaaccgacgacgaaccctaagtaagttacgtttagtacggtacgacggtaccggtagggtacgggtacgttagtttacgtacgtacgtacttaactagtttacttacgtttgtacgtacgtacggtacggacgtaaacggtcgaccggttaccgaccgtttcccgaccgtaccgaccccg

SEQ ID NO: 406172 - DNA, 782 bp, Homo sapiens
  misc_feature: GZ8MTXP02FNDSJ.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctcggtgaaggtctcctgcgagggcctctggttactagttttccgactatagtatcaggttggtcgcgacgacggccccgttggacgtaagggtctttaggaggtgggagtaggggtagtcggggcccgtaaccgttcgaccgaaacggaaagagtcgggagtagtacggtacgtaggtaatttcggacgggctaagtaatttacccgttagaacccgaacagacctacgtacgtccccgaacggggaccaaccgtacgtacccgttaacgttaacggggtaaactacgggaaacggtaaacccgtagaaacggtaaacgtacggggaaccgaaccgaccgggaacccaacgtaaattacgttaagttgggtacgccggtacgggaagggtggggtacgttagttttaggtacgtaaaactttaacgttaactttaactttacgttttaaaccgttccgtttaacgggtaccgtttacggtacgggggaaaccgtaaaaccggggtaaccccgtacgggttaccccgtaaacccggtttccccgtacccccgaaccggtttccccccg

SEQ ID NO: 406173 - DNA, 756 bp, Homo sapiens
  misc_feature: GZ8MTXP02JFSRU.21.67.G01.1.454.CMB.2.raw
  modified_base (357)..(357): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctcggtgaaggtctcctgcgagggcctgtgttactacgttttccgactattagtattcgtaggttggtgacgacgcggtcccgttggacgaagggtcttggagtggagtgggagtcgggccgtaccgtcgacgaacggaagngtaggagtagtggtacgaggtaacttggacggtacgaagtaacgttacgttacgaccgtacgacgtactactaccgtaccgaccgggacacgacggtaccctagtacggaacgtgaacggacctagaagaacgtacggacgaaccgacggacctacttaattagtttacgttacggacggtccgagggttacgggtcggggttaacttaggtttaacgtaacggtaaacttaacccggtttaatttaagttttaacgtttttaaacccgtttcgtttacggggtacccggtttaacgggtaaccggggtttaaacggaaaacccgggggtaacccgttaacccgggggttacccgttaaacccccgtccctttacccccgggtaaaccgttacccccgg

SEQ ID NO: 406174 - DNA, 786 bp, Homo sapiens
  misc_feature: GZ8MTXP02F34YP.21.67.G01.1.454.CMB.2.raw
  modified_base (281)..(281): a, c, t, g, unknown or other
  modified_base (286)..(286): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctggtgaaggtctcctgcagggcctcgtggttactagttttccgacttatagtatcgaggttggtncgacnggtcccttggacgaagggcttggacggtggagtggggagtcggggcccgtacgttcgacgaaacgggaaagacgtagggtagtagttcgggtacgaagggttaaactttcggaacggggtacctaaaggtaacgtttaccgttacggaaacccttaagacgtactactaacgttacccggaaccgggaccaaccgtaacggtcccgttaacgttacgggaaacctacgggaaacggtaaacccgttaggaacggtaagtacgggaacgaaccgaaccggaccctaaacgaacgtttaagtttagttacggtacgggaccgtaccggggtaggggtacgggggtacctttaaggtttaggacgttaaaccgttactttaaccttaagttttactttactttacggttacggtaccgttacggtacgggggttaaacgaaaacggggttacccgaacggggttacccaacccggttacccgtaccccggtaccgtacccccg

SEQ ID NO: 406175 - DNA, 724 bp, Homo sapiens
  misc_feature: GZ8MTXP02FU6XK.21.67.G01.1.454.CMB.2.raw
  modified_base (276)..(276): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaggtctctgcaggcctgtgttactgtttccgatatagtatgagttggtgcgacncggtcctggacgaggtcttggaggtggagtgggagtcggggccgtaccgttcggaacgaaacgggaagtacgtagggagtagtggtacgaaggtagtttacgaggggtactaagtaacttacgttacgaacccaacgtacgacctacgacgtacccgacgggaccacgacgtacctacgttacgaacgtacggaacggtaacctaggaagtaacgtacgggaacgtaccgaccggtacctaacgtaacgttacgtttagttacggtacgaccgggtacgggtacggggtacggggtacgtttaggtttacggtaaacggtacctttaacgttaagtttaacgtttaactttaaccgtttacggttacgggtacggttacggtacggggaaccgtaaaccgggtaccgtaccggtaccctacccgtacccgtacccgacgtaacccccg

SEQ ID NO: 406176 - DNA, 708 bp, Homo sapiens
  misc_feature: GZ8MTXP02JNJG0.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactacgtttttccgacttataggtatcgtaggttggtgtcgacacggtcccttggacgagggcttggagtggagtgggatcggggtccaccgttcgacgaaacggaagagtggagtagtggtacgagtaattcgagggtacaagtaacttacgtacgaccagacgactcgactaccgacggacacacgtaccctacgttacggaacgttacggaacggtacccgtaggaaggaaacgtaccgggaacggaccgaccggaccctaactaagttattaacgtttcgggcggtaccgggtaccggtaggggtcgggggtacttaggtttaaggtaacgttacctaactttaaccgtttagtttactttacgtttcgttacgggtacccgttaggtacgggggtaacgtaaacgggacccgtaaccgggtctacccggtacccgtaccccgaccgtcccccg

SEQ ID NO: 406177 - DNA, 737 bp, Homo sapiens
  misc_feature: GZ8MTXP02GIZYU.21.67.G01.1.454.CMB.2.raw
  modified_base (250)..(250): a, c, t, g, unknown or other
  modified_base (340)..(340): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttacngttttccgactatagtatcagttggtgcgacaggcccttggacagggcttgagtggatgggatgggccgtaccgttcgacaaacggaagngtagggagtagtggtacaaggtaatttcggaaggggtcaagtaactttaccgttaggaacctacgagactacacgtacccgaacggggcaaccgacgtacccttaagttacggaaacgttaggaacgggtaaacccgtaggaacggtaaacgttacgggaaaccggaccgaaccggggacccaaaccgtaacgttaaagtttaacgttagggtacgggtaccgggaccggtaagggggtacggggggtaccttaaggtttacggtaagggtaaacccttaacgtttaacttaacgtttagtttaaacctttcggttacgggtacgttacgtagggggacgtaaaacgggtacccgtaacggtacctacccggtacccttaccccgacggtacccccg

SEQ ID NO: 406178 - DNA, 793 bp, Homo sapiens
  misc_feature: GZ8MTXP02JXKBI.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcaggcctctggttactgttttccgacttatagtatcaggttggtgtcgacaggccccttgggactaagggtcttaggacgtaggaagttggggacgttcggggtcccgtaccgttccggacgtaaacgggaaaagagtacgggtagtaacgtgggtacgtacggtaaatttcggacgggtaccgtaggtaaacgtttaaccgtttacgaacccgttaacgacgtaaccgtacctaaacgttcccggaaccggggactaaaccgtacggtacccttaacgttacggaaaacgttcggaaacggtaaaccctaggtaaaaagtcgggaaacccgaacgacccgggaacccaaccggtaatttaacgtttaacgtttggaacggttcggacggttaacggggtcgggggtacctaaaggttttcgtaaacggtaccttaaccgtaactttaatttaaaacgtttccgttactttacggggtacttaccggtaggggtaaccgttaaacgggggaaccttaccggtacgaccccgttccgaccccgtaaccgtccctaaacccg

SEQ ID NO: 406179 - DNA, 901 bp, Homo sapiens
  misc_feature: GZ8MTXP02GIOL8.21.67.G01.1.454.CMB.2.raw
  modified_base (290)..(290): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctcggtgaaggtctccgtgcgagggcctcgtggttactagtttttccgactatagtatcgtagttgggtgcgacgnggtcccttggacgaaggcttgaggtggagtgggagtcggggacccgtaccgttcggacgaaacgggaaagtacgtagggagttaggttggtacgtaaggggtaactttacggagggtactacgggtaaaattacccgtttacgaaccctaacgtacggtcctaactaacgtacccgaacggggtactaaccgaacgtacccttaacgttacggtaaacgtacggtaaacggtaaacccgtaaggtaacggtaacgttaacggggacccgtaaaaccggacccggggtaaacctaaccgtaaaacgtttaacgtttaaggtttacgggtaaccggggtttaccgggaacggggtaccgggggtttaacggggggtaacccgtttaaacggttttgggtaaaaccggggtttaaacgttaaaaccctttaaaacggttttaaacccttttaaacggtttttaaacccgtttacggtttaaacgggggttaccggttttaccggggtaacgggggttaaacccgtaaaaaaccgggggtaccccggttaaccggggttaaccccgtaacccccggtttacccgtaaccccccggttaccggttaaaccccccgg

SEQ ID NO: 406180 - DNA, 799 bp, Homo sapiens
  misc_feature: GZ8MTXP02I2PGM.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctccgtgcgagggcctcgtggttactagttttccgactatagtatcgaggttgggtgtcgacacggccccgttggacaagggtcttaggaggtggagtggggagtcggggcccgaccgttcgacgaaacggaaagagtagggagttagtcggtacgtaaggtaaacgtttcgaacgggtaccgaaaggttaaactttacccgttaacggaaccctaacgaacggtaaccttccgaaacgttacccccggaaccgggggtacccaaaccggtaaccgtaccccgttaacgttaccggaaaccgttacgggaaaacggtaaacccgttagaaacggtaaaggttacggaaccggaaacgaccggaaacccaaacgttaacttaagtttacgttaggtacggaccggtaaccggtaggggttacggggtaccttaaggtttaggtacgttaactaaccgtttaagttacgttttaaattaccgtttacgttacggtacgttacggtacgggaacgtaaaaccgggacccgtacggtacccgtacccggtccttaccccgaccggttaacccccg

SEQ ID NO: 406181 - DNA, 662 bp, Homo sapiens
  misc_feature: GZ8MTXP02I3M5O.21.67.G01.1.454.CMB.2.raw
  modified_base (407)..(407): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctcggtgaaggtctcctgcagggcctcgtggttactagtttttccgactatagtatcgagttggtgcgacgaggcccttggacaagggcttggaggttggagtggggagtcggggcccgtaccgttcgacgaaacggaagagtgggagtagtaggtcgaggtaatttcgaggtacagtattacctagaccacngactcgactaccgacgggacacgacgtacctacgttacggaacgtacggaacggtaaccgtacgaaggtaagtacgggaaccgacgacggaccctaactaagttagtttagttcgtacggaccgtcggaagggtcggggtactagtttgtagaactacgttacttagttaattaccttagttacggtacgtacggtacggggacgtaaagggacccgtacggtaccgacccgttaccgaccccgacgtacccccg

SEQ ID NO: 406182 - DNA, 754 bp, Homo sapiens
  misc_feature: GZ8MTXP02IDKWL.21.67.G01.1.454.CMB.2.raw
  modified_base (220)..(220): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctggngaaggtctccgtgcgagggcctcgtaggttactagtttttccgactatagtatcgtaggttgggtgcgacacggtcccttaggacgaagggcttggaggtggagtgggagtcgggccgaccgttcgacgaacggaaagagtaggagtagtggtagaggtaattcggacggtacaaggtaacttaccgttgaaccaacgagaccttacacgtcccgaacgggcaacgtacgtacccgtaacgttaggaaacgttacggaaggtaaacccgttaggaaacgtaacggttaacggaacggaacccgaccgggtaccaactaatttaacgtttacgttaggtcgggtaccgacgggtaggggtacgggggtacttaggtttacggtacgttaaaaccgtaacgtttaccttagttttaaacgttacctttaccggtttaggtaccgttacgggtaaccggggtaacgtaaaaccgggggtaccgtaacccggttacccgtacccgttaccccgtacccccgttaacggtacccccccg

SEQ ID NO: 406183 - DNA, 690 bp, Homo sapiens
  misc_feature: GZ8MTXP02IJZED.21.67.G01.1.454.CMB.2.raw
  modified_base (242)..(242): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctctgcacgggcctntggttactgttttccgactatagtatcagttgggtgcgacaggcccgttggacaaggcttgagtggagtgggatgggccgtactcgacgaacggaagagtagggagtagtaggtcaggtaatttcgaacggcgagtaacgtttaccttgaacccaacaggtacctacgaactcccgaaccggggacaccaaacggtccctaaacgttcggaaaccctagggtaacggaaacccgttaggaacggtaaagtcgggaacgaaccgacggacccaacgtattaacgttattggtacggacgacggtaggggtaggggcgttagtttggtaaatacgtacttaacttagtttaacttacgtttcgttaggtacggttacgacgggggtactaaacggggtaccgtaaccggggtacctaccccggtaccgtcccccggtaaacgtacccccg

SEQ ID NO: 406184 - DNA, 785 bp, Homo sapiens
  misc_feature: GZ8MTXP02GK2F9.21.67.G01.1.454.CMB.2.raw
  modified_base (586)..(586): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagaagccgtgggccgtggtagaagtctccgtgcgacggcctcgtggttactagttttccacttatagtatcgtaggttgggtgcgacgtacggtccgttaggacgtaaggtcttaggaggtaggaggtggggacgtcggggtccgtaccgttcgaccgaaaacggtaagtagtaggtaggtaggtcgtacgtaaggtaagtttcggaagggtactaacgtaacgtttaaccgttacgaaacctaacgacgtactacgtaaaccgtccgtaccgggacacgtaacgtccctaaggttacggaacgtacggaaacggtaaccgtaggaacgtaaggtacggaaaccgacgaaacggtacctaaacgttaacgttaagtttacggnggttaccgggacggtaccggggtagggttccgggggtaattttagggttagtaacgttaaacgttactttaaacgttaacgttttactttaaccgttcggtttaaacggtcggtttacgggacggggtaaaccggtaaacggggtacccgttaacggtacccggtacccgttcccgtaccccggttaacgtacccccgg

SEQ ID NO: 406185 - DNA, 771 bp, Homo sapiens
  misc_feature: GZ8MTXP02G9HY3.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctgtggttactagttttccgatatagtatcgtaggttgggtgcgacgtacggccccgttaggaacgtaacgggtcttaggaggtggagtggggagtcggggcccgtaccgttcggacgaaacggaaagacgtagggtagtagtcggtacgtaggtaaacgttcggagggtacctaaaggtaactttaaccgttaggaacccaacgtacggtaaccttacaaccgttacccggaaccggggtaccaaacgtaccggtacccttaacgtacgggtaacttacggaaacggtaaccctaggaacgtaacgtacgggaaccacgacggaccaacgtattaacgttagtcgtggaccgtaggaggtcgggggtacttaaggtttacggaacgttaaccgttaaacgtttaacgttaaacgttttactttaacggtttacgtacgggttaccggttacggtacggggtaaaacggaaaccgggtaccgtaaccggttacccgtacccggtacccgttaccccgaacgttacccccg

SEQ ID NO: 406186 - DNA, 694 bp, Homo sapiens
  misc_feature: GZ8MTXP02FNTF1.21.67.G01.1.454.CMB.2.raw
  modified_base (275)..(275): a, c, t, g, unknown or other
  modified_base (341)..(341): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggcctcggtgaaggtctctgcgagggcctgtggttactagttttccgatatagtatcaggttggncgacaggtcctaggacgaaggtcttggagtggagtgggatcgggcctaccgtgacgaaacggaagngtgggatagtggtacgagtaacgttgaggtcaagtaacttacgtgaaccacgacgtactcctaagtacccgaacgggcaacgacgtccttaccgtaggaaactcggaaggaaccgtaggaacgtaagtacggacgaaccgacgggaaccctaagaagtttaacgttagttacgacgggaaccggtccggtaagggggtagggggtacctttaaagggtttcgaaaggtaccgttaactaacggtttatttacgtttaccgtagttacgggtacgtacggttaagggggaaccgtaaaacggacccgtaacgggtttacccacccggttacccgtaccccgcggttaacccccg

SEQ ID NO: 406187 - DNA, 816 bp, Homo sapiens
  misc_feature: GZ8MTXP02JOEK7.21.67.G01.1.454.CMB.2.raw
  modified_base (184)..(184): a, c, t, g, unknown or other
  modified_base (220)..(220): a, c, t, g, unknown or other
  modified_base (275)..(275): a, c, t, g, unknown or other
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtncagtctggacctgaggtgaagagccgtgggcctggngaggtctctgcgaggcctgtgttactagttttccgatatagtatcgtaggttggngtcgacgacggtccccttaggacgtaagggcttaggaggtggagtgggagtcgggccgtaccgttacggacgaaacggaagagtagggtagtagtggtacgaggtaacgttcgaggtacagtaacttacgtacgaccaactcggactacacgtaccgaaccgggtccaaacgtaccgtaccttaacgttacggtaaccgttacggaaacgtaacccgtaaggaaccgtaaggttacggaaaccgacgaacccggactaacgtaattaaggtttacgttagggtacgggttacccggaagggttaccgggggtacgggggttaacgttaggttttaacggggtaaacttaaacccggttaagtttaaactttaaaccgttttaacggtttaaccccgttttagggtttaaccggttaccggggttaccggtttaacggggggaaaacccggttaaaagggggaacccccggtaaccggggtttacccccgtaaacccgggttacccccgttaacccccgggtaaccgttaaacccccccggg

SEQ ID NO: 406188 - DNA, 802 bp, Homo sapiens
  misc_feature: GZ8MTXP02FZL6R.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtgggcctcggtgaaggtctctgcagggcctcgtggttactacgttttccgactatagtatcgaggttgggtgcgacgaggtcccttgggacgaagggtcttggagtggagtgggatcggggcccgtaccgttcggacgaaacgggaaagtacgtagggtagtagtcgggtacggaaaggtaacgtttacggaggggtacctaaggtaaacttttaaccgttagaaaccccgtaagtacgtaaccgtccgtaaacgttaccccgaaccgggggtacaaccggtaacccggtaccctttaacggttacgggtaaaccgttacgggaaacggaaacccgttaggaaacggttaaagacgggaaccgaaccgaaccgggtacctaaactagtttaactttacgttaggttcggacggacggtaggggttacgggggtactttaaggtttacgtaacggtaaccttaacgttaacctttaagtttaaccgtttacgtttacgtttagggtaccgtttacgggtacgggggtaacgtaaaacggggcccgtaaccggttaccgtaccccggttccctaccccggtaccgttacccccg

SEQ ID NO: 406189 - DNA, 645 bp, Homo sapiens
  misc_feature: GZ8MTXP02ITNOW.21.67.G01.1.454.CMB.2.raw
  modified_base (280)..(280): a, c, t, g, unknown or other
  modified_base (370)..(370): a, c, t, g, unknown or other
  modified_base (386)..(386): a, c, t, g, unknown or other
  modified_base (434)..(434): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcatcagcaacaggtgcccactcccagactcaactggtgcagtctggacctgaggtgaagagcgtgggcctcggtgaggtctctgcaggcctcgtggttactgttttcgactatagtatctaggttgggtgcgacnggtcccttgggacaaggcttgaggtggagtgggagtggggcctaccgttcgacaacggaaagagtaggagtatggcaaggtattgagganagtaactactgaccangactcactccgacggcaacgcgaccttagtgaacgtgaaacgtaccgngaacgaagacggaacgacacgacctaacgtaatagtttagtcggtagacggcggtaggggtacggggtacttaggtttaggtaacgtacgttaaaccttaagtttaactttaagtttaacccgttaggttacggtacgtacggtaggggttaaccgaaaacgggtccggaaccggtttccacccgggtcccttaccccgacgtaacccccg

SEQ ID NO: 406190 - DNA, 774 bp, Homo sapiens
  misc_feature: GZ8MTXP02GJIGV.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctctggttactagtttttccgactatagtatcagttgggtgcgacaggcccttggacaagggcttgagtggatgggatgggcgaccgttcgcaacggaagatgggagtagtggtacaggtaagtttcgaggggaccaggtaaactttacccgtttaggaacccaacgtacggaccttacaacgttcccgaaccgggggtcaaacgacgtaccctacgtttacggaaacccttaggaacggaaaccccgttaggaaggtaaacgtacggggaacgaaccgaccgggaccaacaaagttaactttaagttacggtacgtaccgggaccgtaaaggggttcggggggtacctaaggttttacggtaaggtaacccttaaacggttaccgtttaaaagttttactttaaaccgttttcgggttacgggttaaacccggttccgggttaggggggttaaccgaaaaacgggggtcccggttaaaaccgggtcccggtaaaccccggtcccgtttaccccccgaaacgggtttcccccccg

SEQ ID NO: 406191 - DNA, 557 bp, Homo sapiens
  misc_feature: GZ8MTXP02JBVSC.21.67.G01.1.454.CMB.2.raw
  modified_base (242)..(242): a, c, t, g, unknown or other
  modified_base (338)..(338): a, c, t, g, unknown or other
  modified_base (381)..(381): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctcctgcagggcctntggttacagtttttccgactatagtatcagttgggtgcgacaggccccttggacaagggcttgagtgatgggatgggcgacttcgcaacggaaagntggagtatggtcaggaatttcaggggcagaatacttgaccacngactcatccacgggcacagcctacttggaactgagaacctagagaatggacgacacggccacaatattattgtgcgcgagtgggggcagttgtagatactaatattattacttacttggacgttcgtggggtacgaaaagggtaccgaacggtcgaaccgtctccccgagtacccg

SEQ ID NO: 406192 - DNA, 674 bp, Homo sapiens
  misc_feature: GZ8MTXP02HV3PM.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactccccagactcaactggtgcagtctggacctgaggtgaagaagccgtggggcctcggtgaaggtctcctgcgagggcctctggttactagtttttccgactatagtatcaggtttgggtgcgacgacggtcccgttgggacgaaagggcttagaggtggagtgggagtcggggccgtaccgttcgacgaaacgggaagagtaggagtatggtgaggaatttcgaggcaagtaattaccgttcgaccacgagtaactcagtccgaacggcaacacgcctacgttacggaactgaacggtacctagagtaagtacggacgacacggacccaacgtaacttagtttagttggtaggaccgtacggtaggggtacgggggtcttaggtttagtacgtacgttaacgttactttaattttactttaacgtttcgtttgggtaacgtcgggttacgggtacgaaacgggtaccgtaaccggtaccgtaccgtacccgtccccgacggtacccccg

SEQ ID NO: 406193 - DNA, 721 bp, Homo sapiens
  misc_feature: GZ8MTXP02II1XZ.21.67.G01.1.454.CMB.2.raw
  modified_base (243)..(243): a, c, t, g, unknown or other
  modified_base (282)..(282): a, c, t, g, unknown or other
tcagtcgtcgctcgcacgaccggtgctcgatttagagtatacatattgggtttggggacccaaaaaaccacacccctccttgggagattcccctagatcacagcccctcaccatggactggacctggagcattccttttcctggtggcagcagcaacaggtgcccactcccagactcaactggtgcagtctggacctgaggtgaagagccgtggggcctcggtgaaggtctcctgcgaggctntggttactagtttttccgattatagtatctaggttgggngcgacaggcccttaggacaagggcttgagtggatgggatggggacccgtacgttcggacgaaacggaaagagttagggagttaagtggtacgaaggtaaactttcgaaggggactaagtaatttaccgttagacccacgagtacctacacgttacccgaacgggtcaaacgtacgccttaacgtacggaacgtacggaacggtaaacccgtgaaacggtaagtacgggaaccgaacgaacggaccaaacgtagttaacttagttggtagtacccgaggtacgggtggggtacgttaagtttggtaacgtaattaccgttaaactagttttaactttaccgtttacgtacggttaccggtacgttagggggaacctaaaacgggggtaccctaaccgggtaccgtaacccggttacccgtaaccccgtacggtacccccg

SEQ ID NO: 406194 - DNA, 829 bp, Homo sapiens
  misc_feature: GZ8MTXP02J1OY2.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgagggcctcgtggttactagtttttccgacttatagtatcgaggttgggtgcgacaggcccttggacaaggcttgagtggatgggatgggccgtaccgttcgacgaaacggaaagacgtagggacgttagtgggtacgtaagggaacttttaccggaaggggtacctaagtaaacgttttacccgttacggaacccgaacgtagggaaacctttacgaaccgttacccgaaccgggggaccaaaccggtaaccggtacccgttaaacgttttacgggaaaccgtttacggggaaaccggggtaaaaccccgttgggaaaggtaaacggttaaccggggtaaaccggtaacccgggaaacccggaccccggtaaacctaagttaaccggtttaacgtttaagggttcgggaccggtaccggtaaagggggttcgggggggaaccttaggtttttaacggtaacggtaaacgtttaaccgttaacgttaactttaacttaccgtttacgtttacgggtacgttacgggttaaggggaaccgaagggtaacccgtaacggttaccgtaacccgttccgttaccccgacgtacccccg

SEQ ID NO: 406195 - DNA, 679 bp, Homo sapiens
  misc_feature: GZ8MTXP02IYCZE.21.67.G01.1.454.CMB.2.raw
  modified_base (240)..(240): a, c, t, g, unknown or other
  modified_base (279)..(279): a, c, t, g, unknown or other
  modified_base (352)..(352): a, c, t, g, unknown or other
  modified_base (405)..(405): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctggtgaggtctcctgcagggcctntggttactagtttttccgattatagtatctagttggggncgacaggtccttggacaagggcttggagtggagtggggagtggggccgtaccgttcggacgaaacggaaaggntagggagtagtgggtcaaggtaatttcgagggcagtaagttacttaggaccanacgctcacgtcccgacggggacaaccgcgtacctacgttaggaactggacggtaaacccgtaggacgtaagtcggaaccgaccgaaccgaccgaactaacgttaagtttactttacggttcggacgggtaccgggtaagggtcgggggttactaaggttttgtaacgtacgttacttaactttatttactttacgtttcgttaacggtcgtacggtagggggtacgaaacggggacctaccgggtctacccggtccgtacccgtacggtccccg

SEQ ID NO: 406196 - DNA, 711 bp, Homo sapiens
  misc_feature: GZ8MTXP02JCQV1.21.67.G01.1.454.CMB.2.raw
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggcctgaggtgaagagcgtgggcctggtgaacggtctcctgcgacggcctctggttactacgttttccgactatagtatcaggttggtgcgacgacggtccgttagggacgaagggtcttggaggtaggagtgggagtcgggccgtaccgttcgacgaaacggaaagacgtggacgttagtcggtacaggtacttaggacggtacaagtaacttaccgttacgaaccacgcgtaactacgactacccggacggtaccacgacgtaccgtaacgttacggtaacgtcggtaaacggaaccgtagaacggtaacgtcggaacgaccgacggaccctaacgtattagtttaagtcgttacggcggtagggtacgggtacggggtacgttaggtttagtacgggtaacttaacgttaacttaatttacgttacgtttacgtttacgggtcgtacggggtaacgggtaccggaaaacggggtcctaacggtcccgtaacccggtccgtaccccgacgttaccccgg

SEQ ID NO: 406197 - DNA, 697 bp, Homo sapiens
  misc_feature: GZ8MTXP02G2O8D.21.67.G01.1.454.CMB.2.raw
  modified_base (401)..(401): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagcctggggcctcggtgaaggtctccgtgcgagggcctcgtggttactagtttttccgactatagtatcgagttggtgcgacaggcccttggacaaggcttgagtggatgggatgggccgacgttcgacgaaacggaaagagtgggaagtagtggtacgaggaatttcgaaggggcagtaattaccttagaaccanagactcactccgacgggacaacgacgtacccttacgttggaaacgtaggaacggaacccgtagaacggtaagacgggacgaccgacggaccaaacaagttaagttaagtgtacggacggacggtaagggtgggggtactaaggttttacggtaacgtaacgttaaacgttaaccgtttaagtttaaactttaaccgtttacgtttacggtaaccgttccggtagggggtaaccgaaaacggggtaaccgtaaccgggttaccgaaccccgttaccgttacccccgacgtacccccg

SEQ ID NO: 406198 - DNA, 688 bp, Homo sapiens
  misc_feature: GZ8MTXP02FKHOA.21.67.G01.1.454.CMB.2.raw
  modified_base (279)..(279): a, c, t, g, unknown or other
  modified_base (284)..(284): a, c, t, g, unknown or other
  modified_base (399)..(399): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagttttccgatatagtatcagttggtncgacnggcccttggacaaggcttgagtggatgggatggggccgaccgttcgacgaaacgggaaagagtggagtagtggtacaggtaaatttcgaaggggcagtaattaccttgaaccaanagctacacgtccgaccgggcacgacgaccctacgttaggaaactaggaaggaacccgtaggaacgaaagtcggaacgacgaaccggaccaaacaaattattaagtttagtaggtacggacggtaaggtgggggacgttaagtttagggtaagtaacttaaacgtaacgtttaagtttaaacgttttaacgtttacgtttacgggtaccgtttacggtacgggggtaaccgtaaaacggggtacccgtaaacgggtccgtaaccgtacccgtaccccgacggtacccccg

SEQ ID NO: 406199 - DNA, 876 bp, Homo sapiens
  misc_feature: GZ8MTXP02FXOT8.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcgacgggcctcgtggttactagttttccgactatagtatcgaggttggtgcgacgacggtccccttggaacgaagggtcttggagtggagtgggagtcggggacccgtaccgttcgacgaaaacgggaagagtagggacgtagtacggtacgaggtaactttcggacggggtactaagtaacgtttaacccgttagaacccccgtaagtacggtaccgtacgtaacgttacccgaaccggggtacaaaccggtacgtaaccccgttaacggttaaccgggtaaacgtaacggggtaaaccgggtaaacccgttaagggaaccggtaaagggttaccgggaaaccggtaaccgaaccggggttaacccaaaacctaagtttaaaccgtttagtttacgggttacggaccgggtaccggggtaggggttaccgggggtaactttacggttttaaggaaacgtttaacgttaaaacctttaccggtttaagtttaaacctttttaccggtttaaccggttaggggttaaaccggtttaccggggttaccgggggaaacggtaaaaacccgggggttaacccggtaaccggttaccccggtaaacccccgtttcccgaaccccccggtacgttaaacccccccggg

SEQ ID NO: 406200 - DNA, 738 bp, Homo sapiens
  misc_feature: GZ8MTXP02JPA06.21.67.G01.1.454.CMB.2.raw
  modified_base (578)..(578): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctggtgaacggtctcctgcgacgggccttgtggttactagtttttccgaacttatagtatcgtaggttgggtgacgacgacggtcccttagggacagggtcttggagtggagtgggagtcggggtaccgtaccgttcgacgaaacggaagtacgtagggaggtagtgggtacagggtaatttcgaacggggtacaaggttaaacttaccgttacgaacccgacgaggtaccctacaccgtacccggacgggactaccgacggtacccttacggttacggaacgtacgggacggtaaaccgtaggaaccgaaggtacgggaaacgacggaccggaccaaacgtagttacttaaggtgtacggnggtacggtagggcggggtctagtttaggtaacgtacgtaaccgttaagttactttaaacgttcgtttaacggttcggtacggttacgggtaggggaaccgttaaaaccggggaccgttaccggggtaccctaccggtacccttacccggacgtacccccg

SEQ ID NO: 406201 - DNA, 744 bp, Homo sapiens
  misc_feature: GZ8MTXP02F9AVR.21.67.G01.1.454.CMB.2.raw
  modified_base (286)..(286): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaaggaagccgtggggcctcggtgaaggtctccgtgcgagggtcctcgtggttactagttttccgattatagtatcgtagttgggngcgacgtacggcccgttggaacgaagggtcttaggaggtggagtggggagtcggggcccgtaccgttcgaccgaaaacggaaggaggtaggaggtagtcggtacgaaggtaaatttcggaagggacaacgtaattaccgtagaaccacgagactcgaactaccgacggacacgtacgcctaacgtggaactagaaggtaaccaggtacaaggtacggaaccgaaacgacggtaacccaactaaagttagtttaagttggtacggacgggtggtaacggggtacggggtacgtttaacgttaggtaaacggtacgttaacgttaaacgtttagtttaaattttaccggtttaggtttaaccggtacgggttaccggtacgggggtaaccgaaaacggggtaaccccggtaccgggttacccgtacccggttaacccgtacccccgtacggtaacccccg

SEQ ID NO: 406202 - DNA, 794 bp, Homo sapiens
  misc_feature: GZ8MTXP02JRJR9.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctcctgcagggcctcgtggttactagttttccgactatagtatcgtaggttgggtgcgacacggtcccttaggacgaagggcttggaggtggagtggggatcggggcccgtaccgttcgacgaaacggaagagtagggagttagtggtacgaggtaatttcgaaggggactaaggttaaactttaccgttacggaacccaacgacgtacctacgtaacgtacccgacggggtaccaaccgtaacgtacccttaacgttacggaaaccgtacggaaaccggtaacccgtaggaacggtaaacggttacgggaaccggaaaccgtaacccgggaccctaaacgttaaatttaacgtttagtttacgggtacgggtaccggtaccgggtaagggggtacggggggtactttaaggttttagggtaaacgtaacgttaacgtttaactttaacgttttaacgtttaacgtttacggtttacgggtaccggttacggttacggggaacggaaacggggtacccgtaaccggtaccgtacccggtacccgtaccccggtacgtaacccccgg

SEQ ID NO: 406203 - DNA, 735 bp, Homo sapiens
  misc_feature: GZ8MTXP02HEMJ5.21.67.G01.1.454.CMB.2.raw
  modified_base (590)..(590): a, c, t, g, unknown or other
tcagtcgtcgctcgcacgaccggtgctcgatttagagtatacatattgggtttggggacccaaaaaaccacacccctccttgggagattcccctagatcacagcccctcaccatggactggacctggagcatcccttttcctggtggcagcagcaacaggtgcccactcccagactcaactggtgcagtctggacctgaggtgaagaagccgtggggcctcggtagaacggtctccgtgcgagggtcctcgtggttactagttttccgactatagtatcgtaggttggtgcgacgacggtcccgttagggacgtaagggtcttaggacggtggagtggggtatcgggggacccgtaccgttcggaaccgaaaacgggaaagaggtagggaggttagtagggtacgtaaggtaacgtttcggacgggtacgaagtaaacttaccgtaacggaacaacgacgacctacgaactacccggaacggaccaacgacgtaccgttacgttacggaaactagggaacggtaaccgaggtaagaagtacgggaaccgaccgaccggaccactaagttactttagtcggtacggacggnggtacggggtggggtacttaggtttagaacgtacgtacttaacgttaatttactttacgtttacggtacggttacgtacggtcgggaaacggtaaccgggtaccaacggggttcctaccccgtaccgtaccccgacgtacccccg

SEQ ID NO: 406204 - DNA, 688 bp, Homo sapiens
  misc_feature: GZ8MTXP02JAGJL.21.67.G01.1.454.CMB.2.raw
  modified_base (221)..(221): a, c, t, g, unknown or other
  modified_base (280)..(280): a, c, t, g, unknown or other
  modified_base (643)..(643): a, c, t, g, unknown or other
  modified_base (660)..(660): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggngaaggtctccgtgcgagggcctcgtgttactgttttccactatagtatcgtaggttggngacgacacggtcccgtaggaccgaggtcttggagtggaagtgggagtcggggaccgtaccgttacggacggaaacggaaaggagtagggagttacgtagggtacaagggtaatttacggaacgggtactaagtaagttacccgttagaacctaacacggtaactccacgtaccgaacgggtccaacgaccgtaccgtaccggttaggaacgtacggaacggaacctaggagaacgtaacggacgaaccgacggaccctaaagtcttaacgtttaagttcgaggtaccggacggtaggggtaggggtcttaaggtttagacgtaaccttagtaacttagttattacgttcgttagacgttacgngggtaactaacgggacnccggtcacgtcccgtacccaggtacccc

SEQ ID NO: 406205 - DNA, 736 bp, Homo sapiens
  misc_feature: GZ8MTXP02FZOQT.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcgagggcctcgttggttactagttttccgattatagtatcgaggtttggtgcgacgtcggcccttggacgtaagggtcttagaggtggagtggggatcgggtcccgtacgttcgacgaaacggaagacgtgggagttagtgggtacgtaaggtagtttcggaggggtactagtaaacttacccgttagaaccctacgagtacctacgtaactacccgtaccgggacaaccgacggttaccctaacgtttaccgggaaacgtagggtaaaccggtaccctaaagggaacgaaacggttaccggaaccgaacccggaaccggtaccaaacgttaatttaccggttagttcgggttacgacgggtacggtaggggtcggggtatttaggttcgtaaacgttaacctaggtttacctaatttttaacgttcgtttacgtcggttacgtacggtaggggaacgtaaacggaccgtacgttaccgccgttacccgccgacgtaaccccg

SEQ ID NO: 406206 - DNA, 746 bp, Homo sapiens
  misc_feature: GZ8MTXP02HXDDW.21.67.G01.1.454.CMB.2.raw
  modified_base (278)..(278): a, c, t, g, unknown or other
  modified_base (591)..(591): a, c, t, g, unknown or other
tcagtcgtcgctcgcacgaccggtgctcgatttagagtatacatattgggtttgggggacccaaaaaccacacccctccttgggagattcccctagatcacagcccctcaccatggactggacctggagcatccttttcctggtggcagcagcaacaggtgcccactcccagactcaactggtgcagtctgactgagtgaagagccgtgggcctcggtagaaggtctccgtgcgaggcctcgtgtacttagttttccgactatagtatcgtagttggngcgacgacggtcccttaggaacgaaggtattggtaggtggaagtgggagtcggggacccgtaccgttacggacgaaaaggaaaggtagttagggaagttacgtagggtaccgtaaaggtaacgtttacgaacgggacgttaacgtaaactttaccggttacgaacccgtaacgtacgacttaccgtactaccccggaacgggacaaacgtacgtacccgttaagtaccggtaaacgtcggaaacggtaaccgtaggtacggaagtacgggaaccggtacgaaccggtacgactaaagttatttacggttacgnggtacccgaggtagggttggggtacttagttacggtaagtactaacgtttaacgttattttacttacgttacgttcggtaccgtagggtacggaaaaccggtaaccggtaccggtacggtaccgtacccgacccgtaccccgtacgtaacccccg

SEQ ID NO: 406207 - DNA, 784 bp, Homo sapiens
  misc_feature: GZ8MTXP02HSL51.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggctggtgaggtctcgtgcgaggcctgtggttactagtttttccgattatagtatcgtaggttggtgcgacacggtcccttagggacgtaagggtcttggaggtggagtggggagtcggggccctaccgttcggacgaaacggaaagagtagggagttagtggtacgtaaggtaagtttcggacggggtactaaggtaactttaccgttagaacccagacggtacctacgtacgtacccggaacggggacctaactaccggtacccgttaacgttacgggaaacgtcggtaaaccggaaacccgttaggaaacggttaacggacgggaaccgtaccggaacccggaaccctaaacgtatttaacgtttaagttcggttacgggaccggtacgggttaggggtcgggggtacttaaggtttacggtaaacgtaaccgtttaaacgttaactttaacgtttttaacgtttaccgtttacggttacggttacggtttcggtaacgggggtaaccgtaaaacgggtacccgtaaccggttacccgaacccgttccccgtacccccgtacgtacccccg

SEQ ID NO: 406208 - DNA, 710 bp, Homo sapiens
  misc_feature: GZ8MTXP02GEIPP.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctggtgaaggtctcctgcgagggtcctgtggttactagttttccgactatagtatcgtaggttggtgcgacgacggtccgttaggacgaagggtcttaggaggtggagtgggtagtcggggccgtaccgttcgacgaaacggaagagtggagtagtggtacgagtaacgttgacgggacagtaacgttaccgtacgaaccgacgataccgtactacgtaccggacggcaacgacgtacctagtacggaactggaacgtaactaggagtaagtcgggaacaccgacgaccctagttaattacgttgttacggaggcgtcgggtaggggtggggtacttaggtttacggtaacgtaacttaacccgtttagtacgtttttaaacttacgtttttacggtacggttacccgtttggaacgggggtaaaacgtaaaacccggggacccgtaaccggttaccggaccccgtttacccgtaccccgaacgttacccccgg

SEQ ID NO: 406209 - DNA, 784 bp, Homo sapiens
  misc_feature: GZ8MTXP02F2JFT.21.67.G01.1.454.CMB.2.raw
  modified_base (316)..(316): a, c, t, g, unknown or other
  modified_base (358)..(358): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatcctttcctggtggcagcagcaacaggtgcccactcccagactcaactggtgcagtctggacctgaggtgaagaagccgtggggcctcggtgaaggtctcctgcagggcctctggttactgttttccgactatagtatctaggttggtgcgacaggtcccgttggacaagggtcttgaggttaggngtaggggagtggggcccgtaccgttcggacaaacggtaaagngtacgggagttagtacggtcgtaaggtaatttacggacggggtactacgtaaagtttacccgttaggaacccaaccgtaggaacctcgtaagtaccccgacggggaccaacgtaaccgtacctaacgttacggaaacgttggaaacgtaaccgtagaaggtaaagtacggaacgaaccgacgggaaccactaagttaactttaatggtacggacggtacggtacggggtagggggtaccttaaggtttaggtaaaccggtaacgtttaacccgtaaaactttaaggtttaaccttttaacggtttacgtttacggggtaaccggtttacccggtagggggttaaaacccggtaaaacggggtaccccgtaacggggttaaccccgacccggttaccccgttacccccgaccggttaaaaccccccg

SEQ ID NO: 406210 - DNA, 811 bp, Homo sapiens
  misc_feature: GZ8MTXP02H03P9.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtagaagagccgtggggctcggtgaaggtctccgtgcgaggtccttcgtggttacttacgtttttccgacttagttagtatcgtaggttgggtgtacgacgacggtcccgttagggaacgaagggtccttaggaggtggaggtaggggagtcggggcccgtaccgtttcggaaccgaaacgggtaaaaggagtagggaagttagtaggtacgaaggtaagtttacggacgggacgtaaggtaactttaccgttagaaccgactaggaacctactacgtacccgaggggaccaacgacgtacccgttaacgtagtaacgtagggtaaacccggtaaccgttaggtaaacggaacgtaacgggaaccggaaccgaccgggtaaaccaaccggttaattaaacgttttagttacgggttacgaccgggtacgggtaggggtacgggggtaccttaggtttaaggtaacggtaacgtttaaacccttaagttaactttttacgttaaccgtttacggttacgggttacgtaccgggtttaggggaaccggtaaaacggggtccccgtaacggttacccgtaacccggtaccccgttacccgaacccgtaacccccgg

SEQ ID NO: 406211 - DNA, 708 bp, Homo sapiens
  misc_feature: GZ8MTXP02FZQLP.21.67.G01.1.454.CMB.2.raw
  modified_base (184)..(184): a, c, t, g, unknown or other
  modified_base (221)..(221): a, c, t, g, unknown or other
  modified_base (407)..(407): a, c, t, g, unknown or other
  modified_base (505)..(505): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtcgcccactcccagactcaactggtncagtctggacctgaggtagaagagccgtgggcctggngagtctcctgcgaggcctctggttactgtttccgatatagtatcgtaggttgggtgcgacgacggtcccgttaggacgaggtcttaggagtggagtgggagcgggccgtacgtcgacgaacggaagagtaggagtgtaggtacgagttagttacgacggtactaagtaacttacgtcgaaccgtanacgtacaccacgtaccgacggacaccgacgtacgttacgtagtacgtacggaacggtaacgtagaaggtaacgtacggaacgaacgacgaccgtaaanagtttagttacggttgagggtcgtacggtggggtacgggtatttaaggttacgtacgtacgtttaaacttacgtttaaactttaactttacggttacggtttacgggtaccgtttacggggtaacgggggtaaaccggaaacccggggtaccgtaaccgggttacccgacccgtttcccggaacccccgtacggttacccccg

SEQ ID NO: 406212 - DNA, 655 bp, Homo sapiens
  misc_feature: GZ8MTXP02GO69J.21.67.G01.1.454.CMB.2.raw
  modified_base (242)..(242): a, c, t, g, unknown or other
  modified_base (278)..(278): a, c, t, g, unknown or other
  modified_base (338)..(338): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcagggcctntggttactagttttccgactatagtatcagttggtncgacaggccctggacaaggctggagtggatgggatgggccgacttcgacgaaacggaagngtaggaagttgtggtacaagggtaactttcggaaggggtactaaggtaaattacccgttgaaccctaacgagtacctacacttacccgacgggcaacgacgacctacgttacggaacgtagacggaactggaacgaagtaggaccgacgacggaccaacaattacgttagttaggtacgccggacggtagggtcgggggtatagttgtaagtacgttaacttaagtactttattaccgttgttacggtacgttacggtaggggtaaccgaaagggtaccctacgggtaccaaccggtccctacccgacgtacccccg

SEQ ID NO: 406213 - DNA, 847 bp, Homo sapiens
  misc_feature: GZ8MTXP02F3LI9.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatcctttcctggtggcagcagcaacaggtgcccactcccagactcaactggtgcagtctggacctgaggtgaagaagcctggggcctcggtgaaggtctcctggcagggcctgtggttactagttttccgatatagtatcgtaggttggtgcgacgacggcccttaggacgaaggcttggagtggtagtgggagtcggggccgtaccgttcgacgaaacggaacgatacgggtagtaagtcgggtacgaagggtaaactttggaaccggggtactaacggttaaacgttaacctttacggaaacccgaacggtacgtaaccgtacctaaacgttaccccgaaccgggggaactaaccgtaacgtacccgtttaacggttaccggtaaaacgtaggaaccgtaaaccgttacggaacggtaaacggttacgggaccgaaaaccgaccgggaaacctaaaccgtaagttaaactttaagtttacgggtacggtaccgggtaccgggtagggggttacgggggtaccgtttaaagggttttacggaaacggtttaaccgttaaccgtttaaacgtttaaaactttaacgttttaaaacccgtttcggttacgggttaaacccggtttaccggggttacgggggtaaaaccggtaaaacggggtaccccggtaacggtacccggtaaaccccgttccccgtaccccgtacgtaaacccccgg

SEQ ID NO: 406214 - DNA, 758 bp, Homo sapiens
  misc_feature: GZ8MTXP02FK0OS.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacaggtgcccactcccagactcaactggtgcagtctggacctgaggtgaagagccgtggggcctcggtgaggtctcctgcgaggcctcgtggttactacgttttccgactatagtatcgtaggttgggtgcgacgtcggtcccttgggacgtagggtctggaggtggagtggggagtcggggaccgtaccgttcgacgaacggaagtagtggtagtagtggtacgaaggttaacttggacgggtactaacggttaacttaccgttacgaaccacgtacgtactacgaccgtaccgacgggtacactaccgtaccgttacgttaggaaccgtaggtaaccggaaaccgttaggaaacgtaaggtaccgggaaccggaaccgtacccgggacctaacgttaagtttaacgttagtttacggcgggtacgggacggtagggggtacgggggtattaaggtttacgtaacgttaccttaacttaacgtttagtttaactttaccggttcggttaacggggtaccggttacgggacgggggtaaacgtaaacggggtccccgtaaccggtacccgtacccgtttcccgacccccgtacggtaacccccg

SEQ ID NO: 406215 - DNA, 866 bp, Homo sapiens
  misc_feature: GZ8MTXP02HGAF8.21.67.G01.1.454.CMB.2.raw
  modified_base (291)..(291): a, c, t, g, unknown or other
  modified_base (567)..(567): a, c, t, g, unknown or other
tcagtcgtcgctcgcacgaccggtgctcgatttagagtatacatattgggtttggggacccaaaaaccacacccctccttgggagattcccctagatcacagccccctcaccatggactggacctggagcatccttttcctggtggcagcagcaacaggtgcccactcccagactcaactggtgcagtctggacctgaggtagaagaagccgtggggcctcggtaggaacgggtcctccgtggcgacgggtccctcgttggttaacctacgtttttccgaacttagtagtntcgtaggttgggtagacgacgaacgggtccccttagggaacgtaggtcgttaggaggttcggagtcgggagtcgggtaccgtaccgtccgtaaggaaacggaagtaggtacggaggtagtgggtaccgtaaggtaacgtttacggacggggactaacgttaacttacccgttaggaaccctacgacgtaaccgtcaaccgttcccgaaccggacgacaacccggttaccgtaacgttaccggaaactcggaaaccgggttaaacccgtagggtaanaacggtgggaaacccgtacgaccggacctaataaccggttaagtttagtacgacggggttacgacggggttacggggtacgggggtacctttaggttacgggaaactttaaccccgttaagtttaaaacccgttttagtttaaacgtttttacccgggttcgtttaaccgggggttaaaccgtttccgggggtaacggggtaaaaaccccggtaaacgggggttacccggtaacccgggttaacccccgtaaacccccgggtttcccccgttacccccggaacccgggtaaccccccgg

SEQ ID NO: 406216 - DNA, 683 bp, Homo sapiens
  misc_feature: GZ8MTXP02GY17Q.21.67.G01.1.454.CMB.2.raw
  modified_base (453)..(453): a, c, t, g, unknown or other
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagagcgtgggctggtgaaggtctctgcgaggcctgtgttactagttttccgactatagtatcgtagttgggtgcgacgacggccccttaggacgaaggcttagacgtggagtggagtggcccgacgtcgacgaacgaagagtaggagtagtggtacgtagtaaacgttcgaagggacaagtaacttaccgtacggaaccaacgacgactacaacgtaccgaacgggctaacgacgtcctaacgtggaacngaaacgtaccagtacgaatcgggacgaacgcgaacacgtatacgtttagtcgtagcgtaacgtggggacggggtattaacggtttagtaaacgtacgtttaaaacttaaacgtttacgttaaattttaccccgtttacgtaaggtttaacggttacggtcggggaaataaaaccgggggccctaaagggggtaccctacccgtttacccgaccccctaggtaacccccgg

SEQ ID NO: 406217 - DNA, 826 bp, Homo sapiens
  misc_feature: GZ8MTXP02FLS4D.21.67.G01.1.454.CMB.2.raw
  modified_base (284)..(284): a, c, t, g, unknown or other
tcagtcgtcgctcgcacgaccggtgctcgatttagagtatacatattgggtttggggacccaaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtagaaggtcctcgtgcgagggtcctgttgttacttagttttccgatatagtatcgaggttggncgacgtcggtcccttagggacgtaagggtcttaggaggtcggagtggggagtcggggaccctacgttcgacgaaacggaagtgtagggtagtaggtcggtacgtaaggtacgttacggaggggtaccaagttaaaccttttaccggttacgaaacccgtagtaccggtacctaccggtacgtaccccggaacgggtaccaaccgtaccggttacccgttaacggttacggaaacccgttaagggtaaacccggaaaccgttagggaaacgtaaggtaccgggaaaccggaccgacccgggtacctaaacgttaagtttaaggtttacgttagggtccgggtacggtacgggtacgggggtacggggttactttaacggtttaggtaaacgttactttaaacgttaacgtttaactttaacggtttaccgttacggttacgggtaaccggtttcggtaacggggaaaacggttaaacggggtacccttaaaccccggggtacgtacccccggttaaccccgtacccgtaccggtaaccccccg

SEQ ID NO: 406218 - DNA, 824 bp, Homo sapiens
  misc_feature: GZ8MTXP02IFSXM.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatcccttttcctggtggcagcagcaacaggtgcccactcccagactcaactggtgcagtctggacctggaggtagaaggaacgccgtggggcctggtgacggtctcctgcgaggcctgtggttactagttttccgactatagtatcgtaggttgggtcgacgacgacggtcccgttagggaacgtaagggtcttggaggtagggtaggtggggtacggtcgggtacccggtacccgttacggaaccggaaaacggaaaaggagtagggaagttagtcggtaacgtaaggttaacgtttcggaacggggacctaaagtacgtttacgtacgaaccacgtacgtactactaccgtacccgacgggactaacgacgtccttaacgtacggtaaacgtcggaaacggtaaccctaggaaagtacggtaacgggaccgtaacgacccggtaaaccaagtttaacttaagtttttacggtcgggttaacggcggggtccgggttaaggggtacgggggttacgtttaagggttttaggggtaaccttaacggtttaaaactttactttaaacgtttttaaaccgtttacgtttacggttaaccgggtcggtttaaccgggtaacgggtaacgggtaaaacggggtacccgttaaccggttacccgtaccccggtaccctaccccgtaacccgtaacccccg

SEQ ID NO: 406219 - DNA, 813 bp, Homo sapiens
  misc_feature: GZ8MTXP02JEBV5.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatcctttcctggtggcagcagcaacaggtgcccactcccagactcaactggtgcagtctggacctgaggtgaagaagccgtggggcctcggtgaaggtctcctgcgagggcctcgtggttacagttttccgatatagtatcagttgggtgcgacaggcccttggacgaaagggtcttaggaggttaggacgttggggaattcggggcccgtacccgtttcggacgaaacgggaaaacgtagtagggacgttagtcgggtacgtaaggtaagttttcgacggggtacctaagggtaaactttacccgtttaggaacccccgtaactacggaacccgttactaaacttcccccggaaacgggggacctaaacccgaccgtacccgttaaaccgtttacggggtaaaccgtacgggtaaaaccggtaaaccccgttaggaaacgggtaaaacgttacgggggaaacccgaaaccggtaaccggggaacccctaaacggtaaacttaaacgttttaagttacgtacggggtaccggtaccggtaaagggggtcgggggtacgttaaggtttaaggtaacggtaactaccggtaaacttacgtttattaacgttgttacggtacgtacgtaggggtaccgtaaaacgggtaccgtaacggttccgacccgtcctacccgacgtaccccg

SEQ ID NO: 406220 - DNA, 725 bp, Homo sapiens
  misc_feature: GZ8MTXP02IVGAM.21.67.G01.1.454.CMB.2.raw
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctggtgaaggtctcctgcagggcctctggttactagtttttccgacttatagtatctaggttggtgcgacgaggtcccttggacaaggcttggagtggagtgggagtcggggcccgacgttcgacgaaacggaaagacgtagggagtagtggtacgaggtaatttcgagggtacagtaattaccttacgaaccacagacctacacgttacccgacggggaccaacgacgtaccgttaacgttacggaaactaggaaaccgggtaaacccttaggaaaggtaaacgtacgggaacgaaaccgacgggacccaaactaagttaactttagttgtaggaccggacggtaagggtcgggggtactaaggttttaggtaacgtaacgttaacgttaacgttattttaaacgtttacgtttacgttacgggttacgttacggtcggggtaaaccgaaacggggtacccgtaacgggttcccgtaacccgtacccgttcccccgaacgtacccccg

SEQ ID NO: 406221 - DNA, 720 bp, Homo sapiens
  misc_feature: GZ8MTXP02F568A.21.67.G01.1.454.CMB.2.raw
  modified_base (361)..(361): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtggggcctcggtgaaggtctcctgcagggcctgtggttactagttttccgactagtagtactcgtaggttggtcgcgacacggcccttaggactaagggtcttaggagtggagtgggagtcggggccgtaccgttcggacgaaacgggaagngtagggagtagtggtcaaggtatttcgacggcaagtaacttaccgttagacccagacgtactactacgtacccgacgggactacgacgtacccgttaagttacggaactacggaaacggtaacctaggaaacgaacgtacgggaaccgaccgaccgaacccgtaataaagttacgttaagttcggttaggaccggtacggtaaggggtcggggtacttagtttacggaacgtaccttaacgttaacttaagtttacgtttaaccgtttcgttacgggaacgttacgggtacgggtaacgtaaaaccgggtaccgtaacccgggttcctaacccggttccctacccgtacggtacccccg

SEQ ID NO: 406222 - DNA, 727 bp, Homo sapiens
  misc_feature: GZ8MTXP02GGF4E.21.67.G01.1.454.CMB.2.raw
  modified_base (218)..(218): a, c, t, g, unknown or other
  modified_base (224)..(224): a, c, t, g, unknown or other
  modified_base (226)..(226): a, c, t, g, unknown or other
  modified_base (268)..(268): a, c, t, g, unknown or other
  modified_base (434)..(434): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcattccttttcctggtggcagcagcaacgaggtcgcccactcccagactcaactggtgcagtctggactgagtagagagcgtgggctggngagtcncngcgaggctgtgttactgttccatatagtatcgtaggttggcncgacgcggtccgttaggaactagggtcgttggaacggttggaggtggggtactcggggtacccgtacgttcggaacggtaaaggtaaggtcggtaggtacgtagttcggaacgtaagggtactttcgaaccggggtactaacgtacgttaaccgtcgaaccaacgnggtcctaacgccgtaccgacggaactctaacgtcttacgtacgagtacggacgtacaggaacgtagcggaacgacgacgaaccgtaatattacgttagtgtacgggtacgtacgggtaaggggtcggtagttacggttacgttaacggtaacttaacgttaacgtttaaactttgtttacccgtttaggttaaccggtacgggttaccggtaacggggttaaacggtaaaccgggttaccggtaaccggggttacccgtacccggttccgtaaccccggtccggtaacccccg

SEQ ID NO: 406223 - DNA, 756 bp, Homo sapiens
  misc_feature: GZ8MTXP02GIMZO.21.67.G01.1.454.CMB.2.raw
  modified_base (229)..(229): a, c, t, g, unknown or other
  modified_base (353)..(353): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagagccgtgggcctggtgaggtctccngcgaggcctgtggttactagtttttccgattatagtatcgtaggttggtgcgacgaggtcccttggacgaagggtcttggagtggagtgggatcgggccgtaccgttcggacgaaacggtaagngtagggtagtagtggtacgtaggtactttcgacgggtcaagtaacttccgttacgaacccacgtacgacctacgtacgtacccgacgggacaacgtacgtacccgtacgttacggaacgtacggaacggtaaacccgtagaaacgtaagtacgggaaccgaaccgaccgggaccaaccgtaagttaagtttaacgttcgggtaggtacccggtaccgggtaaggggttcgggggtacctttaaggtttacggtaaacgttaaccgttaaccgttaacgtttaacgttttacgtttaccgtttacggtttaccgggtacgtttaccgggtacggggtaaaccgtaaacggggtacccgtaaccggtacccgtacccgtacccgtacccccgtacgtaccccccg

SEQ ID NO: 406224 - DNA, 780 bp, Homo sapiens
  misc_feature: GZ8MTXP02I8R48.21.67.G01.1.454.CMB.2.raw
  modified_base (235)..(235): a, c, t, g, unknown or other
  modified_base (267)..(267): a, c, t, g, unknown or other
  modified_base (755)..(755): a, c, t, g, unknown or other
tcagtcgtcgctcgcacgaccggtgctcgatttagagtatacatattgggtttggggacccaaaaaccacacccctccttgggagattcccctagatcacagcccctcaccatggactggacctggagcatccttttcctggtggcagcagcaacaggtgcccactcccagactcaactggtgcagtctggacctgaggtgaagaagccgtggggcctcggtgaaggtctctgcngggcctctggttactgttttcccgatatagcntcgtaggttgggtgcgacgacggtcccttaggaccaagggcttggagtggagtggggatcggggccgtaccgttcgacgaaacggaaagcggtggagtagtgggtacaaggtaacgttccgaggtaccaagtaacttaccgttacgaacccagagtaccctcgaacctacccgacgggaccaacgtaccgtaccgttaacgttagggaacccgttaggaaaccgggttaaaccgaggaaacgggtaacgtacgggggaaaccgttaaccgaacccgggaccccgtaaacttaaagtttaacgtttacgtttcgggtaccgggaccggttaccggggtaagggggtcgggggttaaccttaggttttaaggggtaaccttaaaccggttaactttacctttaaaggtttaccttttaaacggtttcgttaaacggggtaccgtttcgggttaacggggaaccgtaaacgggtacccgacgggttacccncccggttaccctacccccgtaacgg

SEQ ID NO: 406225 - DNA, 511 bp, Homo sapiens
  misc_feature: GZ8MTXP01EYMQZ.3.63.F08.1.454.CMB.2.raw
  modified_base (337)..(337): a, c, t, g, unknown or other
  modified_base (363)..(363): a, c, t, g, unknown or other
  modified_base (474)..(474): a, c, t, g, unknown or other
  modified_base (478)..(478): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggtccctgagactctcctgtgcagcctctggattcaccttcagtagctatagcatgaactgggtccgccaggctccaggcaagggggctgggagtgggtggcagttangtccacatgatggaaaagaaaaaatntacgcagactcctgaggtcgattcaccatctcagagacaatccaacacacctgtatttggcaaatgaacagcctgagaactgaagacacggctaatcttattacttgtcgngagngatcagtccggacgacgaaatgaacgtaacggg

SEQ ID NO: 406226 - DNA, 528 bp, Homo sapiens
  misc_feature: GZ8MTXP01EYUK5.3.63.F08.1.454.CMB.2.raw
  modified_base (438)..(438): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgtgcagcctctggattcaccttcagtagctatagcatgaactgggtccgccaggctccgaggggaaggggctggagtgggtctcatccattagtagtagtagtagtacataatactcgcagactcagtgaagggcattcacatcacagacgacaacgcaaagactcactgtatctagacaaatgaaacngacctgagagccgaggcaacggcttgtgttattacgtgttgcgttagtttgggttggggcggtatggcaagggttcgggaaccccggggg

SEQ ID NO: 406227 - DNA, 546 bp, Homo sapiens
  misc_feature: GZ8MTXP01EPNTU.3.63.F08.1.454.CMB.2.raw
  modified_base (363)..(363): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggtccctgagactctcctgtgcagcctctggattcaccttcagtagctatagcatgaactgggtccgccaggctccaggcaagggggctgggagtgggtgcagttatgtcacatgataggaaaaagaaaaaatnttaacgacagacctccctaggaagggtcattcaccatctccagagactaattccaaacaaccaccctagtactttaggactaaatgaaacagaccctagagaaacctagaagaacacgggtctaatcttattacttgtgcgagagactcgagtccggaacgacgaaatgaacgttaaccgggg

SEQ ID NO: 406228 - DNA, 535 bp, Homo sapiens
  misc_feature: GZ8MTXP01C5BMG.3.63.F08.1.454.CMB.2.raw
  modified_base (447)..(447): a, c, t, g, unknown or other
  modified_base (487)..(487): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggattcaccttcagtagctatagcatgaactgggtccgccaggctccgaggggaaggggctggagttgggctcatccattagtagtagtagtagttacataaatactcgcagactcagtgaaagggccattcacatctccaagagacaacgccaaagaactcaactgtaatctgaccaaatgaaacngcctagacgaagcccgaggacaacggcttgtgatttacgngttgcgttagtttgttgggcggtataggcgaaggcgggtaacccgggg

SEQ ID NO: 406229 - DNA, 537 bp, Homo sapiens
  misc_feature: GZ8MTXP01B5KXE.3.63.F08.1.454.CMB.2.raw
  modified_base (362)..(362): a, c, t, g, unknown or other
  modified_base (386)..(386): a, c, t, g, unknown or other
  modified_base (434)..(434): a, c, t, g, unknown or other
  modified_base (462)..(462): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaactggtccgcaggctccgaggggagggctggagtggtctcatcattagtagtagtagtagtacataatactcgnagactcagtagaagggcattcacntctaccagacgacaacgaccaagactcatgtatctgacaaagtgaacngcctaggacgcggccgaggacaaccggnttgtattagttacgtggttgcgttaggttttggttggggaacggtatcggacgtaacgggcggggtaaccccggg

SEQ ID NO: 406230 - DNA, 519 bp, Homo sapiens
  misc_feature: GZ8MTXP01EFXIH.3.63.F08.1.454.CMB.2.raw
  modified_base (438)..(438): a, c, t, g, unknown or other
  modified_base (445)..(445): a, c, t, g, unknown or other
  modified_base (453)..(453): a, c, t, g, unknown or other
  modified_base (495)..(495): a, c, t, g, unknown or other
  modified_base (499)..(499): a, c, t, g, unknown or other
  modified_base (502)..(502): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccgagggaaggggctggagtgggtctcatccattagtagtagtagtagtacataatactcgcagactcagtgaaagggccattcaccatctccagagacaacgccaaagactcactgtatctgacaaatgaacngctgagngccgaggnaacggcttgtgttatactggttgttcggttgttgggtcgggngtancgngtcggccggggtaaccg

SEQ ID NO: 406231 - DNA, 573 bp, Homo sapiens
  misc_feature: GZ8MTXP01AG23F.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtggggggtccctgagactctcctgtgcagcctctggacttcaccttcagtagctatagcatgaactgggtcccgccaggcctccaggcgaagggggctgggaggtgggggtggctagttatgtccacatgaataggaaaaaataaaaaatgttaacgcagacctcccgtaggacgggtcacttacacctatcctaccaagtaacgaactaacttaccaaacaacctaccctagttacttaggaacaaatgaactagcctagaacgaactagaacacgacggtctaatcttatacttgtgacgagacatcgaggtccggaacgaacgaagtcgaaccgttaacggg

SEQ ID NO: 406232 - DNA, 553 bp, Homo sapiens
  misc_feature: GZ8MTXP01CSRKS.3.63.F08.1.454.CMB.2.raw
  modified_base (453)..(453): a, c, t, g, unknown or other
  modified_base (486)..(486): a, c, t, g, unknown or other
  modified_base (525)..(525): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaacgtgggtccgccgaggctccgaggggaaggggctggagtgggtctcatcattagtagtagtagtagttacataatactaacgcagactcagtgaacgggcattcacatctaccaagacaaccaacgaccaaagaactcaactgtactctagaacaaatgaacngcctaggagacgccgaaggccaacggtcttgtnttattacgtggttagcgttaggttttgggttggggcggntaggcgtaagggcccgggtaacccgggg

SEQ ID NO: 406233 - DNA, 529 bp, Homo sapiens
  misc_feature: GZ8MTXP01CWW1X.3.63.F08.1.454.CMB.2.raw
  modified_base (370)..(370): a, c, t, g, unknown or other
  modified_base (398)..(398): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctgggcggtccctgagactctcctgtgcagcctctggattcacctcagtagctatagcatgaactgggtccgccaggctccgaggggaagggggctgggagtgggtctcagtccattagtagtagtagtagttacaatatctacncagactcagtgaagggccattcacatcncagagacaacgccaagaactcactggtatctgacaaatgaacagcctagagagccgaggaacacggctggttgtattcgttgttggcgtggtttggttggggcgggtattacggcgaacgggtcccggggg

SEQ ID NO: 406234 - DNA, 553 bp, Homo sapiens
  misc_feature: GZ8MTXP01CXBI3.3.63.F08.1.454.CMB.2.raw
  modified_base (302)..(302): a, c, t, g, unknown or other
  modified_base (406)..(406): a, c, t, g, unknown or other
  modified_base (424)..(424): a, c, t, g, unknown or other
  modified_base (475)..(475): a, c, t, g, unknown or other
  modified_base (480)..(480): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtggggggaggcctgggtcaaggccgtgggggtccctgagactctcctgtgcgagcctctggattcaccttcagtagctatagcatgaactgggtccncaggctccgaggggaagggctggagtgggtctcatccattagtagtagtagtagtacataactactcgctaagactcagtgaagggccattcaccatcacaganacaacgaccaagaacctnactgatctgaacaaatcgaaacagccgtagagacgccgaggacaacgggtnttgtnttagttacgtgttcgttcgttaggtttgggtagggtcggtagtcggacggtaacggggccggggtaacccggg

SEQ ID NO: 406235 - DNA, 593 bp, Homo sapiens
  misc_feature: GZ8MTXP01E3O3S.3.63.F08.1.454.CMB.2.raw
  modified_base (304)..(304): a, c, t, g, unknown or other
  modified_base (437)..(437): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgcttgggttttccttgttgctattttagaaggtgtccagtgtgaggtgcagctggtggagtcgtgggggaggcctggtcaaggccgtgggggtccctgagctctcctgtgcgacgcctcaggacttcaccttcagtagctatagcagtgaactgggtcccncgaggctcgagggggagggctggagtggctgatccattagtacgtagtagtagtacataaactactaacgcaagacctagaggtcggaagggtcccattaccaccattccaccgagacgaacaaccgacaaanactcatgtaactctagactaaagacgaacagaccgagacgacgaccggacggaacggaaccggtcgttggtagttacgttaacgtgttgttcggttggtttgggttgggggtaacgggtacggtaggcggtaacgggccgggggtaaccccggggg

SEQ ID NO: 406236 - DNA, 635 bp, Homo sapiens
  misc_feature: GZ8MTXP01A8211.3.63.F08.1.454.CMB.2.raw
  modified_base (469)..(469): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaactgggccgccaggctccgaggggaaggggcgtggagtgggtctcatccattagtagtaggtagttagtacataatactaacgcagactcaggtagaacggggccattccaaccgatcctaccgagacgaccaacgaccaaagaacctcacgttgtactcgtagacctaaaagtcgaaacncgacccgtaggaacggtacggacccggaaaggacccgaaacgggtcttggtacgttacgtttacgtgggtttacggttcgggtttagggttttttgggggtttagggggccggggtaattacggggaccggtaacggggttaacccggggggttaaccccgggggg

SEQ ID NO: 406237 - DNA, 591 bp, Homo sapiens
  misc_feature: GZ8MTXP01CJNFY.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcaccttcagtagctatagcatgaactggtcccgccgaggcctccgaggggaagggctgggagtgggtctcatccattagtagtagtagtagttacataatactcgcaagactcgagtaggaacggggcctattccaacctattccaccaagaacgacaacgaccaaagacctcacttagtatctagaccaaagtgaaactcgctaggaacgacgccgaaggcaacgggtcttggtacgttagtttacgtggttcgttcggttaggttttggggtttcggggaacggttacgtacggaccgtaacggggcccggggtaaccccggggg

SEQ ID NO: 406238 - DNA, 522 bp, Homo sapiens
  misc_feature: GZ8MTXP01CPTZG.3.63.F08.1.454.CMB.2.raw
  modified_base (393)..(393): a, c, t, g, unknown or other
  modified_base (398)..(398): a, c, t, g, unknown or other
  modified_base (427)..(427): a, c, t, g, unknown or other
  modified_base (429)..(429): a, c, t, g, unknown or other
  modified_base (433)..(433): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactgggctccgctgggttttcctgttgctattttagaaggtgtccagtgtgaggtgcagctggtggagtcgtgggggaggcctggtcaagccgtggggggtccctgagactctcctgtgcagcctctggacttcaccttcagtagctatagcatgaactgggtccgcaggctcgaggggaaggggctggagtgggtctcatccattagtagtagtagtagtacataatactaagcagactcagtgaaggccgatcacatcncaganacaacgccaagactcatgtatctgacaananacanctgagagacgacgacgaacgcgttgtgttagtacgtgttgttgttaggtttggttgggtcgggtgtagacgtcgcgggtaacccggggg

SEQ ID NO: 406239 - DNA, 570 bp, Homo sapiens
  misc_feature: GZ8MTXP01A30L1.3.63.F08.1.454.CMB.2.raw
  modified_base (297)..(297): a, c, t, g, unknown or other
  modified_base (443)..(443): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggagaggcctggtcaagccgtggggggtccctgagactctcctgtgcagcctctggattcacctcagtagctatagcatgaactgggtccncaggctccgaggggaggggctgggagtgggtctcatccattagtagtagtagtagttacaattatctacgcagactcagtgaagggccattcacatctccaagacgacaacgccaaagactcgactggtatctgacaaatgaaacngacctggaacgacggacccggaagggtaaccgacggggcttggttgttaaacttacgttggttggttacggttaaggttttgggttgggggcggggattacgggcgttaacggggtaaccccggggg

SEQ ID NO: 406240 - DNA, 539 bp, Homo sapiens
  misc_feature: GZ8MTXP01D2BD9.3.63.F08.1.454.CMB.2.raw
  modified_base (443)..(443): a, c, t, g, unknown or other
  modified_base (464)..(464): a, c, t, g, unknown or other
  modified_base (474)..(474): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaactgggtccgccaggctccgagggaaggggctggagtgggtctcgatcattagtagtagtagttacatataactacgcagactcagtgaaggggcgattcacatctccagagaacaacgaccaaagaactcactgtatctagacaaaatgaaacngcctagacgacgccgaggacncggctggttnttattacgtgtagcggttagtttggttggggcggtgtaggcgagggtccgggccgggggtaaccc

SEQ ID NO: 406241 - DNA, 614 bp, Homo sapiens
  misc_feature: GZ8MTXP01DC8OS.3.63.F08.1.454.CMB.2.raw
  modified_base (483)..(483): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcacttcagtagctatagcatgaactgggtcccgccgaggcctccgaagggggaacgggggcgtgggagtgggtctcatcctagttagtagtagtagtagttaacataaatactaacgcaagtactcgagtaggaacgggccgtattcacctatcctcaagaacgaaccaacgaccaaagaacctcaacgttgtaactcgttagaaccaaatacgaaacncgaccgtaggacgaacgaccggaaggtaaccgaacgggtcttggttagttacttacgtggttaggttcggttaggtttttcgggttaggggcgggtagtacggacgtaacgggccggggttaaccccgggg

SEQ ID NO: 406242 - DNA, 597 bp, Homo sapiens
  misc_feature: GZ8MTXP01CHB6V.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcaccttcagtagctatagcatgaacgtcgggtcccgccgaggcctaccggaagggggaaggggcgtggaggttgggtctcatccagttagtagtagtagtagttacattaactactcgcaagactcgaggtcggaacgggccctattccacctatccaccgaagacgaacaacgaccaaagacctcacttgtactctagacaaatacgaaacacgccgtagacgacggaccggaggacgcggtcgttgttacgttagtttacgtggttcgttggtttaggttttcgggttgggggcggtagtcggacgaacggggcccggggttaacccgggg

SEQ ID NO: 406243 - DNA, 650 bp, Homo sapiens
  misc_feature: GZ8MTXP01C1QFU.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggacttcaccttcagtagctatagcatcgaacgtcgggtcccgccgacggccgtcccgagggggaagggggcgtgggaggttggggtctacgtactaccgtatttagtaagttaggttagttagttacagtaaattactaacgacaggactacgagtaggaaacggggccctattccaaccctattcctacccaaggacgaaccaaccggaccaaaggaacctcaacttgttaactcgtagaacctaaagtacgaaaccgcgacccgtagaacggtaacggcccggaaaggaccgaacgggtcttaggtgttaagtttacgtcgttgggttcgttagggttttgggttggggaacggtatcgggcgtaacggggccgggtaaccccggggg

SEQ ID NO: 406244 - DNA, 610 bp, Homo sapiens
  misc_feature: GZ8MTXP01AC9Y8.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtggggggtccctgagactctcctgtgcagcctctggattcaccttcagtagctatagcatgaacgtcgggtcccgccgaggcctaccggagggggaagggggctgggagtgggtctcatcctagttagtagtagtagtagtacataaatactaacgcaagactacgagtggaacgggcctattccaacatccaccagacgaaccaacgaccaaagactacgactagtactcgtaggaaccaaagtgaaaccagccgtaggaacgacggacccggaaggacccaacgggtcttgggttacttaagttacgtggttcggttcgttaggttttggggttggggaaccgggtagtagggacggtcgggaaccggggtaaccccggggg

SEQ ID NO: 406245 - DNA, 618 bp, Homo sapiens
  misc_feature: GZ8MTXP01B5EE5.3.63.F08.1.454.CMB.2.raw
  modified_base (258)..(258): a, c, t, g, unknown or other
  modified_base (272)..(272): a, c, t, g, unknown or other
  modified_base (349)..(349): a, c, t, g, unknown or other
  modified_base (491)..(491): a, c, t, g, unknown or other
  modified_base (532)..(532): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctcgctgggttttcctgttgctatttagaggtgtccagtgtgaggtgcagcgtggtggaggtcggtgggggaggcctggtcaaggccgtgggggtccctgagctctcctgtgcagcctntggtattcaccttnagtagctatagcagtagaacgtcgggtcccgccgaggccgtccggaagggggaagggggcgtggggaggtgggtctnactctagttagtagtagtagtagtacaataatactaacgcaagactacgaggtagggaaacgggccctaattccaaccgtatccgtacaagaacgaacaacgaccaaagactcactgttactctagaacaaagtacgaaacncggtacctaggaacgacggaccggaacggaacgaacgggtnttggtatttacgtacgttggttacggttcggttagggttttgggtagggggaacgtagacggcggtaacgggttcgggtaaccggg

SEQ ID NO: 406246 - DNA, 540 bp, Homo sapiens
  misc_feature: GZ8MTXP01EEHZL.3.63.F08.1.454.CMB.2.raw
  modified_base (466)..(466): a, c, t, g, unknown or other
  modified_base (483)..(483): a, c, t, g, unknown or other
  modified_base (490)..(490): a, c, t, g, unknown or other
  modified_base (502)..(502): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgcttgggtttttccttgttgcttattttagaaggtgtccagtgtgaggtgcagctggtggagtcgtgggggagcctggtcaagccgtgggggtccctgagactctcctgtgcacgcctctggattcaccttcagtagctatagcatgaacgtgggtcccgccgaggctccggaagggggaagggggcgtgggagttgggtctcatccagttagtagtagtagtagtacataatactcgcagactacgagtaggaaacgggccattccacatccaccagacaacaacgcaaagacctcactgtactcgtagaacaaatgaaacncgctagagcgccgagcngcttgtnttatcgtgttgngttgtttggtgggcggatggcgtggccgggtaaccggg

SEQ ID NO: 406247 - DNA, 627 bp, Homo sapiens
  misc_feature: GZ8MTXP01AUYS3.3.63.F08.1.454.CMB.2.raw
  modified_base (259)..(259): a, c, t, g, unknown or other
  modified_base (325)..(325): a, c, t, g, unknown or other
  modified_base (372)..(372): a, c, t, g, unknown or other
  modified_base (407)..(407): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctntggattcaccttcagtagctatagcatgaacgtcggtccgccaggcctccgaggggagggcgtggngtggtctcagtccagttagtagtagtagtagtacataatactaacgnagactacaggtagaacggggtccaactttcaaccngtacctaccgaagaacgaccaaaccgacccaaagaacctcaacgttgtactcgtagacctaaagtcgaaaccgcgtaccgtaggaacgaccggaccgggaagaccggtaacggtcgttggttacgttacgttacggtggttcggttcggtttagggttttcggggttacggggaacggtaacgtcgggaccgggtaacggggttcccggggtaaccccgg

SEQ ID NO: 406248 - DNA, 738 bp, Homo sapiens
  misc_feature: GZ8MTXP01ESDIQ.3.63.F08.1.454.CMB.2.raw
tcagagacgcactccacgaccggtgctcgatttagcgatcgtataaggggctctgagagaggagccttagccctggattccaaggcctatccacttggtgatcagcacttagcaccgaggattcaccatggaactgggctccgctgggttttccttgttgctattttagaaggtgtccagtgtgaggtgcagcgtggtggagtcgtgggggagcctggtcaagccgtgggggtccctgagactctccgtgtgcagcctctggactttccaccttcagtacgcttaatagacagtacggaaccgtcgggtcccgccgagggtcctaccggagggggaagggggtcgtagggtaggtcggggttcctacgacttaccgtaagtttaggtaagttaagttaggttaagttaacctaagttaactaaacctacgctaacgacctacgagggtagaacggggcctagttaccaactacttccaccgagaacgaaccaaaccgaccaaacgaacctacacgttagtactacgttacgaacctaaagtacggaaaacgccgacccgttaaggaacgggaacggtacccgggaacggaacccggcggtaaccgttcgggtttaagttacccgtttacggtaggtttcggttacgggtttacgggttttcgggttaaggggggtacggtaagggttaacggaccgggttacggggtaaccccgggggttaaccggggggtaaccccg

SEQ ID NO: 406249 - DNA, 570 bp, Homo sapiens
  misc_feature: GZ8MTXP01BCMAZ.3.63.F08.1.454.CMB.2.raw
  modified_base (307)..(307): a, c, t, g, unknown or other
  modified_base (383)..(383): a, c, t, g, unknown or other
  modified_base (387)..(387): a, c, t, g, unknown or other
  modified_base (410)..(410): a, c, t, g, unknown or other
  modified_base (413)..(413): a, c, t, g, unknown or other
  modified_base (425)..(425): a, c, t, g, unknown or other
  modified_base (429)..(429): a, c, t, g, unknown or other
  modified_base (433)..(433): a, c, t, g, unknown or other
  modified_base (441)..(441): a, c, t, g, unknown or other
  modified_base (457)..(457): a, c, t, g, unknown or other
  modified_base (548)..(548): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactgggctccgctgggttttccttgttgcttattttagaaggtgtccagtgtgaggtgcagctggtggagtcgtgggggaggccgtggtcaagtccggtggggggtccctgagactctcctgtgcacgcctctggattcaccttcagtagctatagcagtagaacgtgggtcccnccgaggcctccggagggggaagggcgtgggaggtgggtctcacgtctagttagtagtagtagtagtacataatacngcanactgagtggaacggcattcaccntcncagacgacaacncaanactnactgttancagacaagtcgaaacngcctaggacgacgtcggaagacgaacggtcttggtagttacttacggtgttcggttcgtttagggtttgggtggggtaacggagttacggnggtaacgttcggggtaaccggg

SEQ ID NO: 406250 - DNA, 685 bp, Homo sapiens
  misc_feature: GZ8MTXP01DWS93.3.63.F08.1.454.CMB.2.raw
  modified_base (366)..(366): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcaccttcagtagctatagcatgactgggtccgcgaggctccgaggcgaagggggctgggagtggggtgctagttatgtaccacgatagaataaggaaaaaanaaaaaaatgttaaacgacaacgtacctacccgtaggaacggggttacactttacaacctatacctaccaagaacaactaacttaccaaacaacctaaccctagttaactttaggggaactaaaagttacgaaactacgtcccgtaggaacgtaaaaccgtagtaaaacggaaccgtaaccgggtaacttaacttaacccttaagtttacccgttaggttaccggacgttaaagggaggttaaacgtaacccggtaaacgggttcccgggtaaaacgggaaccggttaaaagtcgggttaaaccgttttaaacccggggg

SEQ ID NO: 406251 - DNA, 653 bp, Homo sapiens
  misc_feature: GZ8MTXP01CATR5.3.63.F08.1.454.CMB.2.raw
  modified_base (304)..(304): a, c, t, g, unknown or other
  modified_base (557)..(557): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaagccgtgggggtccctgagactctcctgtgcagcctcgtggattccaccttcagtagctatagctatcgaacgtgggtccnccgaggctccggagggggaaggggcgtaggaggtgggtctcgacttccagttagtacgttagtagttagttacagttaaactactaacgacaagtactacgaggtacggaacggggtcctattaccacctaattccaccgaaggaacgaacccgaaacgacccaaaagtacccttacgaaccttgtaactcgtaagaaccaaagtacaaacgcgtaccgaggacgaaacggccgaacggacgaacccgggttnttgttacgttacgttacgtggttacggttcggttagggttttggggtacggggcggttaagtacggccgggtaacgggttccccgggggtaaccgg

SEQ ID NO: 406252 - DNA, 879 bp, Homo sapiens
  misc_feature: GZ8MTXP01D63B9.3.63.F08.1.454.CMB.2.raw
  modified_base (261)..(261): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaagccgtgggggtccctgagactctcctgtgcacgcctntggtattcaccttcagtagcttatagcatagaaccgtgggtcccgccgaggccgtaccggaagggggaagggggcgttagggagggttcgggggttcctacgtaacgttaccgtaaagttttaaggttaacggttaagggtttaaggttaaagttttaaacccaaagtttaaaaccttaaaccgtaaccggtacctaaagggtacccttacgtaagggttacggggaaacgggggtccctaactttacccaaacctagtaccgttacccgaaaggaaaccggaaacccaaaacccgggtaaccccaaaagggtaaaacccccttctaaaaccgttttacgggttaacgtttaaccttaacggaaaacccgtaaaaataccggaaaacccgacgggtaccccgtaaaggggaaacgggtaaccgggaaccccggggaaacgggaacccgaacggggttaccgtttgggttacggtttttaaatttacccgggtttaggggttacgggttccggggttttttaacgggggttttttcgggggtttaggggggaaccgggttttaaagggtcgggacccgggtaacggggggttaaccccggggggttaaacccccggggg

SEQ ID NO: 406253 - DNA, 634 bp, Homo sapiens
  misc_feature: GZ8MTXP01A7M2H.3.63.F08.1.454.CMB.2.raw
  modified_base (369)..(369): a, c, t, g, unknown or other
  modified_base (526)..(526): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggattcaccttcagtagctatagcatgaactgggtccgccaggctccgaggggaagggctgggagtggtctcatccattagtacgtagtagtagtacataactactcgnacgactacagtaggaacggggccctattccaacctatccctaccgaagaacgaacctaaaccggcctaaagaacctcaacgttgtactctgaaccaaaagttcggaaaccgcgtaccgtaggaacggaccggaccggaaacggtaccgtaaccggtnttaggttagttacgttacggtggttcggttacgggttttagggtttcggggttcgggggaacggtaagtcgggacggtaaccgggggttaacccgggggtaacccggg

SEQ ID NO: 406254 - DNA, 661 bp, Homo sapiens
  misc_feature: GZ8MTXP01EO80V.3.63.F08.1.454.CMB.2.raw
  modified_base (528)..(528): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctatttagaaggtgtccagtgtgaggtgcagctggtggagtcgtggggggaggcctggtcaagccgtggggggtccctgagactctcctgtgcagcctctggtactttacctcagtagctatagcatgaacgtcgggtccgaccagggcctaccggagggggaacgggggtcgtgggaggtcggggttctacgacttaccctaagttaaggtagttaaggttagttaagttaacagttaactaaacctacgcgaagtacctcgaggtaggaacgggggcccgtattacccaccactcctaccgagaacgaaccaaacgaccaaacgaacctacgaactgtaactctagaactaaatacgaaactacnccgtagaaggacggacccggaggaaccgcgggtctggttagtactttacgtggttcggttacggtttggtttggggtttggggacgggtaagtacggcggttacgggcccggggttaaccgggggttaacccc

SEQ ID NO: 406255 - DNA, 708 bp, Homo sapiens
  misc_feature: GZ8MTXP01CXWP4.3.63.F08.1.454.CMB.2.raw
  modified_base (144)..(144): a, c, t, g, unknown or other
  modified_base (587)..(587): a, c, t, g, unknown or other
tcagagacgcactccacgaccggtgctcgatttagcgatcgtataagggctctgagagaggagccttagccctggattccaaggcctatccacttggtgatcagcactgagcaccgaggattcaccatggaactggggctccgnttgggttttccttgttgcttattttagaaggtgtccagtgtgaggtgcagcgtggtggagtcgtgggggagcctggtcaaggtccgtggggggtccctgacgactctcctgtgcagtccctgtggtacttctaccttacgagtacgactagtagactagtacgacggttcgggtcccgccgacggccgtaccgggaagggggaacggggtcgtagggtagggttcgggtactactacgtacctagttagtaagttagtagtagtataataactaactcgcaagtactagaggtaggacggtccctaattccaactactccgtacaacggaacaaccaaccgacaaacgtacctacgacttagtactacgtacgaaacaaacgtacgaaaccgacgtaccggtaaggacggaccggaaccggtacggtaacccgaacggggttnttacggtttgttaaacgtttcggtggttcggttacggggtttagggtttttggggttacgggggaacggttaacggcgggttaacccgggtcgggggaaccccgggggtttaaccccgggg

SEQ ID NO: 406256 - DNA, 601 bp, Homo sapiens
  misc_feature: GZ8MTXP01C1WIT.3.63.F08.1.454.CMB.2.raw
  modified_base (304)..(304): a, c, t, g, unknown or other
  modified_base (379)..(379): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgcttgggttttccttgttgcttattttagaaggtgtccagtgtgaggtgcagctggtggaggtcgtgggggagcctggtcaagccgtgggggtcctgagactctcctgtgcagcctcgtggacttcaccttcagtagctatagcatcgaacgtgggtcccnccgaggcctccggaagggggaaggggctggaggtggtctcactcatttagtagtagtagttacatactaactacncgaagtctagagtcggaacgggccgtattccaaccatcctacgagaacgaacaaaccggaccaaacgactacattacgtactcgacgactaaagtcgaaactcgaccgtagacggacgccggaaggaccgcggtctgttacgttattcgtggtcgttacggttggttttgggttggggacggtaatacggacggacgggtaaccgggggccgggtttaaccc

SEQ ID NO: 406257 - DNA, 788 bp, Homo sapiens
  misc_feature: GZ8MTXP01CZ4GY.3.63.F08.1.454.CMB.2.raw
  modified_base (296)..(296): a, c, t, g, unknown or other
  modified_base (301)..(301): a, c, t, g, unknown or other
  modified_base (330)..(330): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgcttgggttttccttgttgcttattttagaaggtgtcagtgtgaggtgcagcgtggtggagtcggtgggggagcctggtacaacggtccggtcggggggtcccctgacgtacctcctccgtgtcgcacgtccttcgtggtacttcctaccttnagtanctatacgctagtacgaacgtcgggtcccncgacggccgtaccggagggggaacggggtcgtgggacggtttcgggtcctacgacttaccgtaagtttaaggttaacggttaaggttaagttagttaacctaattaaaacgttaccgtaacgactaaacggtaacttacgaaggttacggggaaaccgggtccctaaatttaccaaccctacgttacccaacccggaaaggaaaccgaaaccgaaaccgaaccccgaaaacgtaaaccctaccgtaaacgttcgtaacttaccgttaacgaaactaaagtaccgaaaccgacgtcccgaaaggaacggaaccgaccggaacggaaccgtccgggtatttcggttaagttaaccgtttacgtgggttaccggttcgggttttagggttttaacgggggtacggggccgggttagtaccgggcgggtaaccggggttaaccccgggggttaaccccgggg

SEQ ID NO: 406258 - DNA, 878 bp, Homo sapiens
  misc_feature: GZ8MTXP01EXQCS.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggactgggctccgctgggttttccttgttgcttattttagaaggtgtcagtgtgaggtgcagcgtggtggagtcgtgggggagccgtggtcaagccggtgggggtcctgagactctcctgtcgcacgcctcgtggtacttccaccttcagtagcttatagcagtacgacgtgggtcccgccgaggccgtaccggagggggaagggggtcgtgggggacggtttcggggttacctactacgttaccgtaaagtttaaggttaacggttaggtttaaagttaagtttaaccaagtttaaacttaaccgtaacggtactaacggtaacctacgtaaacgggttaggggaaacgggggtaccccttaaatttcccaaacccgtaacttacccgtaacccgaaagggtaaaacccggaaacccgaaaaccccgggtaaccctaaaaacggtaaacccttaactaaccgttttacggttaaacttacccggttaagtaaacccaaaaaggttacccgaaaaccgtaacggttcccgaaaggggaacggtaaccggggaacccggaacggggtaaacccgggtaaccgggttcgtttaggggtttaaacggtttaaccgttttacgggttagggttacgggtttcccggggttttaaggggttttttcggggggttaacgggggaaccgggggttaatacgggggttacccgggtaaccgggggttaaccccgggggggtttaaaccccccggggg

SEQ ID NO: 406259 - DNA, 710 bp, Homo sapiens
  misc_feature: GZ8MTXP01C9P8I.3.63.F08.1.454.CMB.2.raw
  modified_base (292)..(292): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactgggctccgcttgggttttccttgttgcttattttagaaggtgtccagtgtgaggtgcagcgtggtggagtcgtgggggaggcgtggtcaagccgtgggggtccctgagactctcctgtgcacgcctcgtggacttccaccttcagtacgctatacgntagtgaacgtcggtccgccgaggccgaccggaagggggaacgggtcgtagggtaggtcgggtcctcacttacctagtttaaggtaacgttaaggttagttaagtttaacaacttaaactaacgtaacgacgaacgtaccgtacgagggttacggaacggggtacccgtatttaccgaaccctaacgttacccgtaccgaaaggaaacgaaccgaaaccgacgaaacgtaaccctactacgttacgtaagttacccgtagaaactaaagtcgaaacgtcgaccgtaagacggacgaccggaggaccaacggtcttaggttacgttacgttacgtgttcgggttcggtttaggttttaagggggttgggtaacgggtaagttacgggaccggtcggggttaacccgggggttaacccggg

SEQ ID NO: 406260 - DNA, 747 bp, Homo sapiens
  misc_feature: GZ8MTXP01AD3Y1.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgcttgggttttccttgttgcttattttagaaggtgtccagtgtgaggtgcagctggtggaggtcggtgggggaggcctgggtcaacggccgtcggggggtccctggacgtacctctccgtgtcgcacgcctgtggtacttcctaccttcgagtacgctatagactagtaggaaccgtcgggtcccgaccgacgggtaccgtaccggaaggggggaacgggggtcggtaggggtacggttcgggggttacctacgtaactaccgttaagtttaacggttaacgggtttaaggttaacggtttaacgtttaaacgtaatttaaaacgttaaccgttaaccgcgtaaaccgtaaccgtacgaagggtagggaaacggggtacccgttaactttacccgaacctacgttcccgaaccgaagaaccgaaccaaacccgaaccgaaacgaccgtactaccttggtaactactaggaactaaagtaaccgacgacgccgtagaacggtcgaccggtaacggacgtcggtcttggttacttagttacgtggttcggttgttagggtttcgggtagggcggtagcgcggtaaccgggccggggtaacccgggg

SEQ ID NO: 406261 - DNA, 618 bp, Homo sapiens
  misc_feature: GZ8MTXP01BFNO3.3.63.F08.1.454.CMB.2.raw
  modified_base (486)..(486): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagtcctctggattcaccttcagtagctatagcatcgaacgtcgggtcccgccaggcctcccggaagggggaacggggcgtgggtagtgggtctcatcctattagtacgtagtagtagtacataaactactaacgcagactacgagtagaacgggctattccaactatctaccgagaacgacaaacaccaaagtaacctcaacttgtactcttacggaaccaaattgaaaaccngtccgtagagaccgaccggaagacgaacggtcttaggttgttaacgttacgtggttaggttcgttaagggttttggggttcggggtaaccgggtagtacggcggtaaccgggcccggggttaaccccggggg

SEQ ID NO: 406262 - DNA, 521 bp, Homo sapiens
  misc_feature: GZ8MTXP02IV03Q.3.63.F08.1.454.CMB.2.raw
  modified_base (294)..(294): a, c, t, g, unknown or other
  modified_base (428)..(428): a, c, t, g, unknown or other
  modified_base (432)..(432): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactgggctccgctgggtttcctgttgctattttagaagtgtccagtgtgaggtgcagctggtggagtcgtgggggaggcctggtcaagccgtgggggtccctgagactctcctgtgcagcctctggattcaccttcagtagctatagcatgaactgggtccnccgaggctccgaggggaaggggctggagtgggtctcatccattagtagtagtagtagttacatatactcgcagactcagtgaagggccatcacatctcagagacaacgcaaagactcactgtatctgacaaatnaacngctagagagccgaggacacgggctgtacgtattacgtgtagtcgtagttttggttgggacggtatacggcgacggacgggtacccgggg

SEQ ID NO: 406263 - DNA, 573 bp, Homo sapiens
  misc_feature: GZ8MTXP02IPD5K.3.63.F08.1.454.CMB.2.raw
  modified_base (297)..(297): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttcctgttgctattttagaaggtgtccagtgtgaggtgcagctggtggagtcgtgggggaggcctggtcaagccgtgggggtccctgagactctcctgtgcagcctctggattcaccttcagtagctatagcatgaactgggtccncaggctccgagggagggctggagtgggtctcgatccattagtagtagtagtagttacatatactcgcagactcgagtgaacgggccattcaccctatctcaagagaccaacgaccaaagaactcaacttgtatctgacaaatacgaacagcctagaaggacgacccggaggacctacgggccttaggtagttaacttacgttgggtcgtacggttaaggtttttggttcgggggacgggtagtacgccggtacgggacccgggggtaacccggggg

SEQ ID NO: 406264 - DNA, 555 bp, Homo sapiens
  misc_feature: GZ8MTXP02HRDL2.3.63.F08.1.454.CMB.2.raw
  modified_base (364)..(364): a, c, t, g, unknown or other
  modified_base (398)..(398): a, c, t, g, unknown or other
  modified_base (441)..(441): a, c, t, g, unknown or other
  modified_base (487)..(487): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaacgtgggtccgccgaggcctccgaggggaaggggctggagtgggtctcatccattagtagtagtagtagtacatanactcgcagactcagtgaagggccattcaccatcncagacacaacgccaaagactcactgtatctgacaaatgaaacngcctaggaagacgccgaaggaccacggcttggtacgtattacgtgnggtcgttaagggttttcggtttgggggacgggtaattacgggcacgggggaccggggtaccccggggg

SEQ ID NO: 406265 - DNA, 504 bp, Homo sapiens
  misc_feature: GZ8MTXP02FTZMC.3.63.F08.1.454.CMB.2.raw
  modified_base (297)..(297): a, c, t, g, unknown or other
  modified_base (401)..(401): a, c, t, g, unknown or other
  modified_base (493)..(493): a, c, t, g, unknown or other
  modified_base (499)..(499): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccnccaggctccgaggggaaggggctggagtgggtctcatccattagtagtagtagtagttacatatactcgcagactcagtgaagggccattcaccatctccaganacaacgacaagaactcaactgtaatctgacaaatgaaacagcctgagagccgagacacggctgtgtatactgtcgcgagaagatactagaanaaactnaatag

SEQ ID NO: 406266 - DNA, 515 bp, Homo sapiens
  misc_feature: GZ8MTXP02IE0TF.3.63.F08.1.454.CMB.2.raw
  modified_base (458)..(458): a, c, t, g, unknown or other
  modified_base (495)..(495): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactgggctccgctgggtttcctgttgctatttagaaggtgtccagtgtgaggtgcagctggtggagtcgtgggggaggcctggtcaagccgtggggggtccctgagactctcctgtgcagcctctggattcaccttcagtagctatagcatgaactgggtccgccaggctccgaggggagggcgtggagtgggtctcatccattagtagtagtagtagtacatatactcgcagactcagtgaagggccattcactatctcagagacaacgccaaagactcactgtaatctagacaaatgaacagcctagagagccgagactacggntgtatatcgtgtcgtgttaggtttggtgggacggtanaggcgacggaccgggacggg

SEQ ID NO: 406267 - DNA, 545 bp, Homo sapiens
  misc_feature: GZ8MTXP02GC56G.3.63.F08.1.454.CMB.2.raw
  modified_base (299)..(299): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaactgggtccnccgaggcctccgaggggaaggggctgggagtgggtctcatccattagtagtagtagtagttacatatactcgcagactcagtgaagggccaattcaacccatcctaccagacgacaacgaccaaagactcactgtatctagacaaaagtgaaacctgcctagagacggccggaaggacctaaggcgtagtgtattactgtgtcgtagttggtttggggacggactagcgacggcggtacccggggg

SEQ ID NO: 406268 - DNA, 585 bp, Homo sapiens
  misc_feature: GZ8MTXP02GYMMO.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaactggtccgccaggctccgaggggagggctggagtgggtctcatccattagtagtagtagtagtacatatactacgcagactcagtaggaagggccgtattccaacctatcctaccagacgaccaacgaccaaagacctacactgtatctagactaaatgaaacaggccctaggaacgacgacccggaagggaccgaacgggcttaggtacgttaacttacgtggtacgtcggttaaggttttcggtttagggggacgggtaagtacggccgagggtacccgggggtaacccggggg

SEQ ID NO: 406269 - DNA, 656 bp, Homo sapiens
  misc_feature: GZ8MTXP02JSV3C.3.63.F08.1.454.CMB.2.raw
  modified_base (298)..(298): a, c, t, g, unknown or other
  modified_base (354)..(354): a, c, t, g, unknown or other
  modified_base (365)..(365): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtcctgagactctcctgtgcagcctcgtggacttcaccttcagtagctatagcatgaacgtggtccncgaggctcgagggagggcgtggagtggtctcgatccattagtagtagtagtagtanatatactacgnacgtactacgagttggaaacgggtccgtaattcccgaacctaagtccctacccgaagacgaaccaaacccgacaaaacgactacctaacgtgtactacgtacgactaaacgtaggaaaccacggtacctaggggaaacgaaccggacggaacggggaacctaacgggtccgttaggttacgttaacgtttaccgtaggttaccggtacggtttaagggtttttggggtttacgggggaaccggtaggttaacggccgggaacggggtacccgggggttaacccccgggggg

SEQ ID NO: 406270 - DNA, 613 bp, Homo sapiens
  misc_feature: GZ8MTXP02GFTHZ.3.63.F08.1.454.CMB.2.raw
  modified_base (301)..(301): a, c, t, g, unknown or other
  modified_base (415)..(415): a, c, t, g, unknown or other
  modified_base (442)..(442): a, c, t, g, unknown or other
  modified_base (449)..(449): a, c, t, g, unknown or other
  modified_base (457)..(457): a, c, t, g, unknown or other
  modified_base (463)..(463): a, c, t, g, unknown or other
  modified_base (505)..(505): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtgggggtccctgagactctcctgtgcagcctctggattcaccttcagtagctatagcatgaacgtcgggtccncgaggctccggaggggaaggggcgtgggagtgggtctctactcctagttagtagtagtagttagttacattaactactacgcaacgactacgagtaggacgggactatcgaacntcacagacacacgacaagactcacgtnatcgtanaactaaangaaacncgtaccagggaacgaccggaccggtaaggaccgttaaccggnttaggttacgttacttacggttggacggttacggttaggttttcgggggtttagggggaccggtaaagttcggaccggggacgggtacccgggggtaaaccccggggg

SEQ ID NO: 406271 - DNA, 525 bp, Homo sapiens
  misc_feature: GZ8MTXP02GJIOY.3.63.F08.1.454.CMB.2.raw
  modified_base (440)..(440): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaactgggtccgccaggctccgaggggaaggggctgggagtgggtctcatccattagtagtagtagtagttacatatactcgcagactcagtgaagggccattcaccatctcagacaccaacgccaagactcaactgtatctgacaaatgaacngcctgagacgcgaggacacggctgtgtatacgtgtacgcgtaggtttggttgggcgggtataggcgaggccgggtaacccggggg

SEQ ID NO: 406272 - DNA, 599 bp, Homo sapiens
  misc_feature: GZ8MTXP02HUCXN.3.63.F08.1.454.CMB.2.raw
  modified_base (374)..(374): a, c, t, g, unknown or other
  modified_base (403)..(403): a, c, t, g, unknown or other
tcagagacgcactccacgaccggtgctcgatttagcgatcgtataaggggctctgagagaggagtcttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtgggggtccctgagactctcctgtgcagcctctggattcaccttcagtagctatagcatgaactgggtcccgccaggcctccgaggggaaggggcgtgggagtggggtctcactccattagagtagtagtagttacatatactcgcanactcagtgaaggccgatcacatctcaganacaacgaccaagactacactagtactctgacaaatacgaaacgagacccgagacggaacgaccggaacgggaaccgtacgggtttaggttaggttaactttaacgtggttacggtaccggttaaggtttttgggtttggggtacggggtaagttacgggacgtacgggaccgggggtacccgggggtttaaccccg

SEQ ID NO: 406273 - DNA, 608 bp, Homo sapiens
  misc_feature: GZ8MTXP02JY23I.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaactgggtcccgccaggctccgaggggaaggggcgtggaggtgggtctcatccattagtagtagtagtagtacatatactcgcagactcagtagaacgggccgattccacctatcctaccagacgaccaaacgaccaaagacctcacttagtactactgaacctaaagtacgaaacacggtacctaggaacgacggaccggaacggaccgacgggcttggtagttaaacttacgtgtacggtcggtttagggttttgggggtttacgggggacggggtagttacggcggtaacgggggtaccgggggttaacccccggggg

SEQ ID NO: 406274 - DNA, 517 bp, Homo sapiens
  misc_feature: GZ8MTXP02IY4IK.3.63.F08.1.454.CMB.2.raw
  modified_base (424)..(424): a, c, t, g, unknown or other
  modified_base (475)..(475): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggtccctgagactctcctgtgcagcctctggattcaccttcagtagctatagcatgaactgggtccgccaggctccgaggggaaggggctggagtgggtctcatccattagtagtagtagtagttacatatactacgcagactcagtgaagggccattcaccatctcagacacaacgccaaagactcactgtaanctgacaaatgaaacagcctgaagcgccgaggtacacggctgtgtatactgncggtagtttggttgggacggtataggcaggcggtaaccgggg

SEQ ID NO: 406275 - DNA, 596 bp, Homo sapiens
  misc_feature: GZ8MTXP02GDTT5.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaactgggtcccgccgaggcctccgaggggaaggggctggagtgggtctcatccattagtagtagtagtagttacatatactcgcagactcgagtaggaacgggcctattccaaccatcctaccaagacgaccaaacgccaaagacctcaaccttgtaactctagacaaagtgaaacagcctagaacgacgaccggaaggaccgaacggtctaggtacgttaattacgtggtacgtcggtttaaggttttggggtttcgggggacggggtaatacgggacggacggggtacccgggggtaaccccggggg

SEQ ID NO: 406276 - DNA, 556 bp, Homo sapiens
  misc_feature: GZ8MTXP02IHRVI.3.63.F08.1.454.CMB.2.raw
  modified_base (299)..(299): a, c, t, g, unknown or other
  modified_base (373)..(373): a, c, t, g, unknown or other
  modified_base (397)..(397): a, c, t, g, unknown or other
  modified_base (444)..(444): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggaggcctggtcaagccgtggggggtccctgagactctcctgtgcagcctctggattcacttcagtagctatagcatgaactgggtccnccaggctccgaggggaggggctgggagtggggtctcgatcctaattagtagtagtagtagttacatatactcgnagactcagtgagggcatcacctanctcagacacaacgcaaagactcactcgtatctagacaaatagaacanacgtagacgacgaccggagacgacggactggtattacgtacgtgtacgtcggttaggttttgggtttcgggggacggtagtaacgcggacgggtaccgggtaaccccggggg

SEQ ID NO: 406277 - DNA, 535 bp, Homo sapiens
  misc_feature: GZ8MTXP02I5EI2.3.63.F08.1.454.CMB.2.raw
  modified_base (376)..(376): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgagtgcagcgtggtggaggtcgtgggggaggcctggtcaaggccgtgggggtccctgagactctcctgtgcagcctctggacttcaccttcagtagctatagcagtcggaacctggggtcccgccagggcgtccgaggggaaggggcgtggagtggtctcatccattagtagtagtagtagttacatatacncgcagactcgagtgaacgggccattcaccatctaccagaacgccaaacgcccaaagacctcactgtatctagcaaattgaacagccctgagagccgaggacacgggctgtgattactgtgcgagtttgtttgggcgggataggcgagcggtaccggggg

SEQ ID NO: 406278 - DNA, 525 bp, Homo sapiens
  misc_feature: GZ8MTXP02IEVMK.3.63.F08.1.454.CMB.2.raw
  modified_base (414)..(414): a, c, t, g, unknown or other
  modified_base (441)..(441): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctgggggtccctgagactctcctgtgcagcctctggattcaccttcagtagctatagcatgaactggtccgcaggctccgagggagggctggagtgggtctcatccattagtagtagtagtagttacatatactcgcagactcagtgaagggccgatcaccatctcagacgacaacgcaaagactcacngtaatctgacaaatgaacagcctgagngaccgaggacacggtctgtagtacttacgtgtcgtcgtagtttggtttgggacgggtattagccgtaggccggtaacccggggg

SEQ ID NO: 406279 - DNA, 590 bp, Homo sapiens
  misc_feature: GZ8MTXP02H3MHA.3.63.F08.1.454.CMB.2.raw
  modified_base (370)..(370): a, c, t, g, unknown or other
  modified_base (377)..(377): a, c, t, g, unknown or other
  modified_base (460)..(460): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggaggcctggtcaagccgtggggggtccctgagactctcctgtgcagcctctggattcaccttcagtagctatagcatgaacgtgggtcccgccaggctccgaggggaggggcgtggagtgggtctcatcattagtagtagtagtagtacatatactcgnagacctnagtgagggcctattcacatcctaccgagacgaccaacgaccaaagacctcacttgtaactctagaacctaaaagtgaaaaccngtaccctaggaagaccggacggaaaggaccacggggcttaggtacgtttaaattacgtggtacggtacggttaggtttttgggttcgggggacgggtataggccggacggggtaccggggtacccggggg

SEQ ID NO: 406280 - DNA, 535 bp, Homo sapiens
  misc_feature: GZ8MTXP02GUVI1.3.63.F08.1.454.CMB.2.raw
  modified_base (390)..(390): a, c, t, g, unknown or other
  modified_base (393)..(393): a, c, t, g, unknown or other
  modified_base (438)..(438): a, c, t, g, unknown or other
  modified_base (448)..(448): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccgaggggaaggggctggagtgggtctcatccattagtagtagtagtagttacatatactcgcagactcagtgagggccattcacntcnccagagacaacgccaaagactcactgtatctagacaaatgaaacngcctgaacgngaccgaggaccacgggctaggtcgtaattactggtacgcggttagtttggttggggcggtatggactagggccgggtaacccggggg

SEQ ID NO: 406281 - DNA, 636 bp, Homo sapiens
  misc_feature: GZ8MTXP02GTXIW.3.63.F08.1.454.CMB.2.raw
  modified_base (549)..(549): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggaggcctggtcaagccgtggggggtccctgagactctcctgtgcagcctcgtggacttcaccttcagtagctatagcatgaacgtgggtccgccgaggccgtaccggaaggggaaggggcgtgggaggtgggtctcgatcctaagtttagtagtagtagttagttacattatactacgacagtactacgagtaggaacgggcctaattccaactatccacaagacaccaacgaccaaagacctcaacttgtaaactcgtagaactaaaagtcaaacctgacctaggaacgacggacccgggaaggaccgacggtcttagggttattaacgtttacggnggttaaccggtcggtttaaggggttttcggggttgggggacgggttaatacggaccggtacgggggaccggggtaaacccccggggg

SEQ ID NO: 406282 - DNA, 626 bp, Homo sapiens
  misc_feature: GZ8MTXP02JLA05.3.63.F08.1.454.CMB.2.raw
  modified_base (305)..(305): a, c, t, g, unknown or other
  modified_base (475)..(475): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcggtgggggagccgtggtcaagccggtgggggtccctgacgactctcctgtgcacgcctcgtggtattccaccttcagtagctatagcatgaactcgggtccnccgaggcctccgaaggggaaggggctgggaggttcgggtctcgacttccaagtttagtaaggttagtagttaagttacattactactacgcaagactagagtagaacgggcctattacacctactctacaagacaaccaacgaccaaagacctacacgtagtataccganaacctaaatacgaaaccagaccgtagaacgacggacccgaagaccgacggtctaggttacgttaaacttcgttggtcggtaggttttaggtttcgggtttgggggaacgggtagtacgggacggtacggggaccggggtaacccccggggg

SEQ ID NO: 406283 - DNA, 593 bp, Homo sapiens
  misc_feature: GZ8MTXP02GBUZN.3.63.F08.1.454.CMB.2.raw
  modified_base (298)..(298): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaactgggtccncaggctccgaggggagggctggagtgggtctcatccattagagtagtagtagtagttacattatactacgcagactcagtgaagggccattcacatctccagacgacaacgaccaaagaactacactgtactcgtgtaacaaaagtcgaaacacgccctaggaacgaggaccccgaaaggaccgaccgggtcttacggtagttaagtttaccgttgtacggttacggttaaggtttttggggtttacgggggaccgggggttaataagggccggtaaacggggtcccccgggggg

SEQ ID NO: 406284 - DNA, 575 bp, Homo sapiens
  misc_feature: GZ8MTXP02G5KEP.3.63.F08.1.454.CMB.2.raw
  modified_base (364)..(364): a, c, t, g, unknown or other
  modified_base (376)..(376): a, c, t, g, unknown or other
  modified_base (398)..(398): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggggtccctgagactctcctgtgcagcctctggattcaccttcagtagctatagcatgaactgggtccgccaggcctccgaggggaaggggctgggagtgggtctcatccattagtagtagtagtagttacatanactcgcagactnagtgaagggccattcaccatcncagagacaacgccaaagacctcactgtatctagacaaatcgaaacacgcctggaacgacgacccggaagggaccaacggggtcttaggtaccgttaattaccgtgtaccggtcggttaaggttttgggttagggggcggggtattacgggccgtaggggccggggtaaccccggggg

SEQ ID NO: 406285 - DNA, 538 bp, Homo sapiens
  misc_feature: GZ8MTXP02F5P5B.3.63.F08.1.454.CMB.2.raw
  modified_base (300)..(300): a, c, t, g, unknown or other
  modified_base (398)..(398): a, c, t, g, unknown or other
  modified_base (431)..(431): a, c, t, g, unknown or other
  modified_base (444)..(444): a, c, t, g, unknown or other
  modified_base (469)..(469): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtggggggtccctgagactctcctgtgcagcctctggattcaccttcagtagctatagcatgaactgggtccnccgaggctccgaggggaaggggctgggagtgggtctcagtcattagtagtagtagtagttacatatactcgcagactcagtgaagggcattcacatcncaagacgacaacgccaaagactcaactgtatcngacaaatgaaacngcctgacgagaccgtagacacggtntagtatattcgtgtacgtgttaggtttgggttcgggacggtatacggacgacgggaccgggtacccggg

SEQ ID NO: 406286 - DNA, 536 bp, Homo sapiens
  misc_feature: GZ8MTXP02FLNKK.3.63.F08.1.454.CMB.2.raw
  modified_base (398)..(398): a, c, t, g, unknown or other
  modified_base (403)..(403): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaactgggtccgccaggctccgaggggaaggggctgggagtgggtctcatccattagtagtagtagtagttacatatactacgcagactcagtgaagggccattcacatcncaganacaacgcaaagactcactgtatctagacaaaatgaacagcctgagcgaccgaggacacggctgtagtattactggtacgcgggtttagttggggtcgggacgtagtacgacggtacgggccggggtaacccgg

SEQ ID NO: 406287 - DNA, 612 bp, Homo sapiens
  misc_feature: GZ8MTXP02GKBF7.3.63.F08.1.454.CMB.2.raw
  modified_base (305)..(305): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagtcctcgtggacttcaccttcagtagctatacgcatagaacgtcgggtcccnccgacggcctccggaggggaggggtcgtggaggtgggtctcatctattagtagtagtagtatacatactactacgcagactcgagtagaacgggcctattaccgacctatcctacgaagaacgaaccaacgaccgaaacgacctcaacttagtactcgtagaacaaagtacgaaacgcgtacctaggaacgacggaccggtacggaccgacggtcgttagttacgttatcgttaggtacgtggtttagggtttgggttacggggacggtagtacggccggacggggtacccggggttaaccccgggg

SEQ ID NO: 406288 - DNA, 576 bp, Homo sapiens
  misc_feature: GZ8MTXP02I5EAW.3.63.F08.1.454.CMB.2.raw
  modified_base (430)..(430): a, c, t, g, unknown or other
tcagagacgcactccacgaccggtgctcgatttagcgatcgtataaggggctctgagagaggagccttagccctggattccaaggcctatccacttggtgatcagcactgaacaccgaggattcaccatggactgggctccgctggtttccttgtgctatttagaggtgtccagtgtgaggtgcagctggtggagtcgtgggggaggcctggtcaagccgtgggggtccctgagactctcctgtgcagcctctggattcaccttcagtagctatagcatgaactggtccgccaggctccgaggggaacggggctgggagtgggtctcgatccattaggtagtagtagttacattactactaccgacagactcgaggtgaacgggtccgattccaccatctaccagacacaaacgcccaaagactcacgtntactcgtgacaaatacgaacacgacccgtggaagacgaccggaggaaccgacggctaggttgtaaattcgtgtagtcgttaaggttttggtttaggggcggtagttacggacggacggaccggggaccgggggttacctaaaccgg

SEQ ID NO: 406289 - DNA, 642 bp, Homo sapiens
  misc_feature: GZ8MTXP02G1DBI.3.63.F08.1.454.CMB.2.raw
  modified_base (298)..(298): a, c, t, g, unknown or other
  modified_base (366)..(366): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagccgtgggggtccctgagactctcctgtgcagcctctggattcaccttcagtagctatagcatgaactgggtcccnccgaggcctccgaggcgaagggggctgggaggtggggtggctaggttatgtccacatgataggaaaanaaaaaatgttaacgacagacctcccgtagaacgggtcgattcaccatctaccagagacaattacccaaacaaccacccttagttactttacgactaaatacgaaacctagacccgtagaacgtaaactacggaaacgtaccgaaacggtaccttaagttaccttaatttaaccgtaggttacggaccggtaaagtaacgtaacgtaaccggtaaacggttaacccgggaaacgtaaaaccgtaaaagttacggtaaacccggtttaaaaccggggg

SEQ ID NO: 406290 - DNA, 529 bp, Homo sapiens
  misc_feature: GZ8MTXP02HT9VJ.3.63.F08.1.454.CMB.2.raw
  modified_base (281)..(281): a, c, t, g, unknown or other
  modified_base (349)..(349): a, c, t, g, unknown or other
  modified_base (390)..(390): a, c, t, g, unknown or other
  modified_base (428)..(428): a, c, t, g, unknown or other
  modified_base (430)..(430): a, c, t, g, unknown or other
  modified_base (433)..(433): a, c, t, g, unknown or other
  modified_base (435)..(435): a, c, t, g, unknown or other
  modified_base (437)..(437): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattccaccttcagtagctanagcatgactggccgcagctcgagggaggctggagtggtctcactcattagagtagtagtagtacatanactcgcagctcagtagaagggccattcacctatccaccganacgaacaaccgtaccaaagactcaactgtaatcgtaananaanananacacgagacgacgacgacgacgacgcgtgtacgtatacgtcgtcgtagttagttggttcgggtacggtacgacgacggacggacggtaccgg

SEQ ID NO: 406291 - DNA, 666 bp, Homo sapiens
  misc_feature: GZ8MTXP02GZTHJ.3.63.F08.1.454.CMB.2.raw
  modified_base (502)..(502): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctcgtggacttcaccttcagtagctatagcatgaacgtgggtcccgccgaggcgtccgaggggacggggtcgtggaggtgggtctcatcctagttagtagtagtagtagtacatatactcgcagactacgagtaggaacgggcctaattccaacccgtataccctaccgaaagacgaacccaaaccgtacccaaaagacctccaaactttagtaatacccttagaaccctaaaagtacgaaaaccncggtaccctaagggaacggaccggacccggaaaggggaccctaacggggtcctttagggttacgtttaaacttaccggtggttacggtacgggtttaggtttttcggggttcggggacgggttagtacggacgggtacggggtacccgggggtaacccccgggg

SEQ ID NO: 406292 - DNA, 540 bp, Homo sapiens
  misc_feature: GZ8MTXP02GHRJP.3.63.F08.1.454.CMB.2.raw
  modified_base (366)..(366): a, c, t, g, unknown or other
  modified_base (444)..(444): a, c, t, g, unknown or other
  modified_base (448)..(448): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcaccttcagtagctatagcatgaacgtgggtcccgcaggcctccgaggggaagggcgtgggagtgggtctcactccattagtagtagtagtatacatatacncgcagtactcagtagaacgggctatcgaccatctcaagagaccaacgaccaagactctagtgtaatctagacaaagtnaacngcctagagacgccgaaggccaacggcttagtcgtaattcgtgtcgcggttagtttggttggggacggtatagcgtacgggccggtaccgggg

SEQ ID NO: 406293 - DNA, 598 bp, Homo sapiens
  misc_feature: GZ8MTXP02F9RGF.3.63.F08.1.454.CMB.2.raw
  modified_base (465)..(465): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcaccttcagtagctatagcatgaacgtgggtcccgccgaggcctccgaaggggaaggggcgtgggaggtgggtctcatccattagtagtagtagtagtacatatactcgcagactcgagtagaagggcctattccaccattccaccagaacgaccaacgccaaagactcaagttgtatccgtagaaccaaaagtcgaaacncgacctaggaacgacggacccggtaggaccctaggtcgtgttaggttacttacgtcgttggtacgttagggtttgggtttcggggtacggggtagtacggtacggtaccgggtaccgggggttaccccggggg

SEQ ID NO: 406294 - DNA, 540 bp, Homo sapiens
  misc_feature: GZ8MTXP02GHBGJ.3.63.F08.1.454.CMB.2.raw
  modified_base (378)..(378): a, c, t, g, unknown or other
  modified_base (517)..(517): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaaggccgtgggggtccctgagactctcctgtgcagcctctggattcaccttcagtagctatagcatagaacgtgggtcccgccgaggctccgaggggaaggggctgggaggtgggtctcatccagttagtagtagtagtagtacatattactcgcanactcagtagaagggccgattcaccatcacagacgacaacgaccaaagactacatgtatctagacaaatcaaacagcctagagacgaccgagaccgacgctgtatattacgtgtacgtcgtagtttggtggggacggtanaggcgacgggaccgggtaccggg

SEQ ID NO: 406295 - DNA, 574 bp, Homo sapiens
  misc_feature: GZ8MTXP02HPM1T.3.63.F08.1.454.CMB.2.raw
  modified_base (297)..(297): a, c, t, g, unknown or other
  modified_base (366)..(366): a, c, t, g, unknown or other
  modified_base (534)..(534): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaagcctgggggtccctgagactctcctgtgcagcctctggattcaccttcagtagctatagcatgaactgggtcccnccaggctccaggcaaggggctgggagtggggtggcagttatgtccacatgataggaaaagaaaaaaatntttaacgacaagaccttaccccgtaggaaacggggttcgaatttccaacctatcctacccagaacgaacaaacttacccaaacaaaccaacccttagttaactttgactaaaatcgaaacagcctagaagaactagaagacacgctaactcttataactgtgcgaganatcgacgtaccggaacgacgaaacgtcgacgttaaccggg

SEQ ID NO: 406296 - DNA, 579 bp, Homo sapiens
  misc_feature: GZ8MTXP02IR5C0.3.63.F08.1.454.CMB.2.raw
  modified_base (181)..(181): a, c, t, g, unknown or other
tcagagacgcactccacgaccggtgctcgatttagcgatcgtataaggggctctgagagaggagccttagccctggattccaaggcctcctcactggtgatcagcactgagcaccgaggattcaccatggaactgggctccgctgggttttccttgttgctattttagaaggtgtccagtntgaggtgcagctggtggaggtctgggggaggcctggtcaagccggtggggtccctgagactctcctgtgcagtcctctggattcacttcagtagctatagcatgaacctggtaccgccagggctccgaggaaggggtcagggtagtgggtctcactactattagacgttagtagtagttacattagtactacgactacgtactcgaaggtacgacgggtaccgtacgtcgaaccctactaccgtccaacgacgaccaaaccgaccaaacgaacgtactactcgttaactcaaagctagttacgaacgaacgtcctagagaccgacggacgacgaaccgcgcgtagtctacgtgtacgcgtagtttggttggcggtagtagcgagacggtacccggggg

SEQ ID NO: 406297 - DNA, 653 bp, Homo sapiens
  misc_feature: GZ8MTXP02FQO0Y.3.63.F08.1.454.CMB.2.raw
  modified_base (305)..(305): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagcgtggtggagtcgtgggggagcctggtcaagccgtgggggtccctgagactctcctgtgcacgcctcgtggacttccaccttcagtagctatagcatagaacgtgggtcccncgaggctccggaggggaagggctgggagtgggtctcatctagttagagtagtagtatacatattactcgcagactcgagtaggaacgggcctattaccaacctatcctaccgaagaacgaccaacgacccaaagaaacctcgaaacttgaactacgtagaaaccttaaaagacgaaaccgacgtaccgtaaggaacgaacggaccccgggtaaggaacccgaccgggtacttaggttacgttaacgttacggtaggttacggtcggtttaaggggtttttcggggttagggggaaccggttagtacgggtacgggaccgggggtacccgggggttaaacccccggggg

SEQ ID NO: 406298 - DNA, 642 bp, Homo sapiens
  misc_feature: GZ8MTXP02FMCS8.3.63.F08.1.454.CMB.2.raw
  modified_base (433)..(433): a, c, t, g, unknown or other
  modified_base (439)..(439): a, c, t, g, unknown or other
  modified_base (444)..(444): a, c, t, g, unknown or other
  modified_base (464)..(464): a, c, t, g, unknown or other
  modified_base (510)..(510): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcacccttcagtagctatagacatgaacgtcgggtccgccgaggctccgaaggggaacggggctgggaggtgggtctcactcctagttagtaagtagttagtagttaacatactactacgcagactcgagtgacggggctatcacatctccagacacaacgcaaagacncacgtntactntgaactaaagtacgaaaccngacccgtaggaacgacggaccggaaacgggtacccaaacccgggtntaggttacgttaaacgttacgttccgggtaggtaccgggtttaagggtttttcgggggttgggggtaaccggggtttaaagtacggtaccccggggaaacgggggtcccgggggttaaaaccccccgggggg

SEQ ID NO: 406299 - DNA, 733 bp, Homo sapiens
  misc_feature: GZ8MTXP02GO3XD.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaacgtcgggtcccgccgacggcctacccggaaggggaacgggggtcgtaggggagggttcggggtcctacgtaactaccctaagtttaggtaagtaagttaagtttaacaagttaactaaccgttaacgcaacgtaactaccgaaggttacggaaacggggcccgtaacgtttacccaaccctacttcccacccgaagaaccgaaacccaaaccggacccaaaacggtaacctaccaaccgttaggttaactaccgttacgaactaaaactacggaaaaccacgtacccgaggaacgaccgggaccccgaagggaacccgacgggtacgttaggttagttaacgtttaaaccgtggttacggtacggtttaaggtttttggggttaacgggggacgggtaagtacggacggaaccggggtccgggggtaacccgggggttaacccc

SEQ ID NO: 406300 - DNA, 632 bp, Homo sapiens
  misc_feature: GZ8MTXP02JDASJ.3.63.F08.1.454.CMB.2.raw
  modified_base (302)..(302): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctcgtggattccaccttcagtagctatagcatgaaccgtgggtccnccgaggccgtccggaaggggaacgggcgtagggtaggtcggggtctcattccgtaagtttagtaggtttagtagttaagttacctataactactacgacagtactcgagtagggaacggtccgtaattccaacctactcctacgaagacgaacaaccgaacaaacgaactcaactgtaactcgtagaactaaacacgaacacgacgtaggaacggacgaccggaaggacgtacggtcttaggtacgttagttacgtggtacggtaggttaggttttggtacgggggtacggtaagtcggacggtacgggacccgggggttaaccccgggg

SEQ ID NO: 406301 - DNA, 591 bp, Homo sapiens
  misc_feature: GZ8MTXP02H4OSP.3.63.F08.1.454.CMB.2.raw
  modified_base (262)..(262): a, c, t, g, unknown or other
  modified_base (303)..(303): a, c, t, g, unknown or other
  modified_base (428)..(428): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctgggtggagtcgtgggggaggcctggtcaagccgtggggggtccctgagactctcctgtgcagccctntggattcaccttcagtagctatagcatagaactgggtcccnccgaggctaccgaggggaaggggcgtggagtggggtctcgatccattagtagtagtagtagtacatatactgcagactgagtgaaggcctattccacatctaccagagaccaacgccaaagtacncaactgtatctagacaaagtacgaaactgacctaggacgacggcccgaagggaccacggtcgttagttcgttaaacttacgtacggttaggtcgttaagggtttttgggttacgggggtacggtagttaggaccgtacggggacccgggggtaaccccggggg

SEQ ID NO: 406302 - DNA, 641 bp, Homo sapiens
  misc_feature: GZ8MTXP02HDVDE.3.63.F08.1.454.CMB.2.raw
  modified_base (404)..(404): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggaggcctggtcaagccgtggggggtccctgagactctcctgtgcagcctcgtggattccaccttcagtagctatagcagtagaacgtcgggtcccgccgaggcctaccggaaggggaacggggtcgtaggggtagggttgggtctacacgtcctaagtttaggtagtagttaagttagtaacattaactacncgcagactcgagtaggaacgggcctattccaactatcctaccgaagaacgaaccaaccgaccaaagactcagttgtatcgtagaaactaaagtacgaaacctagccgtaaggaacggacgaccgggaacggacctacgggtacgttggttacttaagttaccggtggtcggtacggtttagggtttggggttacgggacgggttatacggacgtacgggggaccggggtaacccggg

SEQ ID NO: 406303 - DNA, 645 bp, Homo sapiens
  misc_feature: GZ8MTXP02HCZ1D.3.63.F08.1.454.CMB.2.raw
  modified_base (300)..(300): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagctctcctgtgcagcctcgtggattcaccttcagtagctatagcatgaacgtcgggtccnccgacggctaccgaaggggaacggggctgggaggtgggtctcatcctagttagtagtagtagtagttacatatactcgcagactcgagtaggaacggggcctaattccaacctactcctacaagacaacccaacggacccaaagaccttacaacgttcgtaactccttaagaacctaaagtacgaaaaccgtcggtacccaggaacggacgacccggaagggaaccgtacggtacggttagttagttaacgtttagttccgtaggtcggtttaggggtttaagggtttacggggtaccgggggtagtacggtacggtaccgggtaaccgggggtaaccccggggg

SEQ ID NO: 406304 - DNA, 551 bp, Homo sapiens
  misc_feature: GZ8MTXP02IRRWN.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtcctgagactctcctgtgcagcctctggattcaccttcagtagctatagcatgaacgtgggtccgccgaggctaccgaggggaagggcgtgggagtgggtctcatccattagtagtagtagtagttactatactactcgcagactacagtgaaacgggcctattcacctatctcaagacgacaacgcaaagactcattgtactctagacaaatagaacgcgaccgtagagacgaccgaggaccacgggctaggtagttaacttcgtgtacgtcgttaggtttcggttaggacggtataggcgacggccgggtaaccggg

SEQ ID NO: 406305 - DNA, 593 bp, Homo sapiens
  misc_feature: GZ8MTXP02HTV2Y.3.63.F08.1.454.CMB.2.raw
  modified_base (260)..(260): a, c, t, g, unknown or other
  modified_base (299)..(299): a, c, t, g, unknown or other
  modified_base (367)..(367): a, c, t, g, unknown or other
  modified_base (393)..(393): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgcttattttagaaggtgtccagtgtgaggtgcagctggtggagtcgtgggggaggcctggtcaaggccgtgggggtccctgagctctcctgtgcagcctntggattcaccttcagtagctatagcatgaactgggtccnccaggctccgaggggaagggctggagtggctcgatccattagtagtagtagtagtacattatactcgnagactcaggtgaagggccattcaccntctaccagagaacacgactaacgactcacttgtactctagacaaaagtcgaaacacgtccgagaggacgacccggaggaacccgcgggtcttagggtagttaagtttaaccgttggtacggttccggtttagggtttttaaggtttcgggggaaccgggttaagacggtacggacgggtaccgggggtaaaccccggggg

SEQ ID NO: 406306 - DNA, 641 bp, Homo sapiens
  misc_feature: GZ8MTXP02IVKIK.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttcctgttgctattttagaaggtgtccagtgtgaggtgcagctggtggagtcgtgggggagcctggtcaagccgtgggggtccctgagactctcctgtgcacgcctcgtggtacttccaccttcagttacgctatagcagtcgaacgtcgggtcccgccgacggcgtccgaaggggaaggggcgtagggaggtcgggtctcgatcctattagagtagtagtagttacatatactcgcagtactgagtgaacgggcctattcaacctatcctccgaagacgaaccaaccgtaccaaagacctctaaactgtaatcgtagacctaaagtacgaaccacggtaccgtaggaaacgacggacccggaaggaaccgacgggtacttaggttacgttaacttaccggtggttacggacgggtttagggttttggggttacgggggtacgggtaagttaccggtacgggacgggtacccgggggttaaaccccgggg

SEQ ID NO: 406307 - DNA, 592 bp, Homo sapiens
  misc_feature: GZ8MTXP02FUVK7.3.63.F08.1.454.CMB.2.raw
  modified_base (415)..(415): a, c, t, g, unknown or other
  modified_base (449)..(449): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattcaccttcagtagctatagcatcgaacgtgggtccgccaggcctaccggaggggaaggggctagggaggtcgggtctcatcctaagttagtagtagtagtagttacatactactcgcagactcgagtaggaaacgggcctattccaacctanctaccagacacaaacgctaaagactcactagtancgtagaacaaatcgaaactgacctaggaacgacggacgaaggaccacgggtctaggttagttacttacgtcggtagtcggttaaggttttggggttacgggggacggtaatcggacggacgggtcccgggggtaaaccccggg

SEQ ID NO: 406308 - DNA, 616 bp, Homo sapiens
  misc_feature: GZ8MTXP02I7F8B.3.63.F08.1.454.CMB.2.raw
  modified_base (306)..(306): a, c, t, g, unknown or other
  modified_base (421)..(421): a, c, t, g, unknown or other
  modified_base (451)..(451): a, c, t, g, unknown or other
  modified_base (484)..(484): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttcctgttgctattttagaaggtgtccagtgtgaggtgcagctggtggagtcgtgggggaggcctggtcaaggccgtgggggtccctgagactctcctgtgcagcctcgtggtattccaccttcagtagctatagcagtagaacgtcgggtcccnccgaggtccgtccgaaggggaacggggcgtgggaggttcgggtctcgtatcctagtttagtagtagtagtagtacattatactcgcagactgagtagaacgggcaattccaactntccacgaagacaaccaacgaccaaaagacnccaagttgtactctgaacctaaagtacgaaacnggtcctaggacgacggaccgaggacccaggtctagtcgttaaacgttcgtgggaccggttgttaagggtttttcggggtacgggggaccggttaagtacgggaccgacggggtacccggggtaaccccgggg

SEQ ID NO: 406309 - DNA, 705 bp, Homo sapiens
  misc_feature: GZ8MTXP02G45FG.3.63.F08.1.454.CMB.2.raw
  modified_base (230)..(230): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactgggctccgctggtttcttgttgctatttagaggtgtcagtatgaggtgcagctggtggagtcgtgggggagcctggtcaagccgtgggggtcccngagtactctctgtgcagcctgtgtacttcgaccttcagtagctatagctagtcgaacgtcggtccgccgcggaccgtccggaaggggaggggtcgtaggaggttcgggtctacacttacctatttaggtagttacgtaagttaacgttactaattaacgttacgtaccgtactacgtaccgttacgtaaggtacgggaaaccgggtaccctagttacccaaccctagtaccctaccgaaaggaaccgaaccgaaaccgtacccaaaacggaacccttctaaacgttacgttaactcgttaagaacgtaaaagtacccgaacgaccggtactacgaaacggacggaccggaaagggtacccgaacggttcgtttggttaactttagtacgttagggtcggtaacggtttgggtttaacggggttacggggagttaacggtcggacgggaacggggtacccggggttaaccccgggg

SEQ ID NO: 406310 - DNA, 647 bp, Homo sapiens
  misc_feature: GZ8MTXP02HJVRL.3.63.F08.1.454.CMB.2.raw
  modified_base (262)..(262): a, c, t, g, unknown or other
  modified_base (550)..(550): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactgggctccgctgggttttccttgttgctattttagaaggtgtccagtgtgaggtgcagctggtggagtcgtgggggagcctggtcaaggtccggtgggggtccctggagtactctcgtgtgcagcctntggattccaccttcgagtagctaatgacagtagaacgtcgggtcccaccgaggcctaccggaaggggaacggggcgtgggaggtcggtctacacttacctaagtttagtacgtagtagtagttaacattaactaacgtcgactaaggacttacgaggtacggaacgggcctagttccaacctagtccacaagacgaaccaacgtaccaaagactcactgtaactcctaagacctaaaagtcgaaacacgtccaaggacgtaccggacggtaacgccgtaaccgggttnttaggttacgttacttacggtggtacgttacggtttagggtttaacgggacggggaacgtagtaccggaccgggtaccgggtaccggggtaacccgg

SEQ ID NO: 406311 - DNA, 612 bp, Homo sapiens
  misc_feature: GZ8MTXP02JVKSJ.3.63.F08.1.454.CMB.2.raw
  modified_base (248)..(248): a, c, t, g, unknown or other
  modified_base (297)..(297): a, c, t, g, unknown or other
  modified_base (496)..(496): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactgggctccgctgggtttcctgttgctatttagaagtgtccagtgtgaggtgcagctggtggagtcgtgggggaggcctggtcaaggccgtgggggtccctgagactctcctgtncagcctcgtgattcacttcagtagctatagcatacgaacgtcgggtccnccgacggcctaccggaagggggaacggggcgtagggtagggtcgggtctacgatccaagttagtaagtagtacgtaagttactataacttactacggacaacgtactcgaggtacgaaacggggcctattaccacctatccctaacagaacgaaccaaacgacccgaaagaacctacaacttgtaactctagaataaanacgaactcgacgtagacgacgacggagactcggtactgtaccgttaataccgtggtcggtaacgttggtttgggtcgggtacggtagtacgtcggaacggtcggggtaaccccggg

SEQ ID NO: 406312 - DNA, 643 bp, Homo sapiens
  misc_feature: GZ8MTXP02G84RL.3.63.F08.1.454.CMB.2.raw
  modified_base (300)..(300): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtgggggtccctgagactctcctgtgcagcctctggattcaccttcagtagctatagcatgaacgtgggtcccnccgagctccgagggaagggcgtggagtgggtctcatccattagtagtagtagtagtacatatactacgcagactcgagtaggaacgggtccgtattacacctatcctacgaagacgaccaacgaccaaacgacctcgactagtactactagactaaaagttcgaaacgtacgtccgtaaggacgacggaccggaaaggacccgtacgggtccgttaggttacgttaaacgtttaaccgttggggtcggttaaaccgggttgggtttttaacgggggtttcgggggaccgggggttaatacgggtaccgggtaaccgggggtccgggggttaaacccccggggg

SEQ ID NO: 406313 - DNA, 660 bp, Homo sapiens
  misc_feature: GZ8MTXP02GI9KF.3.63.F08.1.454.CMB.2.raw
  modified_base (568)..(568): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctatttcaaaaggtgtccagtgtgaggtgcaggtggtggagacgtgggaggaggcttgatccgaggccgtggggggtccctggagtactctcctgtgcacgtccctcgtcggtcttccaccgtcagtacgcagctacatgcacgtcgggtccgccgaggcctaccggaggggacggggcgtaggggaggtcggtctacgtagtttaacttaccgtacttcgtacggtacctacgtacttacgtaccgtcccgacccggtaggaaccggtaccgtaacttaaccacttcctacgaagacgtaacgtacgttaccgaagaaccgtacggttactacttaccgttaacaaagttaccgaaacctaacgtgaacggaccgaccgaccgaacgtcggttacctttataccgnggtacgacgtagatacgttcggacggttcggttaccgggaccttcgtaaccgttggttacctacgttcacgtttcggacggttcgggtcccg

SEQ ID NO: 406314 - DNA, 654 bp, Homo sapiens
  misc_feature: GZ8MTXP02GNO6U.3.63.F08.1.454.CMB.2.raw
  modified_base (255)..(255): a, c, t, g, unknown or other
  modified_base (404)..(404): a, c, t, g, unknown or other
  modified_base (576)..(576): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctatttagaaggtgtccagtgtgaggtgcagcgtggtggagtcgtgggggaggcctggtcaaggccgtgggggtccctgagactctcctgtgcncgcctcgtggtattccaccttcagtagctatagcatcgaacgtcgggtcccgaccgacggtccgtaccggaagggggaacggggcgtaggggaggtcgggtctcgactccgtaagtttagtaagtagttagtagttaacatatactcgnacgactacgagtaggaacgggcctaattcccgaaccctatccctacgaaagaacgtaacccaaaccggacccaaaagtaacctcctaaacgttagtaacttcgtaagaaactaaaagtacgaaaaccgagtccgtaaggaacgaaccggacccgggaaggtacaccgggttnttagttacgttattacggtgtacgtcggtttaggttgggtcgggacgtacgacggcggacggggtaccgggtacccgg

SEQ ID NO: 406315 - DNA, 831 bp, Homo sapiens
  misc_feature: GZ8MTXP02GAKDQ.3.63.F08.1.454.CMB.2.raw
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagcgtgggtggagtcggtgggggaggccgtggtcacggccggtcgggggtccctgacgactctcctgtgcacgtcctcgtaggtacttcctaccttcgaacggtacgacttatacgactagtcgtaaaccggttcggggtaccccgccgacgggtccgtacccgggaagggggtaacgggggtcgttaggggtacgggttcggggttaccgttaccgtaacgttacccgtaaaggtttttaacggttaacggtttaagggtttaaaccggtttaagtttaaaccgtaacttaaaccgtttacccgtaccggtacaaacggttacctacggtaacggttacgggaaaccggggtacccgtaacttaccaacccggttattacccgaccgaaaggaccgaaacccgaaaccgaacccgaaaacgtaccctacctaacggtttactaacttacgttacgaactaaaacgtacgaaaccgtacgcccgtaaggaacggacccggacgggaaaccggaccgagggttaccgtggtttaacgttacgttacgttggttaccggtaggggtttttacggtttgggggtttcggggaccggtaaggttacggaccggggacgggtaccccgggggttaaaccccgggg

SEQ ID NO: 406316 - DNA, 600 bp, Homo sapiens
  misc_feature: GZ8MTXP02FX1D5.3.63.F08.1.454.CMB.2.raw
  modified_base (256)..(256): a, c, t, g, unknown or other
  modified_base (307)..(307): a, c, t, g, unknown or other
  modified_base (414)..(414): a, c, t, g, unknown or other
  modified_base (459)..(459): a, c, t, g, unknown or other
  modified_base (479)..(479): a, c, t, g, unknown or other
  modified_base (481)..(481): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgcttgggttttccttgttgcttattttagaaggtgtccagtgtgaggtgcagctggtggagtcgtgggggagcctggtcaaggccgtgggggtccctgagactctcctgtgcncgcctctggtacttccaccttcagtagctatagcagtgaacgtcgggtccncgacggctaccggaggggagggtcgtggtagtggtctcatctattagtagtagtagtagtactagtactactacgcagtactcgagtaggaacgggctatcaacctntaccacagacgaacctaacgaccaaagaacctctaacgtgttacnctagaaccaaagtccaaacncncgtaagacgaccgacgtacgactacggtcttaggtcttaaagttccgtggttacgtggtttaggtttggggttacgggacggggtatacggacggtaacgggtcccggggtaaacccgg

SEQ ID NO: 406317 - DNA, 551 bp, Homo sapiens
  misc_feature: GZ8MTXP02F62W7.3.63.F08.1.454.CMB.2.raw
  modified_base (251)..(251): a, c, t, g, unknown or other
  modified_base (256)..(256): a, c, t, g, unknown or other
  modified_base (299)..(299): a, c, t, g, unknown or other
  modified_base (374)..(374): a, c, t, g, unknown or other
  modified_base (380)..(380): a, c, t, g, unknown or other
  modified_base (456)..(456): a, c, t, g, unknown or other
  modified_base (463)..(463): a, c, t, g, unknown or other
  modified_base (486)..(486): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactgggctccgctgggttttcctgttgctattttagaaggtgtccagtgtgaggtgcagctggtggagtcgtgggggagcctggtcaagccgtgggggtccctgagactctcctgtgcngcctntggcttcaccttcagtgctatagcatcgaacgtcgggtacccncgaggcctccggaggggaaggggtctggagtggtactcgatccagttagtagtagtatagtacattatactacgnagactnagtgaacgggccattcccgactatcacaagacaacaacgaccctaagaaactcacgtatactactagaacaaagtnaaaccgngacagacgacgacgagacgtcgntgtagttatcgtgtacgtcggttaggtttggtacggacgtagtcggacgacggtaccgggtaccg

SEQ ID NO: 406318 - DNA, 548 bp, Homo sapiens
  misc_feature: GZ8MTXP02JHJI2.3.63.F08.1.454.CMB.2.raw
  modified_base (403)..(403): a, c, t, g, unknown or other
tcagagacgcactccacgaccggtgctcgatttagcgatcgtataaggggctctgagagaggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggagccgtggtcaaggccgtgggggtccctgagactctcctgtgcagcctctggattcaccttcagtagctatagcatgaactgggtccgcaggctaccgaggggaagggcgtggaggtcgggtctcagtccagttagtacgtagtagtacatactactacgcagactcgagtagaagggcattcacctatccncaagacgacaacgacaaacgaactcgactagtactctagacaaaagtcgaaactacgacctaggaacgtacgaccgaaggacacggtgtacgtgttactacgtgtcgacgttgtttggtggcgagtagcgacggcggaccggtac

SEQ ID NO: 406319 - DNA, 556 bp, Homo sapiens
  misc_feature: GZ8MTXP01DXLGJ.10.12.B01.1.454.CMB.2.raw
  modified_base (370)..(370): a, c, t, g, unknown or other
  modified_base (405)..(405): a, c, t, g, unknown or other
  modified_base (432)..(432): a, c, t, g, unknown or other
  modified_base (477)..(477): a, c, t, g, unknown or other
  modified_base (537)..(537): a, c, t, g, unknown or other
tcagcatagtagtgcacgaccggtgctcgatttagtagtgtagattccgcgggggtgggtccaggaggcagaactctgggtgtctcaccatggcctggatccctctacttctcccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtaatataaaggacactgacgacggcccccagggactccccgtgagcgtattcctctcggccctccagctacgagggaaaccaaacnggtgacgttagaccatcgaggcgggacgcccgggnagggaggacgaggcgtggactattacngtacaatcaacgaagactattactggtacttagttggtgttcggnggtagggtccaagtctgaccgtcgttaggtcacgttccgaggcctccgtcccctggtccncgttctcgttcccgtcccc

SEQ ID NO: 406320 - DNA, 566 bp, Homo sapiens
  misc_feature: GZ8MTXP01DOYOI.10.12.B01.1.454.CMB.2.raw
  modified_base (303)..(303): a, c, t, g, unknown or other
  modified_base (479)..(479): a, c, t, g, unknown or other
  modified_base (483)..(483): a, c, t, g, unknown or other
  modified_base (540)..(540): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccaggggagtccctgagactctcctgtgcagcctctggatgaggttcaataactatgctatgcacgtgggtccncaggctccgaggggaagggctgggaatggatgactagttatttcacgacgatcgaccaaaccgaaaacataacgtacgcggtaagttcggtaggaggggccgctggcattcgtactccaagagaacaagttcgaaagaactacgtctagtaccctagacaaagtgaaacctagtcnggancgcggaagacacgggtccttcgttaactttggcgcgttacgttaaggaaggtgggancgttagtaaggggttaatttaacggg

SEQ ID NO: 406321 - DNA, 581 bp, Homo sapiens
  misc_feature: GZ8MTXP01CZO3E.10.12.B01.1.454.CMB.2.raw
  modified_base (378)..(378): a, c, t, g, unknown or other
tcagcatagtagtgcacgaccggtgctcgatttagtagtgtagattccgcgggggtgggtccaggaggcagaactctgggtgtctcaccatggcctggatccctctacttctcccctcctcactctctgcacagggtccgaggcctcctatgagctgacacagccaccctcggtgtcagtgtccccaggacagacggccaggatcacctgctctggagatgctttgccgaaagcaatatgacttacgtggtaccagcaagaacgccaggccacggccctgtaggaacttgtatataaaggacactgacgacggcccccgagggactcccgtgacgcgtattctcgtcggccctccgagctacgaagggaaacaaacgngtcgacgttacgaccatcgaggcgggacgcccgggacaggaggacgaggcgtggacttatactgtacaatacaagaacgaactattacgttggttacttaggttgggtgttcgggtacgggtacgggtacaaggctcggacccgtcgaggtcgcgaccgacgcctccgccccgtggtcccacttccgtccgttccccgtcccc

SEQ ID NO: 406322 - DNA, 581 bp, Homo sapiens
  misc_feature: GZ8MTXP01AHIXL.10.12.B01.1.454.CMB.2.raw
  modified_base (436)..(436): a, c, t, g, unknown or other
  modified_base (460)..(460): a, c, t, g, unknown or other
  modified_base (505)..(505): a, c, t, g, unknown or other
  modified_base (560)..(560): a, c, t, g, unknown or other
tcagcatagtagtgcacgaccggtgctcgatttagtagtgtagattccgcggggtgggtccaggaggcagaactctgggtgtctcaccatggcctggatccctctacttctcccctcctcactctctgcacagggtccgaggcctcctatgagctgacacagcccaccctcggtgtcagtcgtccccaggacagacggccaggatccacctgctcgtggagatgtcttgaccgaagacaatatgtcttacgtggtaccagcaagaacgccgacggccgacggccctgtaggtaacttgtaatagtaaaggactacgtgacgaccggacccccgagggactcccgtgacgcgtattctcgtcggccctccgagtctacgaggaaaccaacgtaagtcgtacgttacgacctatacgacggacgggaccgcccggganaggaggacgaggctagactatacngtaacaatcaacgagactattacgtagtacttagtgggtgtcggnggagtacgagtcgtcgttaccgtcaggtcacgcccgaggcctccgccccgtgtcnccgttcctccgttcccgtccc

SEQ ID NO: 406323 - DNA, 556 bp, Homo sapiens
  misc_feature: GZ8MTXP01D5X4G.10.12.B01.1.454.CMB.2.raw
  modified_base (363)..(363): a, c, t, g, unknown or other
  modified_base (394)..(394): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccacggcccctgtggaacttgtatataaggacacgtgagacggcccccagggactccctgagcgtacttctctggccctccagctcgagggaacaacngtgacgttgaccatcgagcggacgcccgggnaggaggacgaggctagactattactgtacaaagtcaacgaagactaattacgtaggttacttgttagggtggttcggcgggtaggtccgaagctcgccgtcgttaggtcacggcccgacggcctcgcccccgtggtcctacttccttccgttccccgtcccc

SEQ ID NO: 406324 - DNA, 693 bp, Homo sapiens
  misc_feature: GZ8MTXP01DQ97F.10.12.B01.1.454.CMB.2.raw
  modified_base (242)..(242): a, c, t, g, unknown or other
  modified_base (251)..(251): a, c, t, g, unknown or other
  modified_base (254)..(254): a, c, t, g, unknown or other
  modified_base (262)..(262): a, c, t, g, unknown or other
  modified_base (281)..(281): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttggggttttcctcgttgcttcttttaagaggttgtccagtgtcaggtgcagttggaggaatcgtgggggagcgtggtccagccaggggcgtccngagctctcngcncacgctgngtatggagtacaaatactntgactagtcgctagtggactccccgacgacggtccgtacggaagggggaacgggtctaaggaagtggatgaactagtttacttccaacgtacgtatacgaaacccaaaaaccaactacgttaaaccgtaaccggggtacgggttaacggtttcggggacgggggaccggggtccctcgttcggacctagttcccgtcgtaccgaagaacgaaactaaacgttaaccgaaacgtaaactccttcgtaacgtacgtaacgaaactaaagtaccgaagtagtacgtaggaacggaccggaccgggaacggaaccggaccgggttcccgttacgtttacgttttggacggttaccgttaacgttagggtaagggtagggaacgttagtagggttaaggggttcgtttggtaacggg

SEQ ID NO: 406325 - DNA, 612 bp, Homo sapiens
  misc_feature: GZ8MTXP01AN2MR.10.12.B01.1.454.CMB.2.raw
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccaggggagtccctgagactctcctgtgcagcctcgtggatgaggttcaaatactatgctatgcacgtcgggtccgcagggcctccggagggggaagggctagggaatggatgactagttattacacagatacgaaccaacaaacactacgacggcggtaaggttcgggtagggacgggggccctgtcggctacgttccgtacctaccgaaggtaacgaactaacgttaacgaaacgtaacctacgttcgtacgtaacctacgaactaaatcgaaactagtctaggaacgacggaccggaaggccaccgggtccttacgttacgtttggcgacgttaacgtaagggacggtgggacgtgttaagggtggggttaactttcggg

SEQ ID NO: 406326 - DNA, 561 bp, Homo sapiens
  misc_feature: GZ8MTXP01AI0U8.10.12.B01.1.454.CMB.2.raw
  modified_base (252)..(252): a, c, t, g, unknown or other
  modified_base (363)..(363): a, c, t, g, unknown or other
  modified_base (389)..(389): a, c, t, g, unknown or other
  modified_base (408)..(408): a, c, t, g, unknown or other
  modified_base (419)..(419): a, c, t, g, unknown or other
  modified_base (450)..(450): a, c, t, g, unknown or other
  modified_base (525)..(525): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtncagcctctggattgaggtcaatactatgctatgcacgtgggtccgccaggctccgagggggacgggctagggaatggatgacagttacttcacagatcgacaaaaccaaantacacgcgtagtcgagacggggcccngtgctagtcgtctacaganactatacgaanacactcacggtactagacaaacgtgaaacgngtacgaggacgaccgaccggaaggccgaacgggtcctttacgtactttggcgacgaacgttaggaagggtgggancgttagggtacggggttactttggaacgttccgggg

SEQ ID NO: 406327 - DNA, 613 bp, Homo sapiens
  misc_feature: GZ8MTXP01EOTTQ.10.12.B01.1.454.CMB.2.raw
  modified_base (263)..(263): a, c, t, g, unknown or other
  modified_base (394)..(394): a, c, t, g, unknown or other
  modified_base (406)..(406): a, c, t, g, unknown or other
  modified_base (465)..(465): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcgttgggttttcctcgttgctcttttaagaggtgtccagtgtcaggtgcagttggaggaatcgtgggggagcgtggtccagccgaggggagtccctgagactctcctgtgcagcctntggattgagtcaataactatgctatgcacgtggactccgcaggctcgaggggagggctaggaatggatgactagtttacttcacacgatcgaaacaaaccaaactactaacgacggcggtaagtttcgggnggacggggccgngtggctactcgtcaccgagagaactaacgttacgaaacgaactacttcgtacgttaccngaactaaatagaactagtacgtggacgacgaccggaacggaaccgtaacgggttccttacgttagttttcggacgttacgttaacgttaaggtaagggtcgggtaacgtacggttaaggttacgggggtaacttttaagggtaaccgg

SEQ ID NO: 406328 - DNA, 691 bp, Homo sapiens
  misc_feature: GZ8MTXP01CX5U9.10.12.B01.1.454.CMB.2.raw
  modified_base (298)..(298): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcagttggaggaatcgtgggggagcgtggtccagccgagggacgtccctgagactctcctgtgcagcctgtggattgagtcaataactatgctatgcagtggccncaggctccgaaggggagggctaggagtaggatagacgtagttatttaccacgacgatagaaccaaaaaacccaaaaacaacgtaactaacgggacgggtacggttacggtacggggaacggggcccggtccttaggcaacgttccggtaccttacccgaaaggtaacgaactaaacgtttaacgaaagtaaacctactaccttcgggtaaaccgtacgaataaactaaggacctaagtcgtaacgagaaccggccggaaacggcgtaaccgtcccggttactttaactttcggtcggaacgttaccggttaaggaaggggtttaaccggggagttaacgttaaacggggttagggggttaaattttcgggttaacccgttttaacccgggggg

SEQ ID NO: 406329 - DNA, 617 bp, Homo sapiens
  misc_feature: GZ8MTXP01DGXMJ.10.12.B01.1.454.CMB.2.raw
  modified_base (305)..(305): a, c, t, g, unknown or other
  modified_base (376)..(376): a, c, t, g, unknown or other
  modified_base (407)..(407): a, c, t, g, unknown or other
  modified_base (440)..(440): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgctcttttaagaggtgtccagtgtcaggtgcagttggaggaatcgtgggggagcgtggtccagccgaggggacgtccctgagactctcctgtgcagccttctggattgaggttcaataactatgctatgcacgtgggtcccncaggcctaccgaggggaagggctgggaatggatgactgttattccgacacgatagaccaaaaaccaaaagntacgtaacgcgggtagtcgtggacggggccnctgcatcgtctccaagacgactaagtacgaaanaaccacttaccgtagggttaaccctagaacctaaagtacgaaacctagtacgtagaacgacgaccggaacggaaccgaacggtccgttacgttaccgtttttggacggtacgaacgttagggttaaggtggggaagtcgttaaggtagggggttatttaaggcgttttaacccgggg

SEQ ID NO: 406330 - DNA, 647 bp, Homo sapiens
  misc_feature: GZ8MTXP01EVFU5.10.12.B01.1.454.CMB.2.raw
  modified_base (363)..(363): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggaggtccctgagactctcctgtgcagcctctggattgaggtcaataactatgctatgcacgtggtccgcaggctcgaagggagggctggaatggatgacagttattccactacgatcgacaaaaaccaaaatntaactacggcggtagttcggtagggacggggcccgcgtgctagtccgtctaccgaagagtaactaaattacggaaacgaacctaacgttacgttacggggtaacccttaggacctaaaagttcggaaacacgttacgtaggaacgtaggacccggaacgggacccgaaccgggtcccgttcttaaccgttttggacggtacccgttaacgttagggaaacgggttgggggaactaaccggttaaggtagggggttatttaacgggttaaccgtttccccggggg

SEQ ID NO: 406331 - DNA, 604 bp, Homo sapiens
  misc_feature: GZ8MTXP01A54NP.10.12.B01.1.454.CMB.2.raw
  modified_base (368)..(368): a, c, t, g, unknown or other
  modified_base (442)..(442): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtcgtccccaggacagacggccaggatcacctgctctggagatgctttgccgaagcaatatgcttactggtaccagcagaagccaggccaggccctgtggaacttgtatataaaggacacgtgagacggcccccgagggactcccgtgagcgattctcgtcggccctccagctacgagggaaacaacgnggtgtacgttgaacccagtcgagggcgggacgcccggggacgaagggacgggacgaggcgtaggactattacgngtacaaatcaacaaacgtactaattacgttaggttacttagtttgggttacggttcgggtcgggtagggtcccaaggtcgtcgttacccggtcgttaggtccgacgcccgacgggccgtccgcccccgttcggtctacccgttcgtccgtttccccgtcccc

SEQ ID NO: 406332 - DNA, 521 bp, Homo sapiens
  misc_feature: GZ8MTXP01ALK7X.10.12.B01.1.454.CMB.2.raw
  modified_base (355)..(355): a, c, t, g, unknown or other
tcagcatagtagtgcacgaccggtgctcgatttagtagtgtagattccgcgggggtgggtccaggaggcagaactctgggtgtctcaccatggcctggatccctctacttctcccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagaggcccccagggactccctgagcgattctctggcctccagctcagggaacaacngtgacgttgacatcagcggagcccgggcaggaggacgaggctgactatactgcaatcacgaagactattacgtgtacttagttgggtgttcggcgggagggtccaagctgaccgtcttaggtcagcccgaggctcgcccctggtcacttctcgttcccctaacccc

SEQ ID NO: 406333 - DNA, 547 bp, Homo sapiens
  misc_feature: GZ8MTXP01AQVXV.10.12.B01.1.454.CMB.2.raw
  modified_base (299)..(299): a, c, t, g, unknown or other
  modified_base (364)..(364): a, c, t, g, unknown or other
  modified_base (396)..(396): a, c, t, g, unknown or other
  modified_base (459)..(459): a, c, t, g, unknown or other
  modified_base (490)..(490): a, c, t, g, unknown or other
  modified_base (500)..(500): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtgcagcctctggattgaggtcaataactatgctatgcacgtgggtcccnccaggctccgagggagggctggaatggatgactagttattccacagatcgacaaaaaccaaaacntacctacggcggtagttcgtgggacggggccntgcatcgtctccgagagactaatacgaaagaacactctacggtacctgaccaaagtcgaaacngtctagagacgccgaggaccaacggccgttnttacgtttgngcgacgttaggagtggagcttaaggtcgggttatttggaattccggg

SEQ ID NO: 406334 - DNA, 565 bp, Homo sapiens
  misc_feature: GZ8MTXP01EBD1V.10.12.B01.1.454.CMB.2.raw
  modified_base (178)..(178): a, c, t, g, unknown or other
  modified_base (302)..(302): a, c, t, g, unknown or other
  modified_base (367)..(367): a, c, t, g, unknown or other
  modified_base (400)..(400): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagnggtgtccagtgtcaggtgcagttggaggaatcgtgggggagcgtggtccagccaggggagtccctgagactctcctgtgcagcctctggatgaggttcaataactatgctatgcacgtggtccnccaggctccgaggggagggctgggaatggatgactagttattcacacgatacgacaaccaaaacntaacctacggcgggtagttcgtgggaggggccntgcagtcgtctaccgagacgacaatcgaaagacactctgtacctgacaaatcgaacagtctagacgacgccgaaggcaccgggtcccttgttaacgttttggacgcgttaaacgttaagggaaaggtgggggatacgttagggttaacgggggttaattttcggg

SEQ ID NO: 406335 - DNA, 622 bp, Homo sapiens
  misc_feature: GZ8MTXP01DZ0U9.10.12.B01.1.454.CMB.2.raw
  modified_base (260)..(260): a, c, t, g, unknown or other
  modified_base (299)..(299): a, c, t, g, unknown or other
  modified_base (374)..(374): a, c, t, g, unknown or other
  modified_base (409)..(409): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgctcttttaagaggtgtccagtgtcaggtgcagttggaggaatcgtgggggagcgtggtccagccagggagtccctgagactctcctgtgcagcctntggattgagtcaataactatgctatgcacgtgggtcccnccaggcctaccgaaggggaggggctagggaatggatgactagtttacttccacacgatcgaccaaaaaaccaaantaacgtacggacggtagttcggagggacggggccncgtgctagtccgtctaccgaagacgaactaagttacgaaacgaactactctacggtaacctagaacctaaagtagaaacctagtacgtagaacgacggaccggacggaccgaaccgggtccgttcttaacgttttcggacgtacggttaacgttaggttaagggtggggaactcgttaagggtaggggttatttcggttaacgtttcccgggg

SEQ ID NO: 406336 - DNA, 576 bp, Homo sapiens
  misc_feature: GZ8MTXP01EMO8Q.10.12.B01.1.454.CMB.2.raw
  modified_base (298)..(298): a, c, t, g, unknown or other
  modified_base (359)..(359): a, c, t, g, unknown or other
  modified_base (392)..(392): a, c, t, g, unknown or other
  modified_base (464)..(464): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtgcagcctctggattgaggtcaataactatgctatgcacgtgggtccncaggctccgaggggagggctggaatggatgacagttattccacagatgacaaaaaccaaantacgtaacggcggtagttcgaggacggggtccncgtgcatcgtctaccgagacgacaacgtacgaaacgaacactcgtaggtaacctagaacaaagtacgaaacngtcgtagacgacgaccgaggaccaacgggtccgttcttacgttttgacggtacgttaacgttggaaggtgggagtaacgttaggtaggggttatttgttaacgtttcccggg

SEQ ID NO: 406337 - DNA, 625 bp, Homo sapiens
  misc_feature: GZ8MTXP01DZX2E.10.12.B01.1.454.CMB.2.raw
  modified_base (263)..(263): a, c, t, g, unknown or other
  modified_base (302)..(302): a, c, t, g, unknown or other
  modified_base (616)..(616): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtgcagcctntggatgaggttcaataactatgctatgcacgtgggtccnccaggcctacggagggggagggctaggatggatgactagttattacacacgataacgaaccctaaaccaaaatactaaccgtacgggacgggtaggtttcgggacgggacggggcctcgtcggactacgtcgttaccaccgaagacgaactaacgttacgaaagtaacctactctacgtacctagaacctaaagtcgaacgtagtcgtaggaacggacggccggaacggaccgaccgggtccgttacgttaacgttttcggcgttaccgttaagtaagggtaaaggtcgggagtacgttaagggtaaggggttntttaacggg

SEQ ID NO: 406338 - DNA, 640 bp, Homo sapiens
  misc_feature: GZ8MTXP01DULQY.10.12.B01.1.454.CMB.2.raw
  modified_base (376)..(376): a, c, t, g, unknown or other
  modified_base (516)..(516): a, c, t, g, unknown or other
  modified_base (617)..(617): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgcttcttttaagaggtgtccagtgtcaggtgcagttggaggaatcgtgggggagcgtggtccagccagggacgtcctgagactctcctgtgcagcctctggattgagtcaataactatgctatgcactcgggtcccgcaggcctaccgagggggaagggctgggaatggatgaactagttactttccactacgatacgaccaaaaaccaaaacngtaaaccgtacggaccgggtaagtttccggtagggacggggtcccgacgttggactacgtcggtccttacgaaggacgaactaagttacgaaacgtaacacgttacttacggggtacctagaactaaacgtagaaaccgngtactaggagacggacccggaaggaccgaacggtccgttacgttacgttttagacggtccgaagttaggttaaaggtgggagtaacgttaggtaggggttntttaaggttaacgtttcccgggg

SEQ ID NO: 406339 - DNA, 550 bp, Homo sapiens
  misc_feature: GZ8MTXP01AD6RD.10.12.B01.1.454.CMB.2.raw
  modified_base (353)..(353): a, c, t, g, unknown or other
  modified_base (385)..(385): a, c, t, g, unknown or other
tcagcatagtagtgcacgaccggtgctcgatttagtagtgtagattccgcgggggtgggtccaggaggcagaactctgggtgtctcaccatggcctggatccctctacttctcccctcctcactctctgcacagggtccgaggcctcctatgagctgacacagccaccctcggtgtcagtgtccccaggacagacggccaggatcacctgctctggagatgctttgccgaagcaatatgcttactgtaccagcagagcaggcaggccctgtgaacttgtatataaggacactgagacggcccccgagggactcccgtgagcgattctctcggcctccagctcgaggaacaacngtgacgttgaccatcgagcggacgcccggganaggaggacgaggctgactatactgtacaatcaacgaagactattacgtgtacttagttgggtgttcggcgggtagggtccaaggtcgtcgttaccgtcgttaggtccgacgcccgaaggcccgtccggccccgtcggtccaccgttccgtccgttccccgtcccc

SEQ ID NO: 406340 - DNA, 564 bp, Homo sapiens
  misc_feature: GZ8MTXP01EIJX1.10.12.B01.1.454.CMB.2.raw
  modified_base (264)..(264): a, c, t, g, unknown or other
  modified_base (283)..(283): a, c, t, g, unknown or other
  modified_base (289)..(289): a, c, t, g, unknown or other
  modified_base (300)..(300): a, c, t, g, unknown or other
  modified_base (363)..(363): a, c, t, g, unknown or other
  modified_base (397)..(397): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcaggttggaggaatcgtgggggagcgtggtccagccgagggagtccctgagactctcctgtgcagctntggatgagttcaataactntgctangcacgtggccnccaggctccgagggaagggctgggaatggatgactagttattcagacgatacgacaaccaaanactactacggcggtagttcgtcgggacggggccncgtgcagtcgtactccagacgacaattacgaaagacacgtctagtacctagaccaaatgaacagtctaggagacgccgaaggacgacggtcccggttacttaccgttttgcggttcgaaccgttaaggaaaggttgggaacgtgttaggtaaggggttaagtttcgg

SEQ ID NO: 406341 - DNA, 665 bp, Homo sapiens
  misc_feature: GZ8MTXP01EKRFB.10.12.B01.1.454.CMB.2.raw
  modified_base (302)..(302): a, c, t, g, unknown or other
  modified_base (377)..(377): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgctcttttaagaggtgtccagtgtcaggtgcagttggaggaatcgtgggggagcgtggtccagccgagggagtccctgagactctcctgtgcagcctctggattgaggttcaaataactatgctatgcacgtgggtccncaggctccgaaggggagggctagggaatgggatgacgtagtttacttccactagatcgaaccaaaaaccaaaacntaacgtacggcggtagttacggtgggacggggccctcgtgcgtacgtcgtcctaccgaagacgaactaagtacgaaacaaccaattccgtacgggtaactcggaaactaaacgtacggaaaccagttacgaggaacgtacggaccggtaaacggacccggtaacccggggtaccctttaccgttacgtttttaggaccggtaacggttaaccgttaagggaacgggtggggtaaccgtaacgtttaaagggtagggggttatttaacgggttaacgtttccccggggg

SEQ ID NO: 406342 - DNA, 547 bp, Homo sapiens
  misc_feature: GZ8MTXP01AU74M.10.12.B01.1.454.CMB.2.raw
  modified_base (177)..(177): a, c, t, g, unknown or other
  modified_base (262)..(262): a, c, t, g, unknown or other
  modified_base (300)..(300): a, c, t, g, unknown or other
  modified_base (364)..(364): a, c, t, g, unknown or other
  modified_base (395)..(395): a, c, t, g, unknown or other
  modified_base (424)..(424): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctctttaagnggtgtccagtgtcaggtgcagttggaggaatcgtgggggagcgtggtccagccagggagtccctgagactctcctgtgcagcctntggatgaggttcaatactatgctatgcacgtgggtccncaggctccgagggggaagggctggaatggatgactagttattcacacgatacgacaaccaaaantaactacgcggtagttcgtaggacggggccnctgcatcgctccgagagacaattcgaaanacactctgtacctgacaaatgaaacagtctagagacgccggaagccgacggtcccgttattaccgttttggcgccgttaagtaagggaagtggggaagtcttaaggtaaggggttaatttggg

SEQ ID NO: 406343 - DNA, 661 bp, Homo sapiens
  misc_feature: GZ8MTXP01C6P9E.10.12.B01.1.454.CMB.2.raw
tcagcatagtagtgcacgaccggtgctcgatttagtagtgtagattccgcgggggtgggtccaggaggcagaactctgggtgtctcaccatggcctggatccctctacttcctcccctcctcactctctgcacagggtccgaggcctcctatgagctgacacagccaccctcggtgtcagtcgtccccaggacagacggccaggatcacctgctctggagatgtcttgccgaagcaatatgacttacgtggtaccagcagaacgccgaggccacggcccctaggtaggtaaacttgtaataagtaaaggaccacgtggaacggaccggacccccgaggggacctccccgtaggacgacgtattcctcgtcggcccctccgagtccgtacgaacggggtaaaccaaacgaaggttacgtaacggttacgaaccagtacgacgggaccgggacggcccgggagaacgggacgggacggagggacgtacgtacttaactacgtagtacaactacaacgaagtaactaattacgtagttacgttaggttgggtaggttcggacgggtacggtccgaagtcgtcggacccgtcgttacggtaccgacgacccgacgttccgtcccgccccgtccggtcctaccgttccgtccgttcccctaacccc

SEQ ID NO: 406344 - DNA, 528 bp, Homo sapiens
  misc_feature: GZ8MTXP01AY0AU.10.12.B01.1.454.CMB.2.raw
  modified_base (358)..(358): a, c, t, g, unknown or other
  modified_base (486)..(486): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggcaggcccctgtgaacttgtatataaggacactgagacggcccccagggactcccgtgacgcgtattctctggcctccagctcagggaacaacngtgacgttgacgatcgagcggacgccgggcagaggacgagctgactatactgtacaatcaacgaagacattacgtagtacttagttgggtagttcggcgggtagggtccaagctgaccgtcttcggcncgccgaggcctcgcccctcggtcacttctcgttccccgcccc

SEQ ID NO: 406345 - DNA, 621 bp, Homo sapiens
  misc_feature: GZ8MTXP01DPTEU.10.12.B01.1.454.CMB.2.raw
  modified_base (445)..(445): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccacggcccctgtaggaacttgtatataaaggacactgagacggccccagggactcccgtgacgcgtacttctctggcccctccagcctacgagggaaacaaacgtgacgacgttcgaaccagtcagggccgggacggcccgggacgaggacggacggtaggctagggacttagttaccngttacaaatccaaactaaacgactaatttacgtggttaaactttggttgggtacggttcgggcgggtaagggttcccaaaggtcctcggacccgttccgttaagggtccaacgacccgaacggccttcccggccccgttcggtaccctaccttccgttccgttcccccgttccccc

SEQ ID NO: 406346 - DNA, 624 bp, Homo sapiens
  misc_feature: GZ8MTXP01CI2XM.10.12.B01.1.454.CMB.2.raw
  modified_base (260)..(260): a, c, t, g, unknown or other
  modified_base (372)..(372): a, c, t, g, unknown or other
  modified_base (391)..(391): a, c, t, g, unknown or other
  modified_base (403)..(403): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgcttcttttaagaggtgtccagtgtcaggtgcagttggaggaatcgtgggggagcgtggtccagccagggagtccctgagactctcctgtgcagcctntggattgaggtcaataactatgctatgcacgtgggtcccgccaggcctccgaggggaaggggctagggaatgggatgactagttattccacagatcgacaaaaaccaaaacntaactacgcggtagttcgnggacggggcccntgcatcgtctaccagacgaactaattacgaaagaaccactacctacggtaaccctgaaccaaagtagaaacctagtactagacgtacggaccggaacggaccgaaccgggtcccgttacgtttaaccgttttggacggtacgttaacgttaaggaaggggtggggaagtaaccgttaagggtaacgggggttatttaacgggttaacgtttaacccggggg

SEQ ID NO: 406347 - DNA, 721 bp, Homo sapiens
  misc_feature: GZ8MTXP01DDKL9.10.12.B01.1.454.CMB.2.raw
tcagcatagtagtgcacgaccggtgctcgatttagtagtgtagattccgcgggggtgggtccaggaggcagaactctgggtgtctcaccatggcctggatccctctacttctcccctcctcactctctgcacagggtccgaggcctcctatgagctgacacagccaccctcggtgtcagtcgtccccaggacagacggccaggatcacctgctctggagatgtcttgaccgaagacaaatatgtacttacgtggtaccagcaagaacgccgaggccacggcccctaggtacggtaacttgtataagtaaaggactacgtaggacggaccggacccccgaggggacctccccgtaggacgtcgtacttctcgtcggccctccgagctacgaacgggaaacaaacgtggtcgtacgtacgaaccacgtacgacgggccggggaccggacccgggggacgaacggggaacgggtaacggggaacgggtacgttacggtaacctttaacgttaaccgtacgtaaccaaacttaccgaaacgtaaaacggtaccttaaagtttaccggttaggtttaaccgtttagggttcggggtttacggttacggggtacgggtacggtaccgaaaggtccgtacgttacccggtcgttaggtcccacggacccgaggttcccgtcccgtccccgtcggtacctacgttcccgttccgttcccccgtaacccc

SEQ ID NO: 406348 - DNA, 563 bp, Homo sapiens
  misc_feature: GZ8MTXP01BD33V.10.12.B01.1.454.CMB.2.raw
  modified_base (381)..(381): a, c, t, g, unknown or other
  modified_base (390)..(390): a, c, t, g, unknown or other
  modified_base (440)..(440): a, c, t, g, unknown or other
  modified_base (444)..(444): a, c, t, g, unknown or other
  modified_base (496)..(496): a, c, t, g, unknown or other
  modified_base (556)..(556): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcaggttggaggaatcgtgggggaggcgtggtccagccgagggaggtccctgagactctcctgtgcacgctctggatgaggttcaataactatgctatgcacgtcgggtccgccgaggctaccggagggggaacggggctagggattgggatgactagttacttacactagatacgacaaccaaantaactacgnggtagttcgaggacgggcatgcatcgtactcagacgactaactacgaaanaacncgtactagtacctgaacaaagtcgaaacagtcgagagacgccggaaggaccncgggtccttgttacgtttgcgcgaactaagggagtgggacgtcgttaggttaaggggttntttcggg

SEQ ID NO: 406349 - DNA, 667 bp, Homo sapiens
  misc_feature: GZ8MTXP01BTGKR.10.12.B01.1.454.CMB.2.raw
  modified_base (303)..(303): a, c, t, g, unknown or other
  modified_base (346)..(346): a, c, t, g, unknown or other
  modified_base (350)..(350): a, c, t, g, unknown or other
  modified_base (405)..(405): a, c, t, g, unknown or other
  modified_base (426)..(426): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgcttctttttaagaggttgtccagtgtcaggtgcagttggaggaatcgtgggggagcgtggtccagccgagggagtccctgagctctcctgtgcagcctgtggatgagttcaataactatgctatgcacgtggtccncaggctcggaggggagggctaggatggatgactagttattcanacgntacgaaccaaccaaacataccgtacggcgggtaagttcgggtaggacgggggccncgtggctacgtccggttaccnccgtaagacgaactaaagttaccgaaacgtaaccctcgttacgttacggtaacccctaggtaaccctaaaagtcgaaaacctaggttaccgtaggaacggaccgcccgggaaacggtaacccgttaccggggtaccctttcgtttaaacggtttttggacggttacccggttaaaggtaagggtaggggttcgggtaacgtacggtttaaagggttaacggggggttaatttttaaccggg

SEQ ID NO: 406350 - DNA, 555 bp, Homo sapiens
  misc_feature: GZ8MTXP01DNWZ7.10.12.B01.1.454.CMB.2.raw
  modified_base (298)..(298): a, c, t, g, unknown or other
  modified_base (368)..(368): a, c, t, g, unknown or other
  modified_base (402)..(402): a, c, t, g, unknown or other
  modified_base (486)..(486): a, c, t, g, unknown or other
  modified_base (505)..(505): a, c, t, g, unknown or other
  modified_base (524)..(524): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgctcttttaagaggtgtccagtgtcaggtgcagttggaggaatcgtgggggagcgtggtccagccagggagtccctgagactctcctgtgcagcctctggattgagtcaatactatgctatgcacgtgggtcccnccaggcctaccgaggggaagggctagggaatggatgactagttattccacacgatgaccaaaaaccaaanctacgtacggcggtagtcgtgggacggggcccgntgacactcgtctccgaagagactaatacgaaagaactactctacggtacctagacaaatgaacagtctagagacgacgaggacncggtcgttcttacgtttgngcgacgttagaggtgggancgtagtaggggttatttcggaacgttccggg

SEQ ID NO: 406351 - DNA, 650 bp, Homo sapiens
  misc_feature: GZ8MTXP01AR3KX.10.12.B01.1.454.CMB.2.raw
  modified_base (306)..(306): a, c, t, g, unknown or other
  modified_base (378)..(378): a, c, t, g, unknown or other
  modified_base (416)..(416): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgcttcttttaagaggtttccagtgtcaggtgcagttggaggaatcgtgggggagcgtggtccagccgaggggacgtccctgacgctctcctgtgcagcctgtggattgagttacaatactatgctatgcacgtgggtccncgaggctaccgaggggacgggctaggaatggatggactagtttacttcacacgatcgaaaccaaaccaaacntaaccgtacggcggtaggtttcggagggacggggcccncgtgactacgtccgtcctaccgaagtaacgaactaaacgttaccgaaacgtaacctaccgttacgtacgtaaccgtagaaaccgtaaagtacgaaactagtacgtaggaacgacggaccggaagggaacccgtaccgggttcccgttacgttacgtttcggcgttaccgttaacgttaagggtaagggtcgggtaacgtacggttaagggttacggggttaatttcgggtaacg

SEQ ID NO: 406352 - DNA, 610 bp, Homo sapiens
  misc_feature: GZ8MTXP01B3DGE.10.12.B01.1.454.CMB.2.raw
  modified_base (301)..(301): a, c, t, g, unknown or other
  modified_base (369)..(369): a, c, t, g, unknown or other
  modified_base (395)..(395): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcagttggaggaatcgtgggggagcgtggtccagccgagggacgtccctgagactctccgtgtgcagcctctggattgagtcaatactatgctatgcacgtgggtccncgaggctccgagggagggctagggaatggatgactagttacttccacacgatcgacaaaaaccaaacntacacggcgtagtcgagggacgggcntgcatcgtctacgaagacgacaagttacgaaacgtaacacttacgtacggggttaaccctaggaaaccaaaagttcgaaaacctaggtctacggaacgacggacccggaacgggaccgaaccgggtcccgttacgttacgttttggacgacgttaacgttaggaaacggtgggaacgtcgttaaggtaggggttactttcggaacgtttccgggg

SEQ ID NO: 406353 - DNA, 714 bp, Homo sapiens
  misc_feature: GZ8MTXP01BU5WE.10.12.B01.1.454.CMB.2.raw
  modified_base (257)..(257): a, c, t, g, unknown or other
  modified_base (276)..(276): a, c, t, g, unknown or other
  modified_base (297)..(297): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagctctctgtgcagcctntggattgagtcaataactntgctatgcacgtcgggtcccnccgaggcctccggaagggggaggggtctagggaatgggatgaacctagtttacttcccacacgatcgaacccaaaaaacccaaaactgtaaaccgtaccgggacgggtacgtttcgggtaggacgggggcccacgtgacctagtccgtctacccgaagacgaactaagttacgaaacgtaaccacgttccgtacgggttaaccctaggaaacctaaaagttacgaaacccgtaggttacccgagggaacgtaccgggacccggaaacggggacccgtaaccgggtacccgtttaccgtttaacggtttttcgggacgtaccggttaaacgttagggttaaacgggtttaacggggaaccgttaacggttaaagggtacgggggtttattttaacgggttaaccgttttccccggggg

SEQ ID NO: 406354 - DNA, 639 bp, Homo sapiens
  misc_feature: GZ8MTXP01CLZM6.10.12.B01.1.454.CMB.2.raw
  modified_base (365)..(365): a, c, t, g, unknown or other
  modified_base (389)..(389): a, c, t, g, unknown or other
  modified_base (414)..(414): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttgagaggtgtccagtgtcaggtgcaggttggaggaatcgtgggggagcgtggtccaggccgagggacgtccctgacgctctcctgtgcagcctgtggattgaggttcaaataactatgctagtgcacgtcggggtcccaccgagggcctaccggagggggaacgggctaggaatggatgactagtttacttcanacgatacgaaaccaaaaccaaacntaaccgtacggcggtagttacgggngggacggggcctgtcgcacgtccgtactaccgaagaacgaactaacttaccgaaagaactacttacgtacgttaaccgtagaaccaaaagtacgaaaccgtagttaccgaggaacgacggaccggaacggaacccgtaaccggttccgtttacgttaccgttttggacgttaccgagttaggtaaggtagggaactagtaggttagggttaatttcgggtaaccg

SEQ ID NO: 406355 - DNA, 603 bp, Homo sapiens
  misc_feature: GZ8MTXP01ENSD7.10.12.B01.1.454.CMB.2.raw
  modified_base (302)..(302): a, c, t, g, unknown or other
  modified_base (369)..(369): a, c, t, g, unknown or other
  modified_base (408)..(408): a, c, t, g, unknown or other
  modified_base (587)..(587): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgctcttttgagaggtgtccagtgtcaggtgcagttggaggaatcgtgggggagcgtggtccagccgagggacgtccctgagactctcctgtgcagcctctggattgagttcaaatactatgctatgcacgtgggtcccncaggctacgaggggaggctggaatggatgactagttacttcgacacgaatcgaaaccaaaccaaagntaaccgtacggacgggtaacgtttcgagggacggggccncgtggcatccgtctaccagaagaccaaattacgaaagacactcgtacgtacctgacaaagtgaaactagtaccgagacgacgacccggaaggaaccgaccgggttccgttacttacgttttcggacgttaccgttagttaacgggtaagggtagggaacgttagtaagggttaggggtnttttaacgggtaaccg

SEQ ID NO: 406356 - DNA, 607 bp, Homo sapiens
  misc_feature: GZ8MTXP01BB6A5.10.12.B01.1.454.CMB.2.raw
  modified_base (308)..(308): a, c, t, g, unknown or other
  modified_base (376)..(376): a, c, t, g, unknown or other
  modified_base (411)..(411): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcaggttggaggaatcgtgggggagcgtggtccagccaggggagtccctgagactctcctgtgcagcctctggatggaggttcaataactatgctatgcacgtgggtcccncaggctccgagggggaagggctggaatggatgactaggtttattcaactacgatacgacaaccaaaanataaccgtacggcggtagttcggtggacggggccncgtgcatcgtactccagacgacaacgttacgaaagtaccactctacgtacctagaactaaagtcgaactacgtctaggagacgaccggaacggaccgaccgggtccgttcgttaccgttttgacggttccgttaacggtaagggtagggtaaggggtacggtacggttaaggttaaggggttaacgttttaacggg

SEQ ID NO: 406357 - DNA, 616 bp, Homo sapiens
  misc_feature: GZ8MTXP01AJNG7.10.12.B01.1.454.CMB.2.raw
  modified_base (312)..(312): a, c, t, g, unknown or other
  modified_base (431)..(431): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgaggggaggtccctgagactctcctgtgcacgcctgtggtatgaggttacaaataactatgctatgcacggtcgggtcccnccgacggccgtaccgggagggggagggcgtaggaagtggatgactagttattcacacgtataacgaaccaaaccaaactactacgtacggcgggtaggttcggtagggacgggggcccngtcggacacgttccgtccacgaaggacgaactaagttacgaaacgtacctactgtacgtacctagaacaaagtcgaacgtagtcgtagaacggacgtccggaaggaccgttaccgggtccttacgtttaacgtttggcggacaaggttaagggagtcgggaatgttaggtggggttaatttcggg

SEQ ID NO: 406358 - DNA, 600 bp, Homo sapiens
  misc_feature: GZ8MTXP01BE5U6.10.12.B01.1.454.CMB.2.raw
  modified_base (304)..(304): a, c, t, g, unknown or other
  modified_base (369)..(369): a, c, t, g, unknown or other
  modified_base (389)..(389): a, c, t, g, unknown or other
  modified_base (399)..(399): a, c, t, g, unknown or other
  modified_base (433)..(433): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgaggggacgtccctgagactctcctgtgcagcctctggatgaggttcaatactatgctatgcacgtgggtccncaggctccgagggggagggctggaatggatgactagttattcacacgatacgaccaaccaaaacntaactacggcggtagttcgnggacggggcnctgcatcgtactccagagacaatacgaaagaccncgtctagtacctagacaaatcggaaacagtctaggacgacggccggaacggaaccgccgggtcccgttacgttaaccgttttcggacggttaccggttaacgtaagggtaaacgggtcgggggtaagtaccggttaagggttaacggggggttaattttaaccgggg

SEQ ID NO: 406359 - DNA, 570 bp, Homo sapiens
  misc_feature: GZ8MTXP01DKMAF.10.12.B01.1.454.CMB.2.raw
  modified_base (381)..(381): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcttgggttttcctcgttgctcttttaagaggtgtccagtgtcaggtgcaggttggaggaatcgtggggggaggcgtggtccagccgaggggagtccctgagctctcctgtgcagcctcgtggatgaggttcaataactatgctatgcacgtcgggtccgccaggctaccggagggggaaggggctaggatggatgactagttacttacacgtacgatacgaccaaccaaanataacgtacggacggtagttcggaggacgggcgctgctatcgtctcagagacaatcgaaagaccacgttctagtacctagacaaagtgaactagtcgtagaggacgccggaagaccgacggtcccgttcgttaccgtttgcgttcgaacgtaaggaaggtcgggagtgttaggtaagggttgtttaagg

SEQ ID NO: 406360 - DNA, 679 bp, Homo sapiens
  misc_feature: GZ8MTXP01BWV7C.10.12.B01.1.454.CMB.2.raw
  modified_base (255)..(255): a, c, t, g, unknown or other
  modified_base (304)..(304): a, c, t, g, unknown or other
  modified_base (385)..(385): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagtcttgggttttcctcgttgcttcttttaagaggtgtccagtgtcaggtgcaggttggaggaatcgtgggggagcgtggtccagccgagggacgtccctgagctctctgngcagcctctggattgaggtcaaatactatgctatgcacgtcgggtcccncaggctccggaagggggaaggggctagggaatcgggatgactagtttacttccacacgatacgaccaaaaaacccaaaacngtaacctaacgggcggtaaggtttcggcgggacggggcctcgtgctatcggtctaccgaagacgaactaacgttacgaaacgaaacctacttcgtacggttaacctacggaactaaaacgtacgaaaccaggttccaaggaacggtacgggacccggtaacggacccggtaaacccgggttcccgttacgtttaccggttttggacgggtaccgttaacggttacggaacggttaacggggagtaacggtttaaggtacgggggttattttaacgggaacgtttaacccggggg

SEQ ID NO: 406361 - DNA, 685 bp, Homo sapiens
  misc_feature: GZ8MTXP01D24EI.10.12.B01.1.454.CMB.2.raw
  modified_base (305)..(305): a, c, t, g, unknown or other
  modified_base (383)..(383): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcaggttggaggaatcgtgggggagcgtggtccagccagggacgtccctgagactctcctgtgcagcctcgtggattgaggtacaataactatgctatgcacgtcgggtccnccgaggtctaccggaagggggaacggggctagggaatgggatgactagttattccacagatgaccaaaaaaccaaacngtaactacgggcggtagtttcggaggacgggggccctactgcacgtccgtacctcgaaaggacgtaactaaacgttacggaaaacgaaactaccgttaccgttacggggttaaccctagaacctaaaacgttacgaaaccgtagtccgtaaggaagtacggacccggaacgggaccgtaaccgggtcccgttacgtttaccgttttgggtacgtacccggaaacggttagggaagggtcggggtaagtaaccggttaaagggttacgggggttagtttaacgggttaacgtttccccggggg

SEQ ID NO: 406362 - DNA, 554 bp, Homo sapiens
  misc_feature: GZ8MTXP01DE8ZW.10.12.B01.1.454.CMB.2.raw
  modified_base (303)..(303): a, c, t, g, unknown or other
  modified_base (350)..(350): a, c, t, g, unknown or other
  modified_base (368)..(368): a, c, t, g, unknown or other
  modified_base (384)..(384): a, c, t, g, unknown or other
  modified_base (392)..(392): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgagggaggtccctgagctctcctgtgcagcctctggatgaggttcaataactatgctatgcacgtgggtccncgaggctccgaggggaagggctgggaatggatgactagttattacanacgatcgacaaccaaaantacacgcggagttcgngacgggcnctgcatcgtactccagtacgacaattacgaaagactacgtctagtacctgacaaagtcgaacagtctaggaagacgccgaaggccgacggtcccgttagttacgttttgacgcgttaacgtaaggaaaggtggggaatcgttagtaacggggttaatttcgg

SEQ ID NO: 406363 - DNA, 657 bp, Homo sapiens
  misc_feature: GZ8MTXP01AY6BF.10.12.B01.1.454.CMB.2.raw
  modified_base (303)..(303): a, c, t, g, unknown or other
  modified_base (384)..(384): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgctcttttaagaggtgtccagtgtcaggtgcaggttggaggaatcgtgggggagcgtggtccagccgagggacggtccctgagctctcctgtgcagcctgtggattgagtcaatactatgctatgcacgtcggggtcccnccgagggcctaccggaagggggaggggctagggaatgggattgactagtttacttccacacgatcgaccaaaaaaccaaanctacgtacggcggtagttcggtagggacggggcccacgtgctagtccgtcctaccgaagacgaacctaagttacgaaactaacaccttcgtacgggtaccttaggaacctaaagttcgaaaccgtagttaccgaggaacggtaccggacccgggaaggacccggtaaccggtcccgtttcttacgttttggcggtaacggttacgttagggttaagggtgggggactaaggttaagggtaggggttactttcgggttaacggtttcccggggg

SEQ ID NO: 406364 - DNA, 690 bp, Homo sapiens
  misc_feature: GZ8MTXP01BO45F.10.12.B01.1.454.CMB.2.raw
  modified_base (260)..(260): a, c, t, g, unknown or other
  modified_base (299)..(299): a, c, t, g, unknown or other
  modified_base (373)..(373): a, c, t, g, unknown or other
  modified_base (383)..(383): a, c, t, g, unknown or other
  modified_base (407)..(407): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcagttggaggaatcgtgggggagcgtggtccagccgagggagtccctgagctctctgtgcagcctntggattgagtcaataactatgctatgcacgtgggtcccnccaggcctacgagggggagggctagggaatggatgactagtttacttccgacacgatgaaccaaaaaccaaaantaacgtacgngggtattcggtgggacggggcccncgtgactagtcgtctaccgaagacgaactaagttacgaaacgtaacctacgttaccgtacggttaacccgttagaaacctaaaagttacgaaaacgtacggttacctaggaacggaccggacccggaaacgggtaaccccgtaaccggggttccccgttaactttaacccggtttttggaacggtacccggttaaacgtttaaggggaaacgggtttaacgggggaacgtcgttaaagggttacgggggttattttaacgggttaacggtttaaccccggggg

SEQ ID NO: 406365 - DNA, 733 bp, Homo sapiens
  misc_feature: GZ8MTXP01DTYG0.10.12.B01.1.454.CMB.2.raw
tcagcatagtagtgcacgaccggtgctcgatttagtagtgtagattccgcgggggtgggtccaggaggcagaactctgggtgtctcaccatggcctggatccctctacttctcccctcctcactctctgcacagggtccgaggcctcctatgagctgacacagccaccctcggtgtcagtgtcccaggacagacggccaggactcacctgctctggagatgctttgccgaagcaatatgcttactggtaccagcagaagcaggccgacggccctgtaggaacttgtaatataaaggactactgacgacggacccccgaggggactcccgtgacgtcgtacttctcgtcggcccctccgagtcctacgaaacggggaaacaacgtaaggtacgtaccggttagaaccacgtacgacgggaccgggacgggcccgggagaacgggacgggaaccgggtaacgggtccgttagggtaacctttaacgttaaccgttcgttaacaaaacttccgaaaacggtaaacggtaaccttaagtttaaacgttacggggtttaaaccgtttggtttagggggtttaccggttacgggggtacggggtacgggttacccgaaaggtccgttcgttacccgggttaccgttacgggttaccgaaccgaccccggttaaagggttcccgtcccggtcccccgttccggtcctacccgttccgtttcccgttcccccgtaaccccg

SEQ ID NO: 406366 - DNA, 836 bp, Homo sapiens
  misc_feature: GZ8MTXP01B8Z2J.10.12.B01.1.454.CMB.2.raw
  modified_base (265)..(265): a, c, t, g, unknown or other
  modified_base (285)..(285): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcaggttggaggaatcgtgggggagcgtggtccagccgagggacgtccctgagactctcctgtcgcagcctntggattggagtacaatactntgctatgacacgtcggggtcccgaccgaggccgtaccggaagggggaacgggggtctaggggaaagttgggattacggaactaggtttaactttccccgaaacgtacgtaagttaccgaaaccctaaaaaaaaccccaaaaaacgtaacgttaaacccgtaaacccggggtaccggggttaacgggtttaccggggtagggggaacccggggggaccccgtcccggttaggtacccgtaacgttcccggttacccgttaaccccgaaagggaaaccgtaaaccttaaacggttaaccgaaaacggtaaaccctacgttaccgtaacggggttaaccccgtaaggtaaacctaaaagttacgaaaccggtacgtacgtacgggaacggtaccgggtacccggaacgggaacccggtaaccggggtccctttacggtttaaccgttttgggaacggtacccggttaaaggttacgggttaaacgggtgggggtaacgtaacggttaagggttacggggggttattttcgggttaacggttttaaccccggggg

SEQ ID NO: 406367 - DNA, 660 bp, Homo sapiens
  misc_feature: GZ8MTXP01D7UDR.10.12.B01.1.454.CMB.2.raw
  modified_base (235)..(235): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcaggttggaggaatcgtgggggagcgtgtccagccgagggngtccctgagactctctgtgcagcctctggattgagtacaataactatgctatgcctacgtcgggtcccgcgaggcctaccggaggggaacggggtctaggaagtggatagaactagtttactttaccactacgatacgaaccaaaaaacccaaactaactacgtacgggcggtagtttaccggacgggacggggtccctcgtcgactacgtccgtctacccgaagtaacgtaactaaacgttacgaaacgtaacctaaccgttacgtacggggttaaccttacggaaacctaaaagtacgaaaccgtagttaccgtaggagtaccggaccggtacgaccgtaaccggtcgttacttacgttttgacgtacgttacgttaggaggtgggagtaagttaaggtagggttattcgttaacgttccggg

SEQ ID NO: 406368 - DNA, 777 bp, Homo sapiens
  misc_feature: GZ8MTXP01CUO4A.10.12.B01.1.454.CMB.2.raw
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggagaatcgtgggggagcgtggtccagccgaggggagtccctgagactctcctgtgcagcctctggattgaggtcaataactatgctatgcacgtcgggtccgccaggcctaccgaagggggaagggggctagggaatgggatgaactagtttactttccacgtacgatacgacctaaaaaaacccgaaaaactgtaaaccgtaaccgggaccggggttaacgtttaccgggtaggggaaaccggggggccccgtacggttcggaccgtaacgttccggtacccttaacccgaaggaacgaaccgtaaagttaccggaaaacgtaaaccaacgttacccgtagggggttaaaccccttaggaaaccctaaaaagttacggaaaaccgtacggttaccgtagggaacggtaacgggaccccggtaaacggggaacccgtaacccggggtacccgttaccgtttaaaccggtttttcggtaacggtcggttaaaccggttacggaaacggggtttaaggggaacgttaacggttaagggttaaggggggttattttaacggggttaaccgttttcccggggg

SEQ ID NO: 406369 - DNA, 551 bp, Homo sapiens
  misc_feature: GZ8MTXP01DJX0S.10.12.B01.1.454.CMB.2.raw
  modified_base (361)..(361): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaaagcaatatgcttactggtaccagcagaagccagccagccctgtgaacttgtatataaggacactgagacggcccccgagggactccccgtgagcgtattctcgtggccctccagctcgagggaaacaangtgacgttgaccatcgagcggacgcccgggacaggaggacgtaggctagaacgtattactgtacaatacaacgaagactaagttacgtaggttacttagttagggtcgttcggcggtaggtccaagtctgacccgtcttaggtcacgccgaggctccgccccgtcggtcacgttctccgttcccgtcccc

SEQ ID NO: 406370 - DNA, 648 bp, Homo sapiens
  misc_feature: GZ8MTXP01ARJUM.10.12.B01.1.454.CMB.2.raw
  modified_base (620)..(620): a, c, t, g, unknown or other
tcagcatagtagtgcacgaccggtgctcgatttagtagtgtagattccgcgggggtgggtccaggaggcagaactctgggtgtctcaccatggcctggatccctctacttctcccctcctcactctctgcacagggtccgaggcctcctatgagctgacacagccaccctcggtgtcagtgtccccaggacagacggccaggatcacctgctctggagatgtcttgaccgaagcaatatgcttactgtaccagacagaacgccgacggccacggcccctggtacggtaacttgtaatagtaaaggacacgtggacggaccggacccccgagggactcccgtagacggcgtacttcgtcgtcggcccctcgagcgtacgagggaaacaacgtgtcgtacgttagacctatcgacggcggacggccgggagagggacggacgacggtcgtacgtacttattacgtgtacaatacaacgtaacgtacgtaatttacgttacggttaacgtttaggttggggttcggttccgggtacggggtacggtaccgaacggtcgttaccggaccgttccgttaggtccgaacgttcccgttacggttcccgtccgccccgttcggtccnccgtttccgtccgtttccccgtaacccc

SEQ ID NO: 406371 - DNA, 563 bp, Homo sapiens
  misc_feature: GZ8MTXP01BNXMZ.10.12.B01.1.454.CMB.2.raw
  modified_base (259)..(259): a, c, t, g, unknown or other
  modified_base (279)..(279): a, c, t, g, unknown or other
  modified_base (360)..(360): a, c, t, g, unknown or other
  modified_base (378)..(378): a, c, t, g, unknown or other
  modified_base (390)..(390): a, c, t, g, unknown or other
  modified_base (422)..(422): a, c, t, g, unknown or other
  modified_base (426)..(426): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtgcagcctntggattgaggtcaataactntgctatgcactggatcccgcaggctaccgaggggagggctaggaatggatgactagttacttcacagatgaaccaaacaantactacgcggtagttcgnggacggggcccngtgcatcgtctaccagacgaacaattacgaanaacnctcgtagtaaccctgaaccaaatcgaaactggtactggaagacggcccgaaggaacctacgggccgttacttacgttttggcgaccgttaagttagggaaggtgggaatcgtaggttagggggtaattttcggaacg

SEQ ID NO: 406372 - DNA, 629 bp, Homo sapiens
  misc_feature: GZ8MTXP01A8QWK.10.12.B01.1.454.CMB.2.raw
  modified_base (258)..(258): a, c, t, g, unknown or other
  modified_base (277)..(277): a, c, t, g, unknown or other
  modified_base (297)..(297): a, c, t, g, unknown or other
  modified_base (370)..(370): a, c, t, g, unknown or other
  modified_base (486)..(486): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtgcagctntggattgagtcaataactntgctatgctacgtgggtccnccaggctccgagggggaagggctgggaatggatgactagttattccactacgatgaccaaaaaaccgaaaacntacgtaaccggcggtaagttccggtagggaacgggggcccgctggcaagtccgtactccaaggagaaccaattacggaaacaacacttcgtaggtaccctggaacaaatcgaaacngtcaggacgtacggaccgagggaacccgaacgggtcccgttacgttaaaccgttttggaacgtcccggttaaagttaccggttaagggtcgggaagtccgtaaggtagggggttacttttaacgggttaacgtttccccgggg

SEQ ID NO: 406373 - DNA, 628 bp, Homo sapiens
  misc_feature: GZ8MTXP01AIDM6.10.12.B01.1.454.CMB.2.raw
tcagcatagtagtgcacgaccggtgctcgatttagtagtgtagattccgcgggggtgggtccaggaggcagaactctgggtgtctcaccatggcctggatccctctacttctcccctcctcactctctgcacagggtccgaggcctcctatgagctgacacagccaccctcggtgtcagtgtccccaggacagacggccaggatcacctgctctggagatgtctttgaccgaagcaaatatgtcttacgtggtaccagcaaggaacgccaggccacggcccctgtaggaacttgtatagtaaggacacgtgacgacggccccgagggctcccgtgacgcgtattctcgtcggccctcagctcgagggaaacaacgtgtcgtacgttgacctagtcgaacggcgggacggcccgggacgagggagggaccggaggccgtagtacgtattacgtgtacaattacgaacgaagtactattacgtaggttacgttgttggggttcgtcgggtcgggtaggtaccgaggtcgtcggttacccggtcgttacggtaccgacggcccgaacggttccgtaacccggtcccccgttaacgggtccctaccgttccgttcccgttcccctaaccccg

SEQ ID NO: 406374 - DNA, 658 bp, Homo sapiens
  misc_feature: GZ8MTXP01A24LF.10.12.B01.1.454.CMB.2.raw
  modified_base (303)..(303): a, c, t, g, unknown or other
  modified_base (377)..(377): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtgcagcctctggatggagttcaataactatgctatgcacgtcgggtccnccagggcctccgaagggggaggggctagggaatggaatgactagtttattcacacgatacgacaaccaaaactntaacctcggacgggtattcgggtggacgggggcctcggtgctagtcggtacctaccgaaggaacgaactaaagttacgaaacgaacctaccgttacgttacggtaaccctaggaaccaaaagttccggaaactacggttcgtagggaacggaacgggccccgggaagggtacccgaacgggttcccgttacgtttaaccgtttttgggacggttcgaacggttaagggtaacgggtgggggtacgtacgtttaaggggtaacgggggttgttttaaccggg

SEQ ID NO: 406375 - DNA, 814 bp, Homo sapiens
  misc_feature: GZ8MTXP01DINGC.10.12.B01.1.454.CMB.2.raw
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtcgtccccaggacagacggccaggatcacctgctctggagatgtctttgccgaagcaatatgcttactggtacagcagaagccaggccacggcccctgtaggtaacttgtaataagtaaaggacacgtgacgacggcccccgagggactcccgtaggacgcgtacttcgtctcgggtcccctccgagtcctacggaacggggaaaacccaaacgtggttacgtaacccgtttacggaacccctagtaccggacgggcccggggaccgggaccccggggacgaacggggaacgggaaccgggaagggtacccttaagggtaacctttaacgtttaaccgttacggttaacctaaaacgttacccgaaaacgtaaacggtaaaccttaaacgttttaaccgttaacgggtttaaaccgtttagggttttagggggtttacggtttaccgggggtacgggggtaacggggttacccgaaacgggtccgttacgggttaaccccggttccggttaaacgggttacccgaaccggaaccccggttaacggggttccccgttccccgggtacccccccgttaaccggggttccctaacccggtttcccgtttccccggtttccccccgttaacccccccg

SEQ ID NO: 406376 - DNA, 590 bp, Homo sapiens
  misc_feature: GZ8MTXP01BUCS0.10.12.B01.1.454.CMB.2.raw
  modified_base (264)..(264): a, c, t, g, unknown or other
  modified_base (398)..(398): a, c, t, g, unknown or other
  modified_base (409)..(409): a, c, t, g, unknown or other
  modified_base (563)..(563): a, c, t, g, unknown or other
tcagcatagtagtgcacgaccggtgctcgatttagtagtgtagattccgcgggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccaggggagtccctgagctctcctgtgcagcctntggatgagttcaatactatgctatgcacgtcgggtccgccgagggctccggagggggaacggggctaggaatggatgactagtttattcacgacgatacgaccaaccaaaacataccgtacgcgggtagttcgnggacggggccnctgcagtccgtacctaccaagacgaacaagttacgaaagtaaccacttactagtaccctgaccaaagtgaactagtctagacgacgccggaaggaccgaccgggtccttacgtttacgttttggacgccgttaagtaagggaaggtggggtaancgttaggtaagggggttctttaacggg

SEQ ID NO: 406377 - DNA, 577 bp, Homo sapiens
  misc_feature: GZ8MTXP01A08CW.10.12.B01.1.454.CMB.2.raw
  modified_base (361)..(361): a, c, t, g, unknown or other
tcagcatagtagtgcacgaccggtgctcgatttagtagtgtagattccgcgggggtgggtccaggaggcagaactctgggtgtctcaccatggcctggatccctctacttctcccctcctcactctctgcacagggtccgaggcctcctatgagctgacacagccaccctcggtgtcagtgtccccaggacagacggccaggatcacctgctctggagatgctttgccgaaagcaatatgcttactgtaccagcagaagccaggccaggcccctgtggaacttgtatataaggacactgagacggcccccaggggactccctgagcgattctctggccctccagctcgagggtaacaacgngtgacgttgaccatcagccggagcccgggacaggacggacgaggctgactatactgtcaatcaacaagactattacgtagttacttagttggggttaggttccgggcgggagggttacccaaaggtcgtcgaccggtccttaacgggtccgtaacggcccgaaggggccttccggcccccgttcgggtcccacgttcctccgttcccctaaccccc

SEQ ID NO: 406378 - DNA, 669 bp, Homo sapiens
  misc_feature: GZ8MTXP01CBYW2.10.12.B01.1.454.CMB.2.raw
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtcgtccccaggacagacggccaggatcactgctcgtggagatgtcttgaccgaagcaatatgtcttacgtggtaccagcagaacgccgaggccacggcccctgtacggtaacttgtaatagtaaaggacacgtgacggaccggaccccgagggactcccgtagacgcgtacttctcgtcggccctccgagtctacgaagggaaacaaacgtggtcgtaacgttcgaacctagtacggaacgggccgggacgggcccggggacgaagggacgggtaacggacggtacgtacgtaacgttattacgtagtacaaatacccaaagtaaacgtactaattacgttaggttactttaggttggggttacgtcgggtcggggtacggtaccaaggtcgtacggttacccgttacgttacggtaccgacgttacccgagggttccctccggtaccccgtcggtacctaccgttccgttcccgttcccctaaccccg

SEQ ID NO: 406379 - DNA, 597 bp, Homo sapiens
  misc_feature: GZ8MTXP01DYV6H.10.12.B01.1.454.CMB.2.raw
  modified_base (389)..(389): a, c, t, g, unknown or other
  modified_base (425)..(425): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcggttttaagaggtgtccagtgtcaggtgcaggttggaggaatcgtgggggagcgtggtccagccgaggggagtccctgagtactctcctgtgcagcctctggattgaggtcaaataactatgctatgctacgtgggtcccgccagggcctaccggagggggaagggggtctagggaatggatgactagttacttccacacgatgaaccaaaaaccaaaacngtaactacggcggtagttcggtgggacggggcccgntcgcagtcgtctaccgagagactaatacgaagaacactcgtaggtacctaggacaaagtgaacagtcgtagacgaggaccgaggaccgaacggtccgttacttaccgttttgagtcgaacgttaggaaggtgggagtaacgttagtaggggttatttggaacgtttccgggg

SEQ ID NO: 406380 - DNA, 638 bp, Homo sapiens
  misc_feature: GZ8MTXP01EHNVA.10.12.B01.1.454.CMB.2.raw
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagtcttgggtttttcctcgttgcttctttttaagaggtgtccagtgtcaggtgcagttggaggaatcgtggggagcgtgtccagccagggagtccctgagactctcctgcgcagctcgtggattgagtcaataactatgctatgcagtggtccgcaggctaccgaaggggagggctaggaatggatgaactgttaattccacgtacatcgaacaaaaaccgaaaatcgtaacaacgggcggaacgtttcggagggacggggtccacctgctagtcccgtatacccgaagacgaaactaacgtacgaaacgaacaacttcgtacggtaacctagaactaaactagaaacctgtaccgtaaggacgacgaccggaacggtaccgtaacccggtcgttcgttaccgtttttggacgaacccgttaagttacggttaaggtaaggggtaccgtaacttaagggtaggggttatttcgggttaacgtttaacccggggg

SEQ ID NO: 406381 - DNA, 599 bp, Homo sapiens
  misc_feature: GZ8MTXP01DJXOD.10.12.B01.1.454.CMB.2.raw
  modified_base (308)..(308): a, c, t, g, unknown or other
  modified_base (376)..(376): a, c, t, g, unknown or other
  modified_base (404)..(404): a, c, t, g, unknown or other
  modified_base (425)..(425): a, c, t, g, unknown or other
  modified_base (462)..(462): a, c, t, g, unknown or other
  modified_base (480)..(480): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttgggctgagctgggttttcctcgttgcttcttttaagaggtgtccagtgtcaggtgcaggttggaggaatcgtgggggaggcgtggtccagccgaggggacgtccctgacgactctcctgtcgcagcctctggatgagttcaaatactatgctatgcacgtgggcccnccaggctccggaagggaaggggctaggaatgggatgactagttattcgacacgatagacaaccaaaantaacacgcggtagttcgaggacgggccntagcagtcgtctaccaagtanaacctaagtacggaaataacaccgttctacgtaaccngaacaaacgtgaaaccgngtactggaacgacgccggaaaggacccgaccgggtccgttacgttacgttttcgcggttacgaaccgttaagggaacgggtgggtaacgtacgttagggtaacggggttgttttaacgg

SEQ ID NO: 406382 - DNA, 555 bp, Homo sapiens
  misc_feature: GZ8MTXP01BWWL9.10.12.B01.1.454.CMB.2.raw
  modified_base (261)..(261): a, c, t, g, unknown or other
  modified_base (297)..(297): a, c, t, g, unknown or other
  modified_base (368)..(368): a, c, t, g, unknown or other
  modified_base (391)..(391): a, c, t, g, unknown or other
  modified_base (402)..(402): a, c, t, g, unknown or other
  modified_base (438)..(438): a, c, t, g, unknown or other
  modified_base (467)..(467): a, c, t, g, unknown or other
  modified_base (496)..(496): a, c, t, g, unknown or other
  modified_base (526)..(526): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcagttggaggaatcgtgggggagcgtggtccagccagggagtccctgagactctcctgtgcagcctntggatgagtcaatactatgctatgcacgtgggtccnccaggctccgagggggagggctaggaatggatgactagttacttccacacgatcgaccaaaaaccaaactntaacgtacgacgggtagttcggnggacggggccnctggcagtcgtctacgaagacgacaagttacgaaanaacactctacggtacctgacaaatgaacngtcagagcgacgtaggacaacggtccttntacgtttgagtcgacgttgaacggtgggangttaggtagggttatttggcgttcccggg

SEQ ID NO: 406383 - DNA, 773 bp, Homo sapiens
  misc_feature: GZ8MTXP01BOC2Y.10.12.B01.1.454.CMB.2.raw
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagcccaccctcggtgtcagtgtccccaggacagacggccaggatcacctgctcgtggagatgtctttgaccgtaaagctaaatatgctttacgtacggtaccagacaaggaacgcccgaggccacggtcctcgtaggttacggtaactttaggtaataaagtaaacggaccaacgtagaacggaccgggccccccgaggggtacctcccgtaggacgacgtattccgtcgtccggcctccgagtccgtacgaaacgggaacaacgtagtacggtaccgttagaacccagtcgacgggaccgggacggaccccgggaggaagggaacgggacgggtaacggtacgttacgtaacgttaagttaacgtacggttaactaaactaccggaaaacgtaaacgtaacgttaaacgtttaacggtttacggggttaaccgtttttaagggttcgggggtttacggttaccgggggtacgggttaccggggtaccgtaaacggttcggttacgggtaccccggttacgtaacgggtccgaccggttacccggaacggttcccgtacccggtcccccgttccgggtaccttcccgtttccgttccccggtttccccccg

SEQ ID NO: 406384 - DNA, 766 bp, Homo sapiens
  misc_feature: GZ8MTXP01EQKUL.10.12.B01.1.454.CMB.2.raw
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctcgtggagatgtctttgaccgaagcaatatgtcttactggtaccagcaagaacgccgacggccacggtcccctgtacggtaacttagtaatagtaaaggacacgtggacggaccggaccccgagggtactcccgtgacgtcgttattcgtcgtcggtccctccgagtctacggaacggggaaaccaaacgtaacggttacgtaaccggtttacgaacccgtaagtcggaacgggacccggggacggggccccggggagaacggggaagggtacccggaggggtaccttaggtaaccttaagtttaacgtacgtaactaaacgtacaaacggtaaacggtaaccttaagtttaccgttaggttaacgtttagggttcggggttaggttccggggacgggtacgggtacccgaaaggtccgttacgggttaccccggttccggttagggttacccgaaccggttaccccggttagggttccccgtcccggttccccccggtttcccggggttccctaccccggtttccgttccccggttttccccccggttccccc

SEQ ID NO: 406385 - DNA, 633 bp, Homo sapiens
  misc_feature: GZ8MTXP01DO6RW.10.12.B01.1.454.CMB.2.raw
  modified_base (238)..(238): a, c, t, g, unknown or other
  modified_base (315)..(315): a, c, t, g, unknown or other
  modified_base (440)..(440): a, c, t, g, unknown or other
  modified_base (454)..(454): a, c, t, g, unknown or other
  modified_base (516)..(516): a, c, t, g, unknown or other
  modified_base (552)..(552): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcaggttggaggaatcgtggggggagcggtggtccagccgagggngtccctgagactctcctgtgcagcctcgtggattgaggttcaaataacttatagctatcgctaccgtcggggtcccncgacgggcctaccggaagggggaagggggtctagggaatgggattgactagtttactttcccaactaacggatacgacccaaaaaacccaaaacaacgttaacgtacggacgggtagtttccggngggacgggggcccngtgctatccgtctacgagacgaactaatacgaaagaacactctagtactagaacaatgaacngtctagcgacgccgacggaaccgaacggtcccgttnttaccgtttgcgtacgttacgttaggttagggtaacgggataacggttaggtagggggttacttttggaacgtttccgggg

SEQ ID NO: 406386 - DNA, 646 bp, Homo sapiens
  misc_feature: GZ8MTXP01ATBPS.10.12.B01.1.454.CMB.2.raw
  modified_base (309)..(309): a, c, t, g, unknown or other
tcagcatagtagtgcacgaccggtgctcgatttagtagtgtagatttcgcggggctgggagacgagcccagcactggaagtcgccggtgtttccattcggtgatcatcactgaacacagagactcaccatggagttggggctgagcttgggttttcctcgttgcttctttttaagaggtgtccagtgtcaggtgcagttggaggaatcgtgggggagcgtggtccagccgaggggacgtccctgagactctcctgtgcagcctgtggtattggaggtacaaataactatgtctatgctacgtgggtccncgaggctccgaggggacgggtcgtaggaagtggatgactagttattccacgtacgatacgaccaaaaaacccaaaactctaacgtacggcggtagttccggtagggacggggccctctgacctagtccgtacctacaagtaacgaactaagttaccgaaagtaaccacgttacgtacggtacctagaacgaaactagaaccagttacgacggaagacggaccgtaacgggcccgtaacgggtcccgttacgttacgtttggacgtacgttaacgttagggacgggttcgggagtaacgttaagggtaggggtttattcggttaacgtttcccggggg

SEQ ID NO: 406387 - DNA, 666 bp, Homo sapiens
  misc_feature: GZ8MTXP01DKIIZ.10.12.B01.1.454.CMB.2.raw
  modified_base (264)..(264): a, c, t, g, unknown or other
  modified_base (282)..(282): a, c, t, g, unknown or other
  modified_base (288)..(288): a, c, t, g, unknown or other
  modified_base (305)..(305): a, c, t, g, unknown or other
  modified_base (378)..(378): a, c, t, g, unknown or other
  modified_base (400)..(400): a, c, t, g, unknown or other
  modified_base (410)..(410): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcttgggttttcctcgttgctcttttaagaggtgtccagtgtcaggtgcagttggagaatcgtgggggagcgtggtccagccaggggagtccctgagactctcctgtgcagcctntggatgagtcaataactntgctangaccacgtggggtcccncgaggcctaccggagggggaaggggctagggaatggatgacttagttattcactacgatacgacaaccaaaangtaactacggcggtagttcggngggacgggcnctggcacttcgactacgagacgaactaaattaccggaaaagtaaccctacgttaccgttacggttaaaccctaggtaaaccaaaagttcggtaaaccgtaggtttccgtagggaacgacgggaaccccgggtaacgggaacccgttaccggggtaccgtttaccgtttaacgttttcgggaacgttacccggttaacgttaaggggaaaggttcgggggaatcggttaaggttaacgggggttaagttttaacggg

SEQ ID NO: 406388 - DNA, 519 bp, Homo sapiens
  misc_feature: GZ8MTXP02JA5J7.10.12.B01.1.454.CMB.2.raw
  modified_base (408)..(408): a, c, t, g, unknown or other
tcagcatagtagtgcacgaccggtgctcgatttagtagtgtagattccgcggggtgggtccaggaggcagaactctgggtgtctcaccatggcctggatccctctacttctcccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagaggcccccaggggactcccgtgagcgattctctggcctccagctcagggacaacagtgacgttgaccatcagcggagcccggcaggaggacgaggctggactattacngtcaaatcaacaagacaattactggtacttagtgggtgttcgggcggagggtcaagctgaccgtctaggtcacgcccaaggctcgcccctcggtcactctcgttccgcccc

SEQ ID NO: 406389 - DNA, 511 bp, Homo sapiens
  misc_feature: GZ8MTXP02JJVCD.10.12.B01.1.454.CMB.2.raw
  modified_base (328)..(328): a, c, t, g, unknown or other
  modified_base (352)..(352): a, c, t, g, unknown or other
  modified_base (381)..(381): a, c, t, g, unknown or other
  modified_base (402)..(402): a, c, t, g, unknown or other
  modified_base (412)..(412): a, c, t, g, unknown or other
  modified_base (444)..(444): a, c, t, g, unknown or other
  modified_base (509)..(509): a, c, t, g, unknown or other
tcagcatagtagtgcacgaccggtgctcgatttagtagtgtagattccgcggggtgggtccaggaggcagaactctgggtgtctcaccatggcctggatccctctacttctcccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagaggcccccagggatccctgagcgattcnctggcctccagctcagggacaacngtgacgttgaccatcagcggagcccgggnagaggacgagctgactatacngtcaaatcanaagacattactagtacttagtgggtgttcggnggtagggtcaagctgaccgtctaggtcacgcccaaggctgcccctcggtcactctcgttcccccncc

SEQ ID NO: 406390 - DNA, 582 bp, Homo sapiens
  misc_feature: GZ8MTXP02G7TPW.10.12.B01.1.454.CMB.2.raw
  modified_base (371)..(371): a, c, t, g, unknown or other
  modified_base (389)..(389): a, c, t, g, unknown or other
  modified_base (400)..(400): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcgtggtccagccagggaggtccctgagactctcctgtgcagcctctggattgaggttcaatactatgctatgcacgtgggtccgccaggcctaccgaggggaaggggctagggaatggatggacagtttattccacacgatgacaaaccaaaacntactacgcggtagttcgnggacggggccnctgctagtccgtctccgagacgactaagttacgaaagaactactctacgtacctgactaaatcgaaacagtcaggaacgaggaccggaagaccgaccgggtccttacttaccgttttggacgacgtaaacgtaggaacggtgggagtacgttaggtagggggtactttggtactttccgggg

SEQ ID NO: 406391 - DNA, 537 bp, Homo sapiens
  misc_feature: GZ8MTXP02G7HU7.10.12.B01.1.454.CMB.2.raw
  modified_base (355)..(355): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagacggcccccagggactccctgagcgattctctggcctcagctcagggacaacngtgacgttgaccatcgagcggacgcccgggacagaggacgaggctgactattactgtacaaatcaaacaagacatttaactggttaacttagttgggtgttcgggcggtagggtcaaggctgacccgttcgtaggtcacgcccgaaggctcgcccctcggtccacgtctcgttcccctaccc

SEQ ID NO: 406392 - DNA, 520 bp, Homo sapiens
  misc_feature: GZ8MTXP02I0WL2.10.12.B01.1.454.CMB.2.raw
  modified_base (264)..(264): a, c, t, g, unknown or other
  modified_base (303)..(303): a, c, t, g, unknown or other
  modified_base (362)..(362): a, c, t, g, unknown or other
  modified_base (379)..(379): a, c, t, g, unknown or other
  modified_base (387)..(387): a, c, t, g, unknown or other
  modified_base (501)..(501): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccaggggagtccctgagactctcctgtgcagcctntggattgagttcaataactatgctatgcacgtgggtccncaggctccgaggggagggctggaatggatgacagttattcacacgatgacaaccaaacntactacgcggagttcgngaggggcngtgcatcgtctccagacgacaatcgaaagacactctgtacctgacaaatgaacagtctgagagaccgaggacacggccgttactacttttgcgcgacgtaaggaagtcgggacngtaagtaggggtatttagg

SEQ ID NO: 406393 - DNA, 601 bp, Homo sapiens
  misc_feature: GZ8MTXP02F8TIN.10.12.B01.1.454.CMB.2.raw
  modified_base (264)..(264): a, c, t, g, unknown or other
  modified_base (281)..(281): a, c, t, g, unknown or other
  modified_base (283)..(284): a, c, t, g, unknown or other
  modified_base (286)..(286): a, c, t, g, unknown or other
  modified_base (311)..(311): a, c, t, g, unknown or other
  modified_base (313)..(313): a, c, t, g, unknown or other
  modified_base (340)..(340): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcgtggtttcgcgtaggcgtctttaagaggtgtccagtgtcaggtgcagttggaggaatcgtgggggagcgtggtccagccagggaggtccctgagctctcctgtgcagctctgntgaggtcatactatgtntnncncgtcggtcgcgcgcgcgaggagggngngagtgagtgagtacgtatacacacganacgacaccaaacaactacgtacgacggtacgtcggtcggacgggcgtcgtcgcgtacgtcgtcgtacgacgacgaacgtaacgtaacgaaacgaactactacgtacgtacgtacgtaacgtaacgtaacgtaacgtacgtacgtacgacgacgaccggacggaccggaccggtaccgttacgtttacgtttacgttacgtacgtaacgtaaggtaacggtacgggtacggtacggtacggttaacgggttacggtttacgg

SEQ ID NO: 406394 - DNA, 571 bp, Homo sapiens
  misc_feature: GZ8MTXP02F6R9N.10.12.B01.1.454.CMB.2.raw
  modified_base (259)..(259): a, c, t, g, unknown or other
  modified_base (372)..(372): a, c, t, g, unknown or other
  modified_base (426)..(426): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggaggtccctgagctctcctgtgcagcctntggattgaggttcaataactatgctatgcacgtgggtccgccaggctccgaggggaaggggctagggaatggatgactagtttattcccacacgatcgacaaaacccaaaacnctaacctacggcgggtagttcggtaggacgggggccgctgcatcgtctcgaganacaattcgaaacgaacactctagtacctagacaaatgaaacagtcagagacgaccggaggaccgacggccgttcttacgttttgcgacgtaacgtaggaaggtgggaacgtacgttaggtaggggtatttaggacgtttccgggg

SEQ ID NO: 406395 - DNA, 624 bp, Homo sapiens
  misc_feature: GZ8MTXP02HNFJF.10.12.B01.1.454.CMB.2.raw
  modified_base (214)..(214): a, c, t, g, unknown or other
  modified_base (256)..(256): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcggtggtttcgcgtaggcgtctttaagaggtgtccagtgtcaggtgcagttggaggaatcgtgggggnggcggtggtcgagcgaggacggtccgtgagactctctgtgcncgcgtcgtggtagtgtaggtactaataactagtgtctatgtacacgtcgtacgtccgaccgacggcgtacggacggggaacgggacggtaggagtaggagtagtagtagttacttacacacgatacgaacaaacaactaactaacgtacgacgtacgtacgtacggacgggcgcgtcgacgtacgtcgtcgtacgacgaacgaacgtaacgtacgaacgaaactacgtacgtacgtacgtacgaacaagtacgtaacgtacgtacgtagacgacgacgacggacgtaccggtaccgttacgttacgtttacgtacgtacgtacgtaacgtaaggtaggacgtacgtaggtacggttacgttacgtacg

SEQ ID NO: 406396 - DNA, 560 bp, Homo sapiens
  misc_feature: GZ8MTXP02GHI0D.10.12.B01.1.454.CMB.2.raw
  modified_base (263)..(263): a, c, t, g, unknown or other
  modified_base (301)..(301): a, c, t, g, unknown or other
  modified_base (395)..(395): a, c, t, g, unknown or other
  modified_base (407)..(407): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtgcagcctntggattgaggttcaataactatgctatgcagtggtccnccaggctccgaggggagggctaggatggatgactagttattcacacgatcgacaaccaaaacataacgacgcggtagttcggaggacggggccncgtgcatcgtcncagagactactacgaaagaacactctacgtacctagaacaaagtacgaaactagtacaggacgacgccggaacggacgaccggtccgttacttacgttttggcgtacgtaacgtaaggaaggtcgggagtacgttaggtacggggtatttcgg

SEQ ID NO: 406397 - DNA, 557 bp, Homo sapiens
  misc_feature: GZ8MTXP02JM5MJ.10.12.B01.1.454.CMB.2.raw
  modified_base (264)..(264): a, c, t, g, unknown or other
  modified_base (301)..(301): a, c, t, g, unknown or other
  modified_base (364)..(364): a, c, t, g, unknown or other
  modified_base (383)..(383): a, c, t, g, unknown or other
  modified_base (394)..(394): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggaggtccctgagactctcctgtgcagcctnggattgagttcaatactatgctatgcacgtgggtccncaggctcgaggggagggctggaatggatggactagttattcgacacgatcgacaaccaaaacntaactacgcggtagttcgnggacggggccncgtgcatcgtctccgagacgacaattacgaaagaacactctagtacctagacaaatgaaactgtactagaacgacgacccgaggacaccgggtccgttacttacgttttcgacgtacgacgtaaggaacggtacgggacgtgtacggtagggggtatttacgg

SEQ ID NO: 406398 - DNA, 559 bp, Homo sapiens
  misc_feature: GZ8MTXP02IFME6.10.12.B01.1.454.CMB.2.raw
  modified_base (237)..(237): a, c, t, g, unknown or other
  modified_base (265)..(265): a, c, t, g, unknown or other
  modified_base (301)..(301): a, c, t, g, unknown or other
  modified_base (359)..(359): a, c, t, g, unknown or other
  modified_base (375)..(375): a, c, t, g, unknown or other
  modified_base (385)..(385): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgagggnggtccctgagactctcctgtgcagcctntggattgagttcaatactatgctatgcacgtggccncaggctcgagggagggctggatggatgactagttattcacacgatcgacaaccaaaantactacgcgtagtcgnggacgggccntgcatcgtctccagacgactaattacgaaagtaacactctagtaccctagaactaaatacgaaactaggtctaggacgacggaccggaacgggaccgtaccggggtaccttcgttaacgttttgacgtacgacgtaaaggaggtgggacgtagtacggtaggggttatttacgg

SEQ ID NO: 406399 - DNA, 607 bp, Homo sapiens
  misc_feature: GZ8MTXP02IEGDE.10.12.B01.1.454.CMB.2.raw
  modified_base (162)..(162): a, c, t, g, unknown or other
  modified_base (178)..(178): a, c, t, g, unknown or other
  modified_base (437)..(437): a, c, t, g, unknown or other
  modified_base (501)..(501): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttccncgttgctcttttaagngtgtccagtgtcaggtgcagttggaggaatcgtgggggagcgtggtccagccgagggacgtccctgacgactctcctgtgcagcctcgtggattgaggttcaaataactatgctatgcacgtcggtcccgcgaggctccggaggggaacgggctaggaatgggatgactagtttactcacacgatcgacaaaccgaaacataaccgacggcggtaacgttcggtagggaccggggccgtactggaccagttcccgtacnccgaagacgaaactaagttaccgaaaagtacctacttccgtagtacctgaaactaatacgaacngtcgagaagacgacgaacgggacctacggtccgttaacgttcgtttcgacgtaccggaataaggaaacggttggggaactacggtaacgggtaggttaagtttcgg

SEQ ID NO: 406400 - DNA, 646 bp, Homo sapiens
  misc_feature: GZ8MTXP02JOH0F.10.12.B01.1.454.CMB.2.raw
  modified_base (264)..(264): a, c, t, g, unknown or other
  modified_base (285)..(285): a, c, t, g, unknown or other
  modified_base (303)..(303): a, c, t, g, unknown or other
  modified_base (368)..(368): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggaggtccctgagactctcctgtgcagcctntggattgaggttcaatactangctatgcacgtgggtccncaggctccgagggagggctaggaatggatgactagtttacttcgacacgatacgacaaccaaaantaaccgtacggcggtaagtttccggagggacgggggtcccgcgtcgacgtacgtccgtactaccgaaggtaacgaactaagttaacgaaacgaactacgttaccgtacgtaccctagaacctaaaagtacggaaacgtcgtacgtaggaacgaacgacccggtaaagtaccggaacccggtaccgggtcccgtttacgtttaccgtttcggacggtaacgtaaacgtaagggtaacgggttacgggggaacgtacggtttaacgggtaagggggttac

SEQ ID NO: 406401 - DNA, 540 bp, Homo sapiens
  misc_feature: GZ8MTXP02JS23M.10.12.B01.1.454.CMB.2.raw
  modified_base (303)..(303): a, c, t, g, unknown or other
  modified_base (369)..(369): a, c, t, g, unknown or other
  modified_base (399)..(399): a, c, t, g, unknown or other
  modified_base (519)..(519): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggagcgtggtccagccagggaggtccctgagactctcctgtgcagcctctggattgaggttcaataactatgctatgcacgtgggtccncaggctccgaggggaagggctaggaatgggatggacagtttattcacacgtatgacaaccaaaacntaacgtacgcggtagttcgtggaggggccnctgcatccgtctccagagacaagttcgaaagacactctagtacctgacaaatgaacagtcagagacgccgaggaccacggtccgtcttacgtttgcgacgtaactaaggaaggtgggacncgtagtacggggtatttacgg

SEQ ID NO: 406402 - DNA, 568 bp, Homo sapiens
  misc_feature: GZ8MTXP02HB0C6.10.12.B01.1.454.CMB.2.raw
  modified_base (267)..(267): a, c, t, g, unknown or other
  modified_base (306)..(306): a, c, t, g, unknown or other
  modified_base (373)..(373): a, c, t, g, unknown or other
  modified_base (391)..(391): a, c, t, g, unknown or other
  modified_base (400)..(400): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgaggggaggtccctgagactctcctgtgcagccctntggattgaggttcaaataactatgctatgcacgtggccnccaggcctcgagggaaggggctaggaatggatggactagttattcaacacgatcgacaaccaaaacntacctacgcggtagtcgngacgggccntgcatcgtctccagagacaagtagaaagacactctagtacctgactaaatagaaactagtctagaagacgaccggaaaggaccgaccgggtccttacgttaccttttcggacgtacgaacgttaaggaacggttaggggagtacgtaaggttacgggggtactttagg

SEQ ID NO: 406403 - DNA, 724 bp, Homo sapiens
  misc_feature: GZ8MTXP02IHHMC.10.12.B01.1.454.CMB.2.raw
  modified_base (212)..(212): a, c, t, g, unknown or other
  modified_base (264)..(264): a, c, t, g, unknown or other
  modified_base (304)..(304): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgngggggagcgtggtccagccagggaggtccctgagactctcctgtgcagcctntggattgaggttcaataactatgctatgcactgggtcccnccaggctccgaggggaagggctggaatggatgactagtttactttcacacgatacgacctaaccgaaaacattaaccgtaacggccggggaaggtttaccggtagggaacgggggtcccgacgttacggacctaacgttcccgttctaccccgaaggaacggtaaaccaaagttaccgaaaacggtaaaccctaaccttaccgttacgttaaacccccgttaggaaaccctaaaagttacgaaacctaacggttcctaaggacggaacggaaccccgggaaacggggtaacccgaaaccggggtcccgtttaaccgtttaacccggtttttgggaccggtaccggtaaccgttaaagggaaaccgggttacggggtaacggtaccgtttaaggggttaacgggggttatttttaacgggg

SEQ ID NO: 406404 - DNA, 591 bp, Homo sapiens
  misc_feature: GZ8MTXP02GMT1B.10.12.B01.1.454.CMB.2.raw
  modified_base (307)..(307): a, c, t, g, unknown or other
  modified_base (374)..(374): a, c, t, g, unknown or other
  modified_base (405)..(405): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtttccagtgtcaggtgcagttggaggaatcgtgggggaggcgtggtccagccgagggaggtccctgagactctcctgtgcagcctctggattgagttcaataactatgctatgcacgtggggtcccnccaggcctccgaggggaagggctaggaatgggatgactagttacttcacacgatcgaccaaacaacntaacacggcgtagttcgagggacggggcccngtcggcagtccgtctaccgagaacgaactaagttcgaaagaaacctctactacgtaacctgacctaaaatcgaaaccagttacgagaaggacggccggaaacggtacccgacgggtccttacgttacgttttaggcgtaccgagtaaggaaggtgggacgtacgtagtagggggtactttggtacg

SEQ ID NO: 406405 - DNA, 518 bp, Homo sapiens
  misc_feature: GZ8MTXP02GGJBP.10.12.B01.1.454.CMB.2.raw
  modified_base (301)..(301): a, c, t, g, unknown or other
  modified_base (363)..(363): a, c, t, g, unknown or other
  modified_base (381)..(381): a, c, t, g, unknown or other
  modified_base (390)..(390): a, c, t, g, unknown or other
  modified_base (444)..(444): a, c, t, g, unknown or other
  modified_base (470)..(470): a, c, t, g, unknown or other
  modified_base (500)..(500): a, c, t, g, unknown or other
  modified_base (513)..(513): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatctgggggagcgtggtccagccagggagtccctgagactctcctgtgcagcctctggattgaggttcaataactatgctatgcactgggtccncaggctccgaggggaagggctggaatggatgacagttattcacacgatcgacaaccaaaacntactacgcggtagttcgngaggggccntgcatcgtctccagagacaattcgaaagacactctagtacctgacaaatgaacngtctgagagaccgagacacggccgtntactttgcgtcgactaaggaagtggggacncgtagtaggggtntttag

SEQ ID NO: 406406 - DNA, 542 bp, Homo sapiens
  misc_feature: GZ8MTXP02JXCPN.10.12.B01.1.454.CMB.2.raw
  modified_base (358)..(358): a, c, t, g, unknown or other
  modified_base (459)..(459): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtggaacttgtatataaggacactgagacggcccccagggactccctgagcgattctctggcctccagctacgagggacaacngtgacgttgaccatcgagcggacgcccgggcaggaggacgaggctagactattactgtacaatcaacaagactattacgtgtacttagttgggtgtcgggnggaggtacgaagtcgtagaccgtccgtaggtacacgacccaaggcctccgccccctcggtcctactccgtccgtcccgtcccc

SEQ ID NO: 406407 - DNA, 579 bp, Homo sapiens
  misc_feature: GZ8MTXP02HTVYY.10.12.B01.1.454.CMB.2.raw
  modified_base (300)..(300): a, c, t, g, unknown or other
  modified_base (367)..(367): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggaggtccctgagactctcctgtgcagcctgtggattgaggttcaaataactatgctatgcagtgggtccncaggctccgaggggagggctggaatggatgacagtttattccacgacgatacgacaaaacccaaaanctaactacggcgtagtttcggaggaggggcccacgtgcatcgtctccgagacgacaagttcgaaagaacactcgtagtacctgacaaatcgaacagtctaggagacgaccggaagaccgacgggtccgttcgttaacgttttggcgacgtacgtaaggaagttcggggaacgtacgttaaggaggggttaactttcggtacgtttacccggg

SEQ ID NO: 406408 - DNA, 626 bp, Homo sapiens
  misc_feature: GZ8MTXP02HL0B3.10.12.B01.1.454.CMB.2.raw
  modified_base (288)..(288): a, c, t, g, unknown or other
  modified_base (357)..(357): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcgtggtttcgcgttaggctctttaagaggtgtccagtgtcaggtgcagttggaggaatcgtgggggagcgtggtccagccgagggaggtccctgagctctcctgtgcagctctggattgaggttcaataactaatgtntatgcgcgtcggtccgccgacgcgcggagggagggcgaggagtgagtagtagtacgttattacacacanacgaacaaccaaacaactaacgtacgacggtacggtacggtacgggacgggcgcgtcgacgtacgtccgtcgtacgacgaacgaacgtaacgtaacgaaacgaacctactacgtacgtacctacgtaacaaacgtaacgaacgtacgtacgtagacgacggaccggaaccggacggaccggtaccgttaccgttacgtttacggtacgtacgtaacggtaacggtaaggtacgggtacggtacggtacggttacgggttacggtttacg

SEQ ID NO: 406409 - DNA, 679 bp, Homo sapiens
  misc_feature: GZ8MTXP02IR3BZ.10.12.B01.1.454.CMB.2.raw
  modified_base (258)..(258): a, c, t, g, unknown or other
  modified_base (465)..(465): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcgtggtttcctcgttgctctttaagaggtgtccagtgtcaggtgcagttggaggaatcgtgggggaggcgtggtccagccgagggagtccctgagctctctgtgcagccctntggattgaggttcaaataactatgctatgcacgtggtccgcgaggctaccggaggggaacggggctgggaaatggatcggactagttattccacacgactgaaccaaaccaaaactgtaaactacggacggtaacgttcggcggggaacggggccgcgtcggctacgtccggtcctacccgaggacgaacgtaacttaacgggaaanaacctactccgttacggtaacccttgaacctaaagtacgaaacctagttccgagaacggaacggccggaaacgggaaccgccgggtacccgtttacggtttaacccgtttttgggacgtaacccggtaacgttaaaggggtagggtaacggggtacgtaacggtttaacgggtaacgggggtttagttttacgggtaacccgtttacccggggg

SEQ ID NO: 406410 - DNA, 618 bp, Homo sapiens
  misc_feature: GZ8MTXP02HWOEE.10.12.B01.1.454.CMB.2.raw
  modified_base (261)..(261): a, c, t, g, unknown or other
  modified_base (411)..(411): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggagaatcgtgggggagcgtggccagccagggagtccctgagactctcctgtgcagcctnggattgaggttcaatactatgctatgcacgtcgggtccgcgaggcctccggaaggggagggctaggaatggatgaactagtttacttacacacgatacgaacaaccaaaacactaaccgtaccgagggtacgttcggagggacggggccncgtgctatcgtactaccgaagaacgaactaagttacgaaaagtacctactacgttacgtaacctaggaaacctaaaagtcgaaaactaggttcgaggaaacgacgacccggaaggacccgtaccggtccgttactttacgtttcggacgtacgtaacgtaaggtaaggtacgggacgtacgttaaggttagggggttactttacggg

SEQ ID NO: 406411 - DNA, 618 bp, Homo sapiens
  misc_feature: GZ8MTXP02J2LUV.10.12.B01.1.454.CMB.2.raw
  modified_base (302)..(302): a, c, t, g, unknown or other
  modified_base (407)..(407): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgcttcttttaagaggtgtccagtgtcaggtgcagttggagaatcgtgggggagcgtggtccagccgagggagtccctgagctctcctgtgcagcctctggattgagttcaatactatgctatgcacgtgggtcccncaggcctaccggaggggaaggggctagggaaatgggaatggaactagttacttcaacacgatcgaaccaacccaaaatactaccgacgccgggtaagtttccggngggacgggggccgctggacagtcgactaccagaagaacaattacgaaacgacactcgtacgtacctagaacctaaatcgaaactcggtactaggaacgacggccggaacgggaccgaccggggtacccgttacgtttaacgttttcggacgtaccggtaacgtaagggtaacggtcggggagtacggttaggtaacggggttatttacggg

SEQ ID NO: 406412 - DNA, 555 bp, Homo sapiens
  misc_feature: GZ8MTXP02FUXOU.10.12.B01.1.454.CMB.2.raw
  modified_base (365)..(365): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccacggcccctgtgaacttgtatataaggacactgagacggcccccgaggggactcccgtgagcgtattctcgtggccctccagctcgagggacaaacgnggtgacggttagaacccagtacgaggcgggacgccccggggacaagggaaggacggaggctgaacttagttactagtcaaatcaacaaagactattactagtaacttagttgggtgttcggcggaggtccgaagcgtgaccgtccgtaggtcacgaccagctcgcccctcggcactcgtcgtcccgtccc

SEQ ID NO: 406413 - DNA, 551 bp, Homo sapiens
  misc_feature: GZ8MTXP02FK0Q2.10.12.B01.1.454.CMB.2.raw
  modified_base (360)..(360): a, c, t, g, unknown or other
  modified_base (391)..(391): a, c, t, g, unknown or other
  modified_base (405)..(405): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggccccctgtggaacttgtatataaggacactgagacggcccccaggggactccccgtgagcgattctctggcctccagctcgaggacaacngtgacgttgaccatcagcgggacgcccgggnaggaggacgaggcnggactattactgtcaaatcaacaagactattacgtagttacttagttggggtgttcgggacggtagggtccaaggcctaggaccgtcgtaggtcacgtacccaggcctccgcccccgttcggtcaccttctccgttcccgtccccc

SEQ ID NO: 406414 - DNA, 713 bp, Homo sapiens
  misc_feature: GZ8MTXP02G33TR.10.12.B01.1.454.CMB.2.raw
  modified_base (306)..(306): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccaggggagtccctggagactctcctgtgcagcctgtggattggaggttcaaataactatgctatgcacgtgggccncaggctccgaaggggagggctaggaatggatgactagttattcacacgatacgacaaaccaaaacataacgtacggcgggtaagtttccggagggacggggcccgtacgtcgacctacggtcccgttaccgtacccgggaagtaaactaaacgttaccgggaaaacgaaaaccctaccgtttacttaccgggtttaaccctaggaaacctaaaaagtacggaaaacccgtaggtttaccgaacggaaggaaccggaacccggggaaacggaacccggtaacccggggtccccggtttaacctttaacggtttttcggacggtaaccggtaaaccgttaaaggggaaaacggttcgggggaacgttacggtaaggtttaaacggggggtacttttaggggtaacccgg

SEQ ID NO: 406415 - DNA, 523 bp, Homo sapiens
  misc_feature: GZ8MTXP02HSNYN.10.12.B01.1.454.CMB.2.raw
  modified_base (305)..(305): a, c, t, g, unknown or other
  modified_base (366)..(366): a, c, t, g, unknown or other
  modified_base (373)..(373): a, c, t, g, unknown or other
  modified_base (382)..(382): a, c, t, g, unknown or other
  modified_base (391)..(391): a, c, t, g, unknown or other
  modified_base (422)..(422): a, c, t, g, unknown or other
  modified_base (443)..(443): a, c, t, g, unknown or other
  modified_base (447)..(447): a, c, t, g, unknown or other
  modified_base (496)..(496): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgagggaggtccctgagactctcctgtgcagcctctggattgaggttcaataactatgctatgcacgtgggtccncaggctcgaggggagggctggaatggatgactagttattcacacgatcgacaaccaaaacntacacgnggagttcgngaggggccngtgcatcgtctcagagacatacgaaagaacnctctgacctgacaaatgaacngtcngagagccgaggacacggcctcttacgtttgcgtcgtactaaggaacggngggtaagcgtaagtaggggtatttagg

SEQ ID NO: 406416 - DNA, 637 bp, Homo sapiens
  misc_feature: GZ8MTXP02HLGUN.10.12.B01.1.454.CMB.2.raw
  modified_base (301)..(301): a, c, t, g, unknown or other
  modified_base (375)..(375): a, c, t, g, unknown or other
  modified_base (385)..(385): a, c, t, g, unknown or other
  modified_base (395)..(395): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgagggagtccctgagctctcctgtgcagcctgtggattggagttcaaatactatgctatgcacgtggccnccgaggcctcggaggggaggggctggaatggatggactagttacttcacagatcgacaaccaaacatactacgnggtagttcgnggaggggccnctcgcatccgtctccgagacgtacaagttacgaaagaacctactacgttagtaccctagaacctaaagtacgaaaccgtagtacgtaggaacggacgacccgggaacgggaacccgaccggggttacccgtttaaccgtttaccgtttttacgggacgtaacccggttaccggtaaagggtaaacgggttacgggggtaacgtacgtttaaacgggtaagggggtttaacgttttaacgggg

SEQ ID NO: 406417 - DNA, 561 bp, Homo sapiens
  misc_feature: GZ8MTXP02IRIQ4.10.12.B01.1.454.CMB.2.raw
  modified_base (262)..(262): a, c, t, g, unknown or other
  modified_base (301)..(301): a, c, t, g, unknown or other
  modified_base (362)..(362): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggtttcctcgttgctctttaagaggtgtccagtgtcaggtgcagttggaggaatcgtgggggagcgtggtccagccagggaggtccctgagactctcttgtgcagcctntggattgaggttcaataactatgctatgcactgggtccnccaggctccgaggggagggctggaatggatgactagttattcacacgatcgacacaaaacntacgtacgcgggtagttcggtggacggggccgctgcatcgtctccagacgacatacgaaagaacactctacgttaccctagacctaaatggaaactagtactagacgagacccggaggacacggtccgttacttacgttttcggacgacgtaacgtaaggtaaaggtcgggagtactaaggtacggggttagtttacgg

SEQ ID NO: 406418 - DNA, 635 bp, Homo sapiens
  misc_feature: GZ8MTXP02FWZW7.10.12.B01.1.454.CMB.2.raw
  modified_base (263)..(263): a, c, t, g, unknown or other
  modified_base (301)..(301): a, c, t, g, unknown or other
  modified_base (624)..(624): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgagggagtccctgagctctcctgtgcagcctntggattgaggttcaatactatgctatgcacgtggtccncaggcctcggaggggaggcaggatgatgactagttactcacgacatacgaacaacgaaactactacgacggtcgtagttcggagggacggggtccctgtacgcctacgttcccgtaccacccgaaagaacggtaactaaaacgttaccggaaaacgtacctacgttaccgtacgtaccctaggaaactaaaacgtaggaacctagtcgaggacgacggacccggaaggacccgtacggtcccgtttacgttacgtttagaccggacgtaaccggtaagggtaacgggtagggaaccgttacggtaaacgggttacgggggttntttaaccgggg

SEQ ID NO: 406419 - DNA, 607 bp, Homo sapiens
  misc_feature: GZ8MTXP02G2ZS9.10.12.B01.1.454.CMB.2.raw
  modified_base (175)..(175): a, c, t, g, unknown or other
  modified_base (233)..(233): a, c, t, g, unknown or other
  modified_base (259)..(259): a, c, t, g, unknown or other
  modified_base (371)..(371): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgcttcttttaagnggtgtccagtgtcaggtgcagttggaggaatcgtgggggagcgtggtccagccagggngtcctgagactctcctgtgcagcctntggattgaggttcaaatactatgctatgcacgtgggtcccgccaggctccggaaggggaacggggctgggaatggatgactagttattccacacgatgaccaaaaccaaaantaacacggcgggtagttccggagggacgggggcccacgtcgaccgtactccggtactacccgaagaacgaactaagttaacgaaagaaaccacttacgtagtaacccgtgaacaaaatagaaactagtactaggacgacgacccgaaggaccgacgggtcccttagttacgtttgcggaccgtaacgtaaggaagggtggacgtacgtaaggtaggggtatttggacgtttcgggg

SEQ ID NO: 406420 - DNA, 694 bp, Homo sapiens
  misc_feature: GZ8MTXP02JTTZY.10.12.B01.1.454.CMB.2.raw
  modified_base (288)..(288): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcttgggttttcctcgttgctcttttaagaggtgtccagtgtcaggtgcaggttggaggaatcgtgggggagcgtggtccagccgagggagtccctgagactctcctgtgcagcctgtggattggaggttcaataactntgctatgctacgtcgggtccgcaggcctaccggaaggggaacggggcttagggaatcggggatggtaactagtttacttcgaacgacgtatacgaacctaaaccaaaactgtaaccgtacggacgggtacgtttacgggtacggggacggggcccgtacgtcgacctacgttcccggttacctacccgaaaggtaacgtaaaccgtaaacgtttaaccgggaaaacgtaaacccttaccgttaccgttacggtaaccccgttagaaaccctaaaagttacggaaaccgtagtaccgttaggacggacggtacccggaacggtaaccgaccggtccgttaccttacgtttacgacggacgtaacgtaaggaacggtggaacgtcgtaaggttaggggtactttacgg

SEQ ID NO: 406421 - DNA, 650 bp, Homo sapiens
  misc_feature: GZ8MTXP02G4OD3.10.12.B01.1.454.CMB.2.raw
  modified_base (241)..(241): a, c, t, g, unknown or other
  modified_base (377)..(377): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcgtggtccagccgagggacgtcccngacgctctcctgtgcagcctctggattgaggttcaaatactatgctatgcacgtcgggccgccgaggcctaccggaggggaacggggctgggaatggatggactagttattccacacgtatgaccaaaccaaaacnctaacgtacggcggtagttccggtagggaccggggtccgctgccatccgtctacccgagacgaactaacgtcgaaaacgtacctaactctacgttaccctgaacaaagtacgaaactgttacgagacggacgacccggagggaacccgtaccggggtcccgtttacgtttacgttttcggcggtaaccgtaacgttaacgggaaaggttcggggtaacgttaacggttaagggtaagggggtttacgtttacgggtaccgttttacccggggg

SEQ ID NO: 406422 - DNA, 669 bp, Homo sapiens
  misc_feature: GZ8MTXP02G2JZ7.10.12.B01.1.454.CMB.2.raw
  modified_base (220)..(220): a, c, t, g, unknown or other
  modified_base (357)..(357): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtcgtccccaggacagacggccaggatcacctgctctgganatgtctttgaccgaagctaatatgtcttacgtgtacagcagacgccaggccacggccctggtacggtaacttgtaatagtaaggactacgtgaacgaccggccccgaagggtacctcccgtagacgtcgtacttccncgtcggccctccagtctacgaagggaccaagtcggtacgtaacggttcgaacccgtagaccgacgggccgggaacggcccgggaacgaacgggacgggaacggaggctacggaactttacgtacgttacgtaactaaatacgaaacaaacggtaactaagtttaacgttacgttaacgtttagggttacgggttcgggttcggggacgggtacgggttaccgaacggtaccgtacggttaccgtcggtacgacgtacccgaacgcgtccgtaacccgtcccggtctactccgttcgttccgttccgtacccg

SEQ ID NO: 406423 - DNA, 606 bp, Homo sapiens
  misc_feature: GZ8MTXP02GFSIS.10.12.B01.1.454.CMB.2.raw
  modified_base (307)..(307): a, c, t, g, unknown or other
  modified_base (427)..(427): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgagggacgtccctgagctctcctgtgcagcctcgtggattggaggttcaataactatgctatgcacgtgggtcccnccgaggccgtccgaaggggaacgggctagggaagtggatgactagtttattcaacacgatacgacaaccaaacataacgacgcgtagttcggaggacggggccactgactagtccgtacncgagagacaaacgtacgaaagtaccactacgtcgtacctagaacaaaacgtgaaactagtcgaggaacgacgaccggaaggacccgaacggggtcccttacgtttacgttttcggacggtccgtaaacgtaagggtaaaggttcggggatacgttaaggggtacgggttaagtttcggg

SEQ ID NO: 406424 - DNA, 676 bp, Homo sapiens
  misc_feature: GZ8MTXP02GK3J7.10.12.B01.1.454.CMB.2.raw
  modified_base (268)..(268): a, c, t, g, unknown or other
  modified_base (307)..(307): a, c, t, g, unknown or other
  modified_base (331)..(331): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcgtgggttttcctcgttgctcttttaagaggtgtccagtgtcaggtgcaggttggaggaatcgtgggggaggcgtggtccagccgagggaggtccctgagactctcctgtgcagcctnggattgaggttcaataactatgctatgcacgtgggtccncaggctcgaggggagggctagganggatgactagttattcacacgatcgacaaccaaaacataacgtaccggacgggtagtttccgggagggacgggggcctacgtcgactacgtccgtctacccgagaacgaactaaagttaccggaaaataaccctacttaccgttacgtaacccgttaggaacctaaaagtacgaaaccgtaaggttaccgtaggaacgggaacgggacccggaaacgggaacccgacccggggttccccggttaaactttaaccggtttttcggaaccggtcggttaaaccggtaaagggtaaacggggtggggtaacggtacggtttaaagggtaacgggggtttatttacggg

SEQ ID NO: 406425 - DNA, 662 bp, Homo sapiens
  misc_feature: GZ8MTXP02HR8MH.10.12.B01.1.454.CMB.2.raw
  modified_base (299)..(299): a, c, t, g, unknown or other
  modified_base (381)..(381): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtgcagcctctggatgaggttcaaatactatgctatgcacgtggggtccnccgaggcctccggaagggggaaggggtctagggaatgggatgaactagttatttcccacgtacgatcgacaaaacccaaaanctaacgtacggcggtagtttcgacgggacgggggcccgcgtgacagttcccggtctcccaagacgaactaaagttccggaaacgtaactaaccttcgtagttaccctagacctaaaagttacgaaacgaggttactaggaacggacggaccccgggaaggaacccgtaccgggccccggtttacttaccgtttttggacgccggtaacgttaacggaaggggttcggggaagtaccgttaagggttacggggttacgtttacggtacgttttccccggggg

SEQ ID NO: 406426 - DNA, 663 bp, Homo sapiens
  misc_feature: GZ8MTXP02FJRBO.10.12.B01.1.454.CMB.2.raw
tcagcatagtagtgcacgaccggtgctcgatttagtagtgtagattccgcggggctgggagacgagcccagcactggaagtcgccggtgtttccattcggtgatcatcactgaacacagaggactcaccatggagttgggctgagctgggttttcctcgttgcttcttttaagaggtgtccagtgtcaggtgcagttggaggaatcgtgggggagcgtggtccagccgagggaggtccctgagactctcctgtgcagcctctggattgaggttacaaataactatgctatgcacgtcgggtccgccgaggcctaccggaaggggacggggctagggaaagtggaatgactagtttattccaacacgatcgaaccaaaaccgaaaactctaacgtacggcgggtaacgttccggtagggaccgggggccgtcgtcgaccgtacgtccgtacctacccgaagaacgtaactaaacgttaacggaaaacgtaacctaaccgttacctacgttaacctagaacctaaaagtacgaaacgtagtacgtagacggacgaccggagaccgaacgggtcccgttacgtttacgtttcgtacggtaccgtaacgaaggtaaggtaagggtacgtacgttaggtaggggttactttaggtacgtttaccgggg

SEQ ID NO: 406427 - DNA, 564 bp, Homo sapiens
  misc_feature: GZ8MTXP02IFNL9.10.12.B01.1.454.CMB.2.raw
  modified_base (253)..(253): a, c, t, g, unknown or other
  modified_base (261)..(261): a, c, t, g, unknown or other
  modified_base (281)..(281): a, c, t, g, unknown or other
  modified_base (299)..(299): a, c, t, g, unknown or other
  modified_base (366)..(366): a, c, t, g, unknown or other
  modified_base (387)..(387): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgcttcttttaagaggtgtccagtgtcaggtgcaggttgggaggaatcgtgggggagcgtggtccagccagggagtccctgagctctcctgngcagcctntggattgagttcaatactangctatgcacgtgggtccnccaggcctccggagggaagggctagggaatggatgactagttacttccacacgatgacaaaaccaangtactacgcgggtattccggnggaggggcccacgtgcacgtcgtactccagactacaatacgaacgaacactctacgtacctagacaaatcgaacagtcagagacgacgtaggaccgtacggccgttacttacgtttgacgtacgaacgttaggaaggtgggacgtacgtaggtagggttactttaggacgtttccgg

SEQ ID NO: 406428 - DNA, 555 bp, Homo sapiens
  misc_feature: GZ8MTXP02FWFS4.10.12.B01.1.454.CMB.2.raw
  modified_base (303)..(303): a, c, t, g, unknown or other
  modified_base (363)..(363): a, c, t, g, unknown or other
  modified_base (380)..(380): a, c, t, g, unknown or other
  modified_base (389)..(389): a, c, t, g, unknown or other
  modified_base (451)..(451): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtgcagcctctggattgaggttcaataactatgctatgcacgtgggtccncaggctccgaggggagggctggaatggatgactagttattcacacgatcgacaaccaaantactacgcgtagttcgngaggggccnctgcatcgtctccagagacaatcgaaagaacactctacgtacctagacaaatgaacagtcgngaagacgccggaacggaccgacgggtcccgttacgttaacgttttcggacgtcgtaacgtaaggaaacggtggggacgtacgtaaggtacggggtattttacgg

SEQ ID NO: 406429 - DNA, 653 bp, Homo sapiens
  misc_feature: GZ8MTXP02GW7RQ.10.12.B01.1.454.CMB.2.raw
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtacagcagaagccaggccacggccctgtgacttgtatataagacactgagacggccccgagggactcccgtgacgcgattcctcgtggccctccgagcctacgacgggaaccaaacgaggtcggtacggttacgaacccgagtacgacgggaccggggacgccccgggggagaacgggaacgggacggacgggcgtacggtacttaaacgttaccgtagttacaaataccaaacgtaaaggtaacttaacttacgttacggttaacgtttaaggttcgggggttaggtttacggggacgggttacggggtaccgaaggtccgtacggtaccgttaccgtaggtaccacgacccgaagtccgtaaccgtccccgtcgtacctacctccgttcccgtccccgtcccc

SEQ ID NO: 406430 - DNA, 558 bp, Homo sapiens
  misc_feature: GZ8MTXP02JZDP2.10.12.B01.1.454.CMB.2.raw
  modified_base (308)..(308): a, c, t, g, unknown or other
  modified_base (384)..(384): a, c, t, g, unknown or other
  modified_base (395)..(395): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcgtggtccaggccaggggaggtccctgagactctcctgtgcagcctctggattgaggttcaaataactatgctatgcacgtgggtccncaggctcgaggggagggctggaatggatgactagttattcacacgatgacaaccaaaacatactacgcgtagtcgnggacggggccntcgcatcgtctccaagacgaacaagttacgaaagaacactctagtacagacaaagtgaactagtctaggacgacgaccgaacggaccgacgggccgttacttacgtttcggacgtacggacgtaagaaacgggttgggatacgtaggttacggggatttacgg

SEQ ID NO: 406431 - DNA, 633 bp, Homo sapiens
  misc_feature: GZ8MTXP02HH6SL.10.12.B01.1.454.CMB.2.raw
  modified_base (408)..(408): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcgtggtccagccagggaggtccctgagactctcctgtgcagcctctggattggaggttcaataactatgctatgcacgtgggtccgccaggcctccgaggggaaggggctaggaatggatgactagtttattcacacgatcgacaaccaaaacataacgtacgcggtagttcgtagggacggggcccnctggctacgtccgtactcccgaagacgaactaagttcgaaaagacctaacgtcgttagtaaccctgaacctaaaagtcgaaactagttacgtagaacggacgacccggaaagggacccaaccggggtccccgtttagtttaaccgtttttcggacggaccggtaaccgtaaaggtaagggttggggaacgtacggttaaaggttacgggggttacttttacgggg

SEQ ID NO: 406432 - DNA, 681 bp, Homo sapiens
  misc_feature: GZ8MTXP02H8BW3.10.12.B01.1.454.CMB.2.raw
  modified_base (283)..(283): a, c, t, g, unknown or other
  modified_base (401)..(401): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggagaatcgtgggggagcgtggtccagccgagggaggtccctgagactctcctgtgcagcctctggattgaggttcaaataactangctatgctacgtcgggtccgccaggcctccggaggggaaggggctagggaatggatgaactgttattcccacgacgatacgacaaaaccaaacataccgtacggacggtagttccggngggacggcccgcgtgactacgtccgttaccacccgaggacgaactaaacgttacggaaacgtaaacctaccttccgttacgttaacccgttagaaccgtaaaagtacgtaaactacgggttaccgtaaggaacggtaacgggacccggaaacggggaacccgtaccggggtcccgtttaccgtttaaccgttttggacggtaacccggtaacgtaagggtaacggggtcgggacgtacgttaaggggttacgggtttagtttcggtaacgttcccggggg

SEQ ID NO: 406433 - DNA, 642 bp, Homo sapiens
  misc_feature: GZ8MTXP02HT2PT.10.12.B01.1.454.CMB.2.raw
  modified_base (375)..(375): a, c, t, g, unknown or other
  modified_base (396)..(396): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggaggtccctgagactctcctgtgcagcctctggattgaggttcaaataactatgctatgcacgtcggggtcccgcaggcctaccgaggggaacggggctgggaatgggatgactagtttattcccacacgatgacaaacccaaanctacgtaacgcggtagttcgnggacggggcccgctgcacgtcgtcctccgaagacgactaagttacgaaagtaacacttcgtagtaccctgacctaaaagtcgaaacgtagtaccgtaggagacgacccggaagggaacccgaccgggtcccggtttacctttaaccgtttttggtaccggacccggtaacgttaagggtaaagggttcggggaacgtaccgttaaacgggttacgggggttattttacgggtaacgtttcccgggg

SEQ ID NO: 406434 - DNA, 670 bp, Homo sapiens
  misc_feature: GZ8MTXP02F2YNH.10.12.B01.1.454.CMB.2.raw
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcgtggtccagccaggggaggtccctgagctctcctgtgcagcctctggattgaggttcaataactatgctatgcacgtgggtcccgccgaggctccggaaggggaacggggctggaaatggatggactagtttattcacacgatcgaccaacccaaaactataccgtacggcggtaagtttccggtagggaacgggggtcccgtcgtcggactaagttcccgtacctacccgaaaggaacgtaaactaaaacgtttaccggaaaacgtaaaccaacctttacctacggttaacccctaggaacctaaaattacggaaaacaggtacgtaggaacggacggacccggaaggacccgaccgggtacccgttacttaaccgtttttgacggaccgtaaacgttaaggaaacgggttaggggacgtacgtaaggttaagggggtattttacggg

SEQ ID NO: 406435 - DNA, 623 bp, Homo sapiens
  misc_feature: GZ8MTXP02ID2QN.10.12.B01.1.454.CMB.2.raw
  modified_base (309)..(309): a, c, t, g, unknown or other
  modified_base (358)..(358): a, c, t, g, unknown or other
  modified_base (405)..(405): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcagttggaggaatcgtgggggagcgtggtccagccgagggacgtccctgacgactctcctgtcgcagcctctggattgagttcaataactatgctatgcacgtgggtcccnccgaggcctccgaggggagggctaggatggatgactgttattcacacgntacgacaaccgaaacataccgtacgcggtagtacgtggacggggccntgacagtccgtctaccgaagtagaactaagtcgaaacgaacgtacctacgttcgtaaccctaggaaccctaaaagttacgaaacgtacggttaaccgttaggaaacggacggaccccggaacgggtaacccgacggggtccctttacgttaaccgttttggcgttacgaacgtaaggtacggtagggtacgtacgttaaggtacgggttagtttacgg

SEQ ID NO: 406436 - DNA, 593 bp, Homo sapiens
  misc_feature: GZ8MTXP02IA0OV.10.12.B01.1.454.CMB.2.raw
  modified_base (336)..(336): a, c, t, g, unknown or other
  modified_base (361)..(361): a, c, t, g, unknown or other
  modified_base (390)..(390): a, c, t, g, unknown or other
  modified_base (415)..(415): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtaggaacttgtatataaggacactgaagacggcccccagggactccccgtgagcgattcnctggcctccagctcgagggacaacngtgacgttgaccatcagcggacgcccggnagaggacgaggctgacctattacgngtacaaattcgaacaaagactaatttacgtaggttaacctttagttggggttcgttacggggcggaagggtcccgaaaggtcctggacccgttcccgttaagggccacgccccgaaaggcccttcggcccccccgttacgggtcctaaccgttccgtttccggtttcccccgtccccc

SEQ ID NO: 406437 - DNA, 680 bp, Homo sapiens
  misc_feature: GZ8MTXP02I38BR.10.12.B01.1.454.CMB.2.raw
  modified_base (164)..(164): a, c, t, g, unknown or other
  modified_base (198)..(198): a, c, t, g, unknown or other
  modified_base (293)..(293): a, c, t, g, unknown or other
  modified_base (312)..(312): a, c, t, g, unknown or other
tcagcatagtagtgcacgaccggtgctcgatttagtagtgtagattccgcgggggagctctgggagacgagcccagcactggaagtcgccggtgtttccattcggtgatcatcactgaacacagaggactcaccatgggagttggggctgagctgggttttccncgttgctcttttaagaggtgtccagtgtcaggtncaggttggaggaatcgtgggggagcgtggtccagccaggggacgtccctgacgactctcctgtgcagcctgtggattggagttacaaataactangctaatgcagtcgggtccncgaggctaccggaaggggaacgggtctagggaagtggataggactagtttactacacgacgtatacgaaccaaaccgaaacactaaccgtacggaccgggtaagttcgggtagggacgggggtccgtcgtcgacgtaacgtcgtactaccgaaggtacgtaaactaaacgttacggaaaacgtaaacctaccgttacgttacggtaacccctaggaaacctaaaacgtacgtaaaccgacgtttaaccgtaggaacgtaacgggaccggtaaacggaccgtaaccgggtccgttacgttaacgttttcggacgtaccgtaacgtaagggtaacgtagggacgtagttacggtacgggttactttacgg

SEQ ID NO: 406438 - DNA, 618 bp, Homo sapiens
  misc_feature: GZ8MTXP02I6O3C.10.12.B01.1.454.CMB.2.raw
  modified_base (174)..(174): a, c, t, g, unknown or other
  modified_base (260)..(260): a, c, t, g, unknown or other
  modified_base (281)..(281): a, c, t, g, unknown or other
  modified_base (300)..(300): a, c, t, g, unknown or other
  modified_base (364)..(364): a, c, t, g, unknown or other
  modified_base (385)..(385): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagnggtgtccagtgtcaggtgcagttggaggaatcgtgggggagcgtggtccagccagggagtccctgagactctcctgtgcagccctntggattgaggttcaataactntgctatgcacgtgggtccnccaggctccgaggggagggctgggaatggatgacagtttattccacacgatgacaaaaccaaantaccgacggcggtagttcggnggacggggcccgcgtgcacgtcgtctcccgagacgaactaatacgaaacgaacactcgtagtacccgtgacaaaagtacgaaactagtactaggaacgacggaccggaagggaaccgtaaccggggtcccgttaacgtttaccgtttttggaccgtacgtaaacgttaggaacgggttggggaacgtacgttaacggttaagggggtactttacgggtacgttttacccgggg

SEQ ID NO: 406439 - DNA, 781 bp, Homo sapiens
  misc_feature: GZ8MTXP02F4020.10.12.B01.1.454.CMB.2.raw
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcaggttggaggaatcgtgggggagcgtggtccagccgagggacggtccctggagacctctcctgtgcagcctcgtggattggagttcaaataactatgactatgcacgtcgggtcccgccgaggcctcccggaaggggaacggggtctagggaaatgggatgactagtttacttacccacgacgtatacgaaccaaaaccaaaacgtataaccgtaacgggtaccgggtaaagtttccggtaggggaccgggggtccctacgtcggaccctacgttcccggttacctacccgaaaggacggtaaaaccttaaaacggttaacccggaaaaacgtaaacccttacccgttaaccgttaacggttaaccccgttagaaaacccttaaaaagtacgaaaaaccgtaggttcgaagggaaacggtaccgggaacccgggaaacggggaaaccccgtaccgggggtttaccctttaccgttttaaccggttttacggacgggtaaccgtaaacgttaacggggtaaaggggtcggggtaactacggttaaaggggttagggggtttactttacgggtaccgtttacccgggg

SEQ ID NO: 406440 - DNA, 653 bp, Homo sapiens
  misc_feature: GZ8MTXP02GGQ8T.10.12.B01.1.454.CMB.2.raw
  modified_base (265)..(265): a, c, t, g, unknown or other
  modified_base (307)..(307): a, c, t, g, unknown or other
  modified_base (370)..(370): a, c, t, g, unknown or other
  modified_base (444)..(444): a, c, t, g, unknown or other
  modified_base (474)..(474): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcaggttggaggaatcgtgggggagcgtggtccagccgagggaggtccctgagactctcctgtgcagccctntggattggagttacaaataactatgactatgcacgtgggccncgaggctaccggagggagggcagggaatggatgactagttatcacacgatcgacaaacaaacntacgacgcggtagtcggtaggacggggcctacgtgaccctacgtctaccgtagaacgaactaattaacggaaanaaaccgtactacttacgtaccgtacgtaanaaacgttaaacgaacaaccgttgtacgaacggacggaccggaaaccgggacgaacccggtaccggtttaccgtttaaccgtttaggttcggaacccggtaggttaaaacgaagggttagggaaccggtaagttaacggtaagggggtacttttacggacgttttacccgggaccggggg

SEQ ID NO: 406441 - DNA, 528 bp, Homo sapiens
  misc_feature: GZ8MTXP02JS1PR.10.12.B01.1.454.CMB.2.raw
  modified_base (300)..(300): a, c, t, g, unknown or other
  modified_base (365)..(365): a, c, t, g, unknown or other
  modified_base (451)..(451): a, c, t, g, unknown or other
  modified_base (503)..(503): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggaggtccctgagactctcctgtgcagcctctggattgaggttcaataactatgctatgcacgtgggtccnccaggctccgaggggaaggggctagggaatggatgacagttattccacacgatgacaaaccaaantactacgcgtagttcgtggaggggccgctgcatcgtctccgagacgacaatcgaaagaactactctagtacctgacaaatgaaacngtactgacgagcgagacacggcgtctactttgacgtcgacgtagaggtggancgtagtagggtatttgacttccggg

SEQ ID NO: 406442 - DNA, 615 bp, Homo sapiens
  misc_feature: GZ8MTXP02GYOEY.10.12.B01.1.454.CMB.2.raw
  modified_base (375)..(375): a, c, t, g, unknown or other
  modified_base (405)..(405): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggagaatcgtgggggagcgtggtccagccgagggagtccctgagactctcctgtgcagcctctggattgagttcaaataactatgctatgcacgtcgggtccgccgaggcctccgaaggggaacggggctagggaatgggatgactagttattccacacgatacgacaaaccaaaacntactacggcggtagttcgtaggacgggccnctgctagtcgtcctaccgaagacgaactaacgttacgaaagaaactaccttcgtacgtaaccctagaacctaaaagtgaaacctaggtactaggaacgacgaccgaaggaccgaaccgggtccttacttacgttttggacgtaccgaaacttaagggaaaggtaagggagtaacgttaaggaggggttactttcggaacgtttcccgggg

SEQ ID NO: 406443 - DNA, 618 bp, Homo sapiens
  misc_feature: GZ8MTXP02HDESC.10.12.B01.1.454.CMB.2.raw
  modified_base (219)..(219): a, c, t, g, unknown or other
  modified_base (373)..(373): a, c, t, g, unknown or other
  modified_base (446)..(446): a, c, t, g, unknown or other
  modified_base (561)..(561): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctgganatgctttgccgaagctaatatgcttacgtggtaccagcaagaacgccaggccacggcccctgtaggaacttgtaatataagacactgagacggccccgagggactcccgtgacgcgtacttctcgtggccctccgagctacgaagggacaacgngtagacgtacaacctatacgaagccgggaacgcccgggacgaaggagggacgagggctacgaacgtactactntacaaatcaacaaagactattacgttagtattagttggggtcgttacgggcggtaacgggtacgaagtcgtacggtaccgttacgtacggtaccgacgtaccccgaaaggtcccncccggtcccccgttaccgggtcctaccggttccctcccggtttaccccctaaccccc

SEQ ID NO: 406444 - DNA, 613 bp, Homo sapiens
  misc_feature: GZ8MTXP02GQDY2.10.12.B01.1.454.CMB.2.raw
  modified_base (350)..(350): a, c, t, g, unknown or other
  modified_base (369)..(369): a, c, t, g, unknown or other
  modified_base (400)..(400): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcgtggtccaggccagggaggtcccctgagactctcctgtgcagccctctggattgaggttcaataactatgctatgcactgggtccgccgaggctccgagggaaggggctgggaatggatgactagtattccanacgatcgacaaccaaaacntaactacgcggagttcggtgagggggcccgngtgccatccggtctcccagacgtaacaaattaccgaacgaaacacgttacctacgtacccgttagacgaaaactggaaacaggtacctaggaagacggtaccgacgggaacaaccggggtcccgttacggtaaccttttcggtaggtacgtaccgttaaggaacggtaagggtagtaccggtaagtacggggtagtttacggaagtttccggg

SEQ ID NO: 406445 - DNA, 646 bp, Homo sapiens
  misc_feature: GZ8MTXP02I2UIZ.10.12.B01.1.454.CMB.2.raw
  modified_base (305)..(305): a, c, t, g, unknown or other
  modified_base (388)..(388): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgctcttttaagaggtgtccagtgtcaggtgcaggttggaggaatcgtgggggaggcgtggtccaggccgagggagtccctgagactctcctgtgcagcctgtggattggagttcaataactatgctatgccacgtcgggccnccgaggccgtaccggaggggaacggggctagggaatgggatgactagtttacttaccacacgatacgacaaaacccaaaactntaactacggcgggtagttcggtagggacggggcccgctgcctacgtcggtacctacgagacgtaactaacgttacgaaacgtaaccacttacgtacgttaaccctgaaacctaagtacgaaactgtaccgtaggaacggacggacccgggaaggaccgtaccgggtcctttacggttacgttttggacgtacgtaaacgtagtaaacgggtggtacgtacgttaaggtaggggttactttacggtacgtttaccgggg

SEQ ID NO: 406446 - DNA, 595 bp, Homo sapiens
  misc_feature: GZ8MTXP02I4OSP.10.12.B01.1.454.CMB.2.raw
  modified_base (374)..(374): a, c, t, g, unknown or other
  modified_base (395)..(395): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggaggtccctgagctctcctgtgcagcctcgtggattgaggttcaataactatgctatgcacgtcgggtccgccaggctccgaaggggacggggctggaatgggatggactagtttattcacacgtatcgacaaccaaaanctaacgtacgcggtagttcgnggacgggggcctcgtgctagtcgtctaccaagacgtaacaaagttcgaaagtactactctagtaccctgaaccaaatgaactagttacgagaaagcggtaccggaacggaccgtaccgggtccgttacttaccgttttgacgtaccgtaacgtaaggtaacgggtacgggtaggtcgttaggtacgggggttactttagg

SEQ ID NO: 406447 - DNA, 662 bp, Homo sapiens
  misc_feature: GZ8MTXP02ILF7H.10.12.B01.1.454.CMB.2.raw
  modified_base (249)..(249): a, c, t, g, unknown or other
  modified_base (257)..(257): a, c, t, g, unknown or other
  modified_base (294)..(294): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcagttggaggaatcgtgggggagcgtggccagccagggagtcctgagctctctgngcagcctnggattgagttacaataactatgctatgcacgtggccncaggcctcgagggagggctagggatggatgactagtttactccacgacgtatacgaacctaaaaccaaaactacgttaccgtaacgggacggggttaaacggtttccgggaggggaccgggggtcccgtcgtcggacctattccggtctacccgaaagacgtaactaaagttaccggaaacaactaaccttaccgttacgtaacccttaggaacctaaaagtacgaaaccgtaggttaccgtaggaacggaccggaccggaacggaacccgtacgggtacccgttaccgtttaacgttttcggacgtacgtaacgttaggaaggtgggacgtacgtaggttaagggtagtttacggacgtttaccggg

SEQ ID NO: 406448 - DNA, 664 bp, Homo sapiens
  misc_feature: GZ8MTXP02FUO4S.10.12.B01.1.454.CMB.2.raw
  modified_base (259)..(259): a, c, t, g, unknown or other
  modified_base (285)..(285): a, c, t, g, unknown or other
  modified_base (298)..(298): a, c, t, g, unknown or other
  modified_base (379)..(379): a, c, t, g, unknown or other
  modified_base (414)..(414): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtgcagcctntggattgagttcaataactatgctangcacgtgggtccnccgaggctaccgaaggggtaacggggctagggaaatgggatgaactagtttatccaacacgatcgaaccaaaaccaaaacnctactaacggcggtagttccgtaggagggggcccngtagcgtaacgtccgtcgtacccaaggacgtaaacgtaaacgttaccggaaaacgaacctaaccgttaccgtacggtaacccctagaacccttaaaagtaccgaaaccgtagttaccgtaggaaacggaacggaccggaaacggaccgtaccggggtaccccgtttattaccgttttgaacggaccgtaacgtaggtaaaggtgggggaactacggtacggtagggggtaatttcggacgtttaccgggg

SEQ ID NO: 406449 - DNA, 713 bp, Homo sapiens
  misc_feature: GZ8MTXP02JNOOM.10.12.B01.1.454.CMB.2.raw
  modified_base (310)..(310): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcagttggaggaatcgtgggggagcgtggtccagccgagggacgtccctgagactctcctgtgcagtcctcgtggtattggaggttcaaatactatgactatgcagtcggccncaggctacggaggggagggctaggaatggatgatacgtttacttacacaacgatacgaaccaaaccgtaaaactactaaacgtaaccggcgggtaacgtttacgggcggggtaaccgggggccctacgtgaccgtacgttccgtacctacccgaaaggacgtaaacccgtaaaagtttaccgggaaaacaaacccgtacttaccgtacgttaacccgtacgaaacctaaaagtaacgaaaccgtagtcgtaggaacggacgacccgggaaggtaaacccgtaccgggtaccgttaaccgtttacgtttttacgggacggtacccggtaaacggttaacggggtaaggggtttaacggggacggttacggttaaacgggtttacgggggttaattttaccgggg

SEQ ID NO: 406450 - DNA, 626 bp, Homo sapiens
  misc_feature: GZ8MTXP02HTFZD.10.12.B01.1.454.CMB.2.raw
  modified_base (179)..(179): a, c, t, g, unknown or other
  modified_base (268)..(268): a, c, t, g, unknown or other
  modified_base (285)..(285): a, c, t, g, unknown or other
  modified_base (287)..(287): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgcttcttttaagnggtgtccagtgtcaggtgcagttggaggaatcgtgggggtagcgtggccagccgaggggagtccctgagactctcctgtcgcagcctgngattgagtacaatactngntatgctacggtcgggtcccgcgacggtcgaccggaaggggagggtctaggagtggatgactagtttacttcgaacacgtataccgaacaaccctaaaactagtaacccgtacgggtacggtaacggtttcgggacggggtacggggccgtcgtgactcgtccgtactaccgagacaactaacgtacgaaagacctacgttactacgtacctagaacctaaagtacgaactagtcgtacgaggacggcggaacgaccggtaccggtccttacggtttagtttcggaccgtaaggagtaagggtaagggtaggactaggtaaggttacgggttatttacgg

SEQ ID NO: 406451 - DNA, 705 bp, Homo sapiens
  misc_feature: GZ8MTXP02GV5TO.10.12.B01.1.454.CMB.2.raw
  modified_base (317)..(317): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcagttggaggaatcgtgggggagcgtggtccagccgaggggcgtccctgacgtactctcctgtgcagccctgtggtattggagttaccaaataactatgctatgctacgtcgggtcccncgaggcctaccggaaggggaacggggtctagggaaagtggaataggtactagttttacttaccaacgacgtatacgaaacccaaaccgaaaaactacgttaaccgtaccgggacggggttaacggtttccgggtagggggaaccgggggcccgtccggttacgaccgttaacgtcccggtaccctacccggaaggaaccggtaaacctaaacgttaccgaaaacgtacctaaccttcgttacgtaccccgtagaaacctaaagtacgaaactggttaccgaggaaacggacgaccgggaacggaccgtaccggttcccgttattacggtttcgacgtaccgtaagtaaggaggtcgggtactacggtaggttaggggttactttacgg

SEQ ID NO: 406452 - DNA, 589 bp, Homo sapiens
  misc_feature: GZ8MTXP02HYCJQ.10.12.B01.1.454.CMB.2.raw
  modified_base (262)..(262): a, c, t, g, unknown or other
  modified_base (366)..(366): a, c, t, g, unknown or other
  modified_base (386)..(386): a, c, t, g, unknown or other
  modified_base (394)..(394): a, c, t, g, unknown or other
  modified_base (408)..(408): a, c, t, g, unknown or other
  modified_base (439)..(439): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcaggttggaggaatcgtgggggagcgtggtccagccgagggagtccctgagactctctgtgcagcctntggattgaggttcaaataactatgctatgcactggactccgcaggcctacgaggggaagggctaggaatggatagactagttacttcacagatgaccaaacaanctaactacggcgtagttcgngacgggcntgcatctctcaganacaatcgaagaactctctacgtactacgaanaaacgtagaacagtacgtaggaacggaacggaccggaacggtaaccgaccgggttaccgtttacgttacggtttttacgcggtaacgtaacgtaaaggaacgggtagggtaacgtacggttaaaggttacgggggttattttacggacgg

SEQ ID NO: 406453 - DNA, 583 bp, Homo sapiens
  misc_feature: GZ8MTXP02JFS4E.10.12.B01.1.454.CMB.2.raw
  modified_base (398)..(398): a, c, t, g, unknown or other
  modified_base (409)..(409): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcttgggttttcctcgttgctcttttaagaggtgtccagtgtcaggtgcagttggaggaatcgtgggggagcgtggtccagccgagggacgtccctgagctctcctgtgcagcctgtggattggagttcaaataactatgctatgcacgtcgggtcccgcgaggcctaccggaggggaagggctagggaatggatgactagtttacttcacagatcgacaaccaaatataaccgacgcggtagtttcgnggacggggccntgcagtcgtctcgagacgactaagtacgaaagactacgtcgtacgtacctagaacaaagtcgaactgtacaggaacgacgaccggacggtacgaccggtaccgttacgttaccgtttggacgtacgtacgtaaggtaacggtgggacgtcgtaagggttacggggtatttacgg

SEQ ID NO: 406454 - DNA, 572 bp, Homo sapiens
  misc_feature: GZ8MTXP02JERTW.10.12.B01.1.454.CMB.2.raw
  modified_base (254)..(254): a, c, t, g, unknown or other
  modified_base (302)..(302): a, c, t, g, unknown or other
  modified_base (375)..(375): a, c, t, g, unknown or other
  modified_base (396)..(396): a, c, t, g, unknown or other
  modified_base (407)..(407): a, c, t, g, unknown or other
  modified_base (438)..(438): a, c, t, g, unknown or other
  modified_base (454)..(454): a, c, t, g, unknown or other
  modified_base (462)..(462): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggtgctgagcttgggttttcctcgttgctcttttaagaggtgtccagtgtcaggtgcagttggaggaatcgtgggggagcgtggccagccgagggagtccctgagctctcctgtgcngcctgtggattgaggttcaatactatgctatgccacgtcggggtcccncaggctaccggaggggacggggctagggaatggatgactagtttaccttcacgacgtatacgacaaacccaanagtactacggcgtagttcggnggacggggccnctgcagttcgactcgagacacgaatcgaaanacctatctacgtaccngaacaaangaaacagttcgagacggacgacggtaacggacgtaccggtaccgttactttacgtttcggcgacgtacgtaaggaacggtgggactacgtaggtagggtatttcggtacg

SEQ ID NO: 406455 - DNA, 634 bp, Homo sapiens
  misc_feature: GZ8MTXP02GDVTK.10.12.B01.1.454.CMB.2.raw
  modified_base (261)..(261): a, c, t, g, unknown or other
  modified_base (382)..(382): a, c, t, g, unknown or other
  modified_base (398)..(398): a, c, t, g, unknown or other
  modified_base (409)..(409): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcgtggtccagccagggaggtccctgagactctcctgtgcagcctntggattggagttcaaataactatgctatgcacgtcgggtccgccgaggcctccggaaggggaacggggctagggaatgggatgactagtttattacccactacgatcgacaaaaccaaacntacacgcggagttcgnggacggggccntgctatccgtctaccgagacgaacgtaatacgaaacgtaacactcgtacgttacctagactaaagtacgaaacctagtacctaggaacgacgaccgggaaaggtaccgaaccgggttcccgttacgtttaccgtttttaggacgtaccgtaaacgtaggtaacgggttaaggggaacgtcggttaaaggggttagggttagtttacggttaacgtttcccggggg

SEQ ID NO: 406456 - DNA, 691 bp, Homo sapiens
  misc_feature: GZ8MTXP02GNW2J.10.12.B01.1.454.CMB.2.raw
  modified_base (261)..(261): a, c, t, g, unknown or other
  modified_base (282)..(282): a, c, t, g, unknown or other
  modified_base (300)..(300): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcgtggtccagccgagggagtccctgagactctcctgtgcagcctntggattgagttcaataactangctatgcacgtgggtccncgaggcctaccgaggggaaggggctagggaatggactaggactagtttactttacccacgtacgatacgaaccaaaacccgaaaaactcgtaaccgtaaacggggcggtacggtttccgggacgggaacgggggtccccgtacgttcgacccgtaacgttcccggtcctaacccgaggaacggaacctaaacgtttaccggaaaagtaaccaaccgttcgtaaccgttaaccctagaacctaaaagtacgaaaccgtagtaccgtagggaaacgacggacccggaagggaacccggtacgggtacccgtttacgtttacgttttcggacggtacgaacgtaaggaggtgggtaacacgttaacggtagggtatttacggactttaccgggg

SEQ ID NO: 406457 - DNA, 585 bp, Homo sapiens
  misc_feature: GZ8MTXP02I1SIO.10.12.B01.1.454.CMB.2.raw
  modified_base (267)..(267): a, c, t, g, unknown or other
  modified_base (308)..(308): a, c, t, g, unknown or other
  modified_base (374)..(374): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcaggttggaggaatcgtgggggagcgtggtccagccgagggacgtccctgagctctcctgtgcagcctntggattggagttcaaattaactatgctatgcacgtgggccnccaggctccgaggggaggggctaggaatggatgtactagtttacttcacagatcgacaaccaaacnctaccgtacgcggtaagtttcggaggacggggccacgtgcagttcgtctccaagacgaacaattacgaaagactactctactacctagaacaaagtcgaactgtacgtggaacgacggccggaacggaccaccgggtaccgtttacttacgttttggacgtacgtacgtaaggaaggttagggacgtacgttaaggtagggttactttagg

SEQ ID NO: 406458 - DNA, 661 bp, Homo sapiens
  misc_feature: GZ8MTXP02GWDE1.10.12.B01.1.454.CMB.2.raw
  modified_base (298)..(298): a, c, t, g, unknown or other
  modified_base (389)..(389): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcagttggaggaatcggtgggggaggcgtggtccagccgagggtacggtccctgacgtactctcctgtgcagccctgtggattggagttacaaatactatgctancgcacggtcggtcccgcgaggcctaccggaaggggaagggctaggaagtggaatgactagttactaccacagatacgacaaaacctaaacntaccgacggcggtacgttcggaggacggggcctcgtgctacgtccgtactacgagacgaacctaaacgtacgaaacgtaacctaccttacgttaacgtaccctagaacgtaaaacgttacgaaacgtaggttacgagggaaaacggcggaaccggacgggtaaccgtacccggttccgtttacgtttacgtttcggacgtacgtaagtaacgggtaggtaacgggacgttaggttaacggtaggttaacgtttcggaccgtttacccggggg

SEQ ID NO: 406459 - DNA, 784 bp, Homo sapiens
  misc_feature: GZ8MTXP02H8UF4.10.12.B01.1.454.CMB.2.raw
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcgtggtccagccaggggagtccctgagactctcctgtgcagccctgtggattggagttcaaataactatgctatgcctacgtcgggtcccgccaggcctaccggagggggaacggggtctaggggtaaagtgggaatgaactaggtttaattcccgaacaacggtatacggaaccaaaaccaaaatactaaacgtacggacggtacgtttcgagggaacggggcccgtacgtcggctaacgtccggtacctaccgaaggaaacgtaacgtaaaacgttaccggaaacgaaaacctaaccttccgtaacggttaaccccttaggaaaaccctaaaacgttagtaaaaccgaagggtttaccgtaagggaacgaacggggtacccggaaacggggaaaccccggttaacccgggtacccgggtttcccttttaaaccgtttttggggaacggtaaccccggttaaacggtttaaacgggaaaacggggttaagggggaaaaccgttacggtttaaaacgggttacggggggtttaaacttttacggggtaacgttttaacccccgggggg

SEQ ID NO: 406460 - DNA, 624 bp, Homo sapiens
  misc_feature: GZ8MTXP02H2GV8.10.12.B01.1.454.CMB.2.raw
  modified_base (178)..(178): a, c, t, g, unknown or other
  modified_base (196)..(196): a, c, t, g, unknown or other
  modified_base (303)..(303): a, c, t, g, unknown or other
  modified_base (352)..(352): a, c, t, g, unknown or other
  modified_base (372)..(372): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagnggtgtccagtgtcaggtncagttggagaatcgtgggggagcgtggtccagccaggggagtcctgagactctcctgtgcagcctctggattgagttcaataactatgctatgcacgtcgggtcccnccgaggcctaccggaggggaagggctaggaatggatgactagttatcanacgatcgaacaaccaaaacnttaccgacggacgtacgtcggtacgggacggggccgcgtcgacgtacgtccgtactacccgaagaacggaacctaaagtacgaaaacggaaactacctacgtacgttaaccgtacgaaccaaagttacgaaacgtaggtaccgttacggagacgaccggaacggaccggtaaccggtccgttacgttaccgttttgacgtaccgtaacgtaaggtaaggtaggtacgtacgtacggtagggtaacgtttcgg

SEQ ID NO: 406461 - DNA, 679 bp, Homo sapiens
  misc_feature: GZ8MTXP02JOA4C.10.12.B01.1.454.CMB.2.raw
  modified_base (270)..(270): a, c, t, g, unknown or other
  modified_base (311)..(311): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttgggctgagcttgggttttcctcgttgcttcttttaagaggtgtccagtgtcaggtgcagttggaggaatcgtgggggagcgtggtccagccgaggggcgtccctgagactctcctgtgcagcctctggnttaggaggttacaaataactatgctatgcacgtcgggtccncgacggctaccggaggggaacgggtctaggaatggatggactagtttattacgaactacgatacgaactaaccaaaacgtactaccgtaccgggaggtaacggtttaccgacggggaacgggggcccgtcgtacggacgtaacgttccggttactaccggaacgtaacggtaaactaaacgttaaccgggtaaaacgaaaccgtaaaccttaccgttacgtaaccgttacggaaactaaaagtacgggaaactacggttacgaggaagaaccggaccgggaacggacggtaccggtacccttacgtttacgttgtacggaccgttaacgaaggtaaggtcgggatacgtagttaggggtactttacgg

SEQ ID NO: 406462 - DNA, 662 bp, Homo sapiens
  misc_feature: GZ8MTXP02H65FW.10.12.B01.1.454.CMB.2.raw
  modified_base (313)..(313): a, c, t, g, unknown or other
  modified_base (389)..(389): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgagggacggtccctgagactctcctgtgcacgcctcgtggattggaggttacaaataactatgcttatcgccacgtcggggtcccnccgaggccctaccggaggggaaggggctagggaatggatgactagtttattccacacgatcgaccaaaaccaaacntaaaccgtacggcggtagttcgggaggacggggcccagtcgctacgtccgtacctaccgaaggacgaactaacgttacgaaacgaactaccttcgttacgtaacctacgaacctaaaagtcgaaacgtagtcgtaggaacggacggacccggaagggaacccgtaccggggtcccgtttacgtttacgttttcggacgtaccgtaacgtaagggaagggtcggggaagtacgttaagggttagggggtacttttacggtaacgtttcccgggg

SEQ ID NO: 406463 - DNA, 576 bp, Homo sapiens
  misc_feature: GZ8MTXP02IU38P.10.12.B01.1.454.CMB.2.raw
  modified_base (258)..(258): a, c, t, g, unknown or other
  modified_base (298)..(298): a, c, t, g, unknown or other
  modified_base (370)..(370): a, c, t, g, unknown or other
  modified_base (406)..(406): a, c, t, g, unknown or other
  modified_base (440)..(440): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagctctcctgtgcagcctntggattgaggttcaataactatgctatgcacgtgggtccnccaggcctccgaggggaagggctagggaatggatgacagtttacttcacacgatacgactaaaaccaaaacntaaccgtacggcggagttcgtagggacgggggtccncgtgcacgtcgtctacgagacaataatacgaaanacactcgtacgtaccagaactaagacgaactgtactagacgacgacgacgtacgtaccggtcgttactttacgtttcgacgacgtaacgtaggaaggtcggacgtacgtaaggtaggttactttcggtacgtcggg

SEQ ID NO: 406464 - DNA, 705 bp, Homo sapiens
  misc_feature: GZ8MTXP02GCTXH.10.12.B01.1.454.CMB.2.raw
  modified_base (308)..(308): a, c, t, g, unknown or other
  modified_base (398)..(398): a, c, t, g, unknown or other
  modified_base (450)..(450): a, c, t, g, unknown or other
  modified_base (692)..(692): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttgagaggtgtccagtgtcaggtgcagttggaggaatcgtgggggaggcgtggtccagccgagggacggtccctgagactctcctgtgcagcctgtggattggagttcaataactatgctatgacacgtggggtcccnccaggcctaccgaggggaacgggcgtagggaattgggaatgaacgtagtttaccgttcaacgacgtatacgaaaccaaaaccctaaaacncgttaaaccgtaacgggtaccggtaaggttcgggtacgggaacgggggtccncgttcggctacgttccggtaccctacccgaggtaaacgtaaactaagttaaaccggaaaacgtaaacctaacccttaccgttacggttaaccctaggaacctaaaatacggaaaaccgtagtacgtaaggacggacgggaccggaacggaacccgaccggttccgttaccgtttaacgttttcggtacggtaccgtaacgtaaaaggtaacggtacgggagtaacgttaggtaacggggttntttacggtaccgg

SEQ ID NO: 406465 - DNA, 566 bp, Homo sapiens
  misc_feature: GZ8MTXP02IN4BO.10.12.B01.1.454.CMB.2.raw
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccaggcccctgtgaacttgtaatataagacactgaagacggcccccgaggggactccccgtgacgcgattctcgtggccctccgagctacgagggaacaacagtcgacgttacgaccatacgaggcggacgcccgggcaggacggacgagctagactatactgtacaaatcaacaaagacatttactggttaacttagttgggtacggttcgggacggagggtacaagtcgtcgaccgtcgtaggtcacgacccgtaaggccgtccgcccccgtcggtccacgtccgtccgtcccctcccc

SEQ ID NO: 406466 - DNA, 645 bp, Homo sapiens
  misc_feature: GZ8MTXP02G9HY7.10.12.B01.1.454.CMB.2.raw
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgcttcttttaagaggtgtccagtgtcaggtgcagttggaggatcgtgggggagcgtggtccagccgagggacgtccctgagactctcctgtgcagcctctggattgaggttcaaataactatgctatgcacgtgggtccgccgaggcctccggaaggggaaggggctgggaaagtggatgactagtttacttaccgacacgtatacgaccaaaaccaaaactcgtaactaacggacggtagttccggtagggacggggcccgtgtcggctacgtccgtcaccgtaggacactaaagtacgaaaacgactaccttcttagtacccgttagaaccgtaaagtacgaaaccgtagttacctagggaacgaacggacccggaaaggacccgaccgggtacccgttactttaaccgttttggacgtaccgtaacgtaggaaggtgggaacgtcgtaaggttagggtactttcggacgtttacccgggg

SEQ ID NO: 406467 - DNA, 667 bp, Homo sapiens
  misc_feature: GZ8MTXP02J0F1A.10.12.B01.1.454.CMB.2.raw
  modified_base (254)..(254): a, c, t, g, unknown or other
  modified_base (262)..(262): a, c, t, g, unknown or other
  modified_base (303)..(303): a, c, t, g, unknown or other
  modified_base (353)..(353): a, c, t, g, unknown or other
  modified_base (373)..(373): a, c, t, g, unknown or other
  modified_base (411)..(411): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgcttcttttaagaggtgtccagtgtcaggtgcagttggaggaatcgtgggggaggcgtggtccagccgagggacgtccctgagactctctgngcagcctntggattgaggttcaatactatgctatgcacgtcgggtcccncaggctaccggaggggacggggctagggatggatgactagttattccganacgatacgacaaaaccaaanctaaccgacggacggtagttcgggaggacgggggcccncgtgccagttccgtctacccgagtaacgaacctaagttacgaaacgtaacctactcgttacgtaccctagaactaaaagtcgaaactacggtacgtggaaacggcggaacccggaagggaacccgtaccgggttacccgtttacgtttaacccggtttttggaccggtaccggtaaccgttaaaggggtaagggttggggaaccgttacggttaaaggggtttaggggtattttacggggaacgtttccccggggg

SEQ ID NO: 406468 - DNA, 749 bp, Homo sapiens
  misc_feature: GZ8MTXP02GPCTZ.10.12.B01.1.454.CMB.2.raw
  modified_base (220)..(220): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtcgtcccaggacagacggccaggatcacctgctcgtgganatgtctttagaccgaaagaaatatgtacttacgtggtaccagacgagaacgccgacggccgacggccccgtgtacggtaacttagtaataagtaacggaactacgtaggaacggaaccggacccccgagggtacctccccgtaggacgtacggtactttcgtcgtcggtcctaccccgagtccgtaacggaacgggaacctaaaacgtagggttaccgtaaaccgttacggaaaccctaacgtaccggaacggaccgggaccggggacccgggaacgaacgggaaacgggaccggaggtaccgtaacgtaaccgtttaaatttaccggtagttacgaaacgtaccaaaagtaaacgaacttaacgtttaacgttaggttaacgtttagtttggggttacggttcggggacgggtacggtaccgtaacgcgttaccgaccgttcgtaaggtaccgacggacccgtaacggccctacccggaaccccgtccgtaccgtaccgttcccgtccgttcccccgcccttaccccg

SEQ ID NO: 406469 - DNA, 666 bp, Homo sapiens
  misc_feature: GZ8MTXP02GV4N5.10.12.B01.1.454.CMB.2.raw
  modified_base (266)..(266): a, c, t, g, unknown or other
  modified_base (304)..(304): a, c, t, g, unknown or other
tcagcatagtagtgcacgaccggtgctcgatttagtagtgtagattccgcgggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggatcgtgggggagcgtggtccagccgagggacgtccctgacgactctcctgtgcagcctntggattgagttcaatactatgctatgcacgtgggtccncaggctaccgaggggagggctaggatggatgactagtttacttcaacacgatacgaacctaaccaaaactctaaccgtaacggccgggtaagtttccgggtaggggacgggggcccgacgttcggactacgttcccgtactacccgaaggaacggtaaactaaacgttaacgaaaacgaacctaacgttaccgttacgtaacccgtaggtaaaccaaaacgttcggaaaacctaggtaccgtaggaaaggacgggacccggaacgggacccgaccgggtaccgttaccgttaacgtttttcggacgacgtaaacgtaagggtaaaggtcggggatacggtaaggtacggggttatttacggg

SEQ ID NO: 406470 - DNA, 543 bp, Homo sapiens
  misc_feature: GZ8MTXP02JVF3W.10.12.B01.1.454.CMB.2.raw
  modified_base (464)..(464): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccagggagtccctgagactctcctgtgcagcctctggattgaggttcaatactatgctatgcacgtgggtccgccaggctccgaggggaggggctggaatggatgacagttattcacacgatcgacaaccaaaacatacctacgacggtacgttcgagggacggggccgcgtagccagtccgtactccgaagacgaacaattcgaaagaccactctgtacctgacaaatgaaacngtcagagagcgagacgacggccgtctacgtttgcgtacgtgtaacggaggttagggatacgtagtacgggtagtttacg

SEQ ID NO: 406471 - DNA, 619 bp, Homo sapiens
  misc_feature: GZ8MTXP02J0042.10.12.B01.1.454.CMB.2.raw
  modified_base (306)..(306): a, c, t, g, unknown or other
  modified_base (349)..(349): a, c, t, g, unknown or other
  modified_base (368)..(368): a, c, t, g, unknown or other
  modified_base (405)..(405): a, c, t, g, unknown or other
  modified_base (491)..(491): a, c, t, g, unknown or other
tcagcatagtagtgcacgaccggtgctcgatttagtagtgtagattccgcgggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccaggggacgtccctgagactctcctgtgcagcctctggattgagttcaataactatgctatgcacgtcgggtccncaggctccgaggggagggctaggatggatgactagttattcanacgtatagacaaccaaaanactacgtacgcggtagtttcggagggacgggggcccngtcgctatccgtctaccgaagaacgactaaacttcggaaaacgtacctactccgtacgtaacctaggaactaaaacgtgaaaaccnggttacaggaacgacggaccggaacggaccggaccgggtcccgtttactttacggttttcggacggtaccgtaaagtaaggaagggtacggggattaccggtaggttaacgggggtttactttacggg

SEQ ID NO: 406472 - DNA, 600 bp, Homo sapiens
  misc_feature: GZ8MTXP02FMEHM.10.12.B01.1.454.CMB.2.raw
  modified_base (246)..(246): a, c, t, g, unknown or other
  modified_base (255)..(255): a, c, t, g, unknown or other
  modified_base (289)..(289): a, c, t, g, unknown or other
  modified_base (306)..(306): a, c, t, g, unknown or other
  modified_base (372)..(372): a, c, t, g, unknown or other
tcagcatagtagtgcacgaccggtgctcgatttagtagtgtagattccgcgggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccaggccagggacggtcccngagactctnttgtgcagcctctggattgaggttcaaatactangctatgcagtgggtccncaggctccgaggggaagggctagggaatgggatgacagtttattcacacgatacgacaaccaaaantaacgacgcgggtagttcgtggaacggggcctacgtggacatccggtctaccgaagtacgaactaaattacgaaagaaacctactcgtagtaccctagacctaaaatcgaaactagtcgtaggagaacgccggaaacggacgaacccgggtcgtaccgttaacgttttcgacggcgtaacgtaagggtaaggtcggggacgtacgtaggtacgggggtactttacggg

SEQ ID NO: 406473 - DNA, 767 bp, Homo sapiens
  misc_feature: GZ8MTXP02IX0MZ.10.12.B01.1.454.CMB.2.raw
  modified_base (266)..(266): a, c, t, g, unknown or other
  modified_base (286)..(286): a, c, t, g, unknown or other
  modified_base (304)..(304): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagctggggttttcctcgttgcttcttttaagaggtgtccagtgtcaggtgcagttggaggaatcgtgggggagcgtggtccagccaggggcgtccctgagctctcctgtcgcagcctntggattgagttcaatactangctatgcacgtgggcccncaggctccggaggggaggggctaggaagtggatggactagtttacttccaacgtacgtatcggacctaaaccgaaaactactaaccgtacgggtccgggtaaggttttcgggacgggacgggggtcccgtcgttcgggacctacgttccgttaccgtaccccgaaaggtaccgtaaacctaaaacggtttaccggaaaaacgtaaaccccttaaccttaccgttaaccggttaaacccccgttaggaaaccctaaaaacgttaggaaaaccctagggttaaccgtagggaaacggaccgggtaacccggaaacggggaacccggtaaacccgggtttccccgttaccgttttaaccggtttttcggaaccggttacccggtaaacggttaaacggggtaaaggggttacggggtaaacggtacggtttaaaggggttaacgggggtttaactttttaacgggg

SEQ ID NO: 406474 - DNA, 732 bp, Homo sapiens
  misc_feature: GZ8MTXP02H8KE2.10.12.B01.1.454.CMB.2.raw
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtcgtcccaggacagacggccaggatcacctgctctggagatgctttgccgaagcaatatgtcttaacgtcggtaccagcagaacgcacggccacggccctgtacggaacttgtaataagtaagacaacgtggaacgaccggacccccgaggggactccccgtaggacgcgtacttcgtcgtcggtccctccagtcctacggaacggggaaaccaaacgtacggggttacgtaccggtttacggaaccctacggttacgaacggggacccggggaaacccggggcccgggggaacgaacggggaaacgggggaacggaacggggtaccgtacgggtaaactttaacgttaaccgttacgtactaaaactacccaaaagtaaaacggaacttaacgttaccgtttagggtttaaccgttttaaggttagggggtttcggttacggggtcggggtacggggtaccgtaggtaccgtacggtaccgtaccgtacggtacgacgaccgaaggtcctaaccggccccgtcggtccacgttccgttccgttcccgtccc

SEQ ID NO: 406475 - DNA, 573 bp, Homo sapiens
  misc_feature: GZ8MTXP02FY2K6.10.12.B01.1.454.CMB.2.raw
  modified_base (366)..(366): a, c, t, g, unknown or other
  modified_base (379)..(379): a, c, t, g, unknown or other
  modified_base (388)..(388): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcgtggtccagccgagggaggtccctgagactctcctgtgcagcctctggattgaggttcaataactatgctatgcacgtgggtccgccaggctccgaggggaaggggctagggaatggatgactagttattccacacgatgacaacaaantacagcgagtcgngacgggccntgcatcgtctccagagactaagttacgaaagaacactctgtacctgacaaaatgaaacagtactggaagacggaccggacggaccgtacgggtccgttacgttaccgttttggacgacgtaactagggtaaggtaaggggacgtacgttagggtaagggggtatttacgggacgtttacccgggg

SEQ ID NO: 406476 - DNA, 687 bp, Homo sapiens
  misc_feature: GZ8MTXP02HLV16.10.12.B01.1.454.CMB.2.raw
  modified_base (368)..(368): a, c, t, g, unknown or other
  modified_base (384)..(384): a, c, t, g, unknown or other
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccagcagaagccaggccacggcccctggtggaacttgtatataaggacactgagacggccccgagggactccctagagtcgtattcctcgtcggccctccagtctacgagggacaacnggtcgtacgttgaccntcgaggccgggacgcccgggcaacgggaggacggtaggaccgttaggaaacttacgtttaaaccgtgtttacaaaacgttcaaacccgtaaaggtacttaacggtttaacgttacggttaaaccgttttaggttacgggggttcgtttacgggggccgggttacggggttaaccgaaaacggttccgttaccggtaccggtttaccggtaaacgggtttcccgacgtacccccgtaaggtccccgtaaccggtcccccggtttacggtcccttacgtcccgttcccgtttacccctacccccg

SEQ ID NO: 406477 - DNA, 646 bp, Homo sapiens
  misc_feature: GZ8MTXP02GHG11.10.12.B01.1.454.CMB.2.raw
  modified_base (289)..(289): a, c, t, g, unknown or other
  modified_base (304)..(304): a, c, t, g, unknown or other
  modified_base (380)..(380): a, c, t, g, unknown or other
  modified_base (420)..(420): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttgagaggtgtccagtgtcaggtgcagttggaggaatcgtgggggagcgtggtccagccgagggaggtccctgagactctcctgtgcagcctcgtggattgagttacaataactatgctangcacgtcgggtcccncgaggtcctccggaaggggaacgggctaggaagtggatgaactagtttacttcacacgatacgaaccaaaacaacnctaaccgtacggacggtacgtttcggagggacggggcccncgtagctacgtccgtaccctaccgacgaacgtaactaaacgttacgaaacgtaaaacctccgttacgttaccgtacctagaacctaaaatacggaaactaggttcaggacggaccgacggaacggaccgtacggtccgtttacttacgttttcgacggaccgtaacgttaaggaacggttacgggaacgttacggtaaggttaacggggtactttacgggtaccgg

SEQ ID NO: 406478 - DNA, 692 bp, Homo sapiens
  misc_feature: GZ8MTXP02H39NZ.10.12.B01.1.454.CMB.2.raw
  modified_base (406)..(406): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgaggggacgtccctgagactctcctgtgcacgcctcgtggattggaggttacaaataactatgctatcgcacgtcgggccgccgaggcctccggaaggggacggggctagggaatggatagactagttattccacacgatcgaacaaaaccaaaatctaacgtacggcggtagttcggngggacggggcccgtacgtcgactagtccgtacgtacccgaggaacgaacctaaacgttaaccggaaaacgaacctaccgttaccgttacgttaaaccccgttaggaaccctaaaaggtagtaaaccctaggttaccgtaaggaaacggacggaacccgggaaagggaacccggtaaccgggtcccgtttacctttaacggttttcggacggtaccgtaaacggtaggtaaagggtgggtacggtacgttaaggtaaggggtttacgtttggttaacggttccgggg

SEQ ID NO: 406479 - DNA, 579 bp, Homo sapiens
  misc_feature: GZ8MTXP02HG7RE.10.12.B01.1.454.CMB.2.raw
  modified_base (260)..(260): a, c, t, g, unknown or other
  modified_base (283)..(283): a, c, t, g, unknown or other
  modified_base (301)..(301): a, c, t, g, unknown or other
  modified_base (368)..(368): a, c, t, g, unknown or other
  modified_base (388)..(388): a, c, t, g, unknown or other
  modified_base (398)..(398): a, c, t, g, unknown or other
  modified_base (429)..(429): a, c, t, g, unknown or other
  modified_base (457)..(457): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgagggagtccctgagactctcctgtgcagcctntggattggagttcaaataactangctatgcacgtgggtccncaggcctcgaggggaagggctaagagtggatgactagttattccacacgatacgacaaaaccaaaantacgtacggcggtagttcgngaggggcccntgcatcgactccgagacgaacaatacgaaanacactctacgacctagacaaatgaaacngtactagaagacggaccgaaggaccacgggtcccttactttacgtttggacgtacgtaacgtaaggaaacggtggggaatacggtaaaggttaggggtactttacggtaacgtttcccgggg

SEQ ID NO: 406480 - DNA, 651 bp, Homo sapiens
  misc_feature: GZ8MTXP02FI451.10.12.B01.1.454.CMB.2.raw
  modified_base (311)..(311): a, c, t, g, unknown or other
  modified_base (424)..(424): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttctttttaagaggtgtccagtgtcaggtgcaggttggaggaatcgtgggggagcgtggtccaggccgaggggacgtccctgagacctctcctgtgcagcctctggattggaggttacaaatactatgctatgcacgtcgggtccncaggcctaccggaaggggaggggctaggaatggatgactagtttactccacacgatacgaaccaaaaccaaactactaccgtaacggacggtagttcggagggacgggggccncgtcgacctagtccgtctacccgaaggacgaaactaacgttacgaaaacgaacctacttcgtaacgttaccgtagaaacctaaaagtacgaaaacctggtacctaggaacgacgaccggtaaggacccgtaccggtccgtttactttacgtttcggacgtacgtaacgagggtaaaggtcggggactacggttaagggtagggttatttacggacgtttacccgggg

SEQ ID NO: 406481 - DNA, 707 bp, Homo sapiens
  misc_feature: GZ8MTXP02G8NNS.10.12.B01.1.454.CMB.2.raw
  modified_base (435)..(435): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggaggcgtggtccagccgagggagtccctgagactctcctgtgcagcctacgtggacttggacggttcaaagttaacctagttggcttaagtcgccgtaacgtcggggttcccgccgaaggtcccgtacccggaagggggtaacggggctagggaaacgtggagtagaaccgtaaggttttacttccccgaaacgtacgaatacgaaccctaaaaccgaaaacncgtaaactaccgggcggtacgttcggtagggacgggtaccgtacgtgaccgtagtccgtactaccgacgtacgactaacgtacgaacgaactaccgtactacgtaacctggaacaagtaacgtaacgagtcgagtaaacggcggaccgtaagggaccgtaaaccgggtccgttacgttaaccgttttcggacggtacgtaacgtaaggtaacgggtgggtaaacggtcgttaaacggttagggggtacctttgggaacgtttaccccggggg

SEQ ID NO: 406482 - DNA, 658 bp, Homo sapiens
  misc_feature: GZ8MTXP02HIR5K.10.12.B01.1.454.CMB.2.raw
  modified_base (261)..(261): a, c, t, g, unknown or other
  modified_base (291)..(291): a, c, t, g, unknown or other
  modified_base (398)..(398): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaaggaggtgtccagtgtcgaggtgcaggttggaggaatcggtgggggagcgtggtccagccgagggacgtcctgagctctcctgtcgcncgcctctggtatggagttacaaataactangctagtcgctacgtcggtcccgccgaggccgtaccggaggggaacggggctagggaatggactagtactagtttactacccacgtacgatacgaacaaaaccaaaanctaaccgacggacggttagtcgggtcgggacgggccgctacgcacgttcgtactaccgagaacgtaacgtaaagtacgaaacgtaacaccttacgtacgtacctagactaaagtaacgaaacgtacggacgtaggacggaacggaccggaacggtaaccgacccgggttcttaccgtttaccgtttggaacgtaccgtacgtaaggtaaggtggggtacgtaggtaacggtaggttagtttaccggtacggtttccgggg

SEQ ID NO: 406483 - DNA, 575 bp, Homo sapiens
  misc_feature: GZ8MTXP02FKFZ7.10.12.B01.1.454.CMB.2.raw
  modified_base (208)..(208): a, c, t, g, unknown or other
  modified_base (260)..(260): a, c, t, g, unknown or other
  modified_base (300)..(300): a, c, t, g, unknown or other
  modified_base (369)..(369): a, c, t, g, unknown or other
  modified_base (387)..(387): a, c, t, g, unknown or other
  modified_base (415)..(415): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgngggggagcgtggtccagccagggaggtccctgagactctcctgtgcagcctntggattgagttcaaataactatgctatgcacgtgggtccncaggctccgaaggggagggctagggaatgggatgactagtttattccacacgatgaccaaaccaaaaantaacacgcggtagttcgnggacggggccactgcatcgctaccaganaacaagttcgaaaacgaacactctacgtacctagaccaaaatcgaaacagtctagagacgaccggagaaccgacgggtccttattactttggacgacgtaacgtaaggaaaggtggggaacgtacgtaaggtacgggggtatttacggacgtttaccggg

SEQ ID NO: 406484 - DNA, 716 bp, Homo sapiens
  misc_feature: GZ8MTXP02JDZJ6.10.12.B01.1.454.CMB.2.raw
  modified_base (158)..(158): a, c, t, g, unknown or other
  modified_base (239)..(239): a, c, t, g, unknown or other
  modified_base (259)..(259): a, c, t, g, unknown or other
  modified_base (296)..(296): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttccncgttgctcttttaagaggtgtccagtgtcaggtgcagttggaggaatcgtgggggagcgtggtccagccgagggacgtccngagactctctgtgcagcctnggattgagttcaaatactatgctatgcacgtggtccncaggctccgaggggagggctagggaatggatgactagtttacttaccacacgatagacctaaaacccaaaactgtaaccgtaacggcgggtacgtttacggtacgggacgggggtcccacgtcgacccgtagttcccggtctaaccccgaaggtaaccggtaacctaaaacgtttaccgggaaaaactaaaccctaaaccgtttccttaacgggtaaccccttggtaaaacctaaaagttaacgaaaccgtagttacgaacggaaggacggacccggaaaacggtacccgtaaccgggtacccgtttacgtttaccggtttttaggaccgaacccgtaaaccgtaaggggtaaacggttaagggggaacgttacgttaaaggggtacgggggtttaatttcggaaccgttttcccggggg

SEQ ID NO: 406485 - DNA, 699 bp, Homo sapiens
  misc_feature: GZ8MTXP02IWHG9.10.12.B01.1.454.CMB.2.raw
  modified_base (240)..(240): a, c, t, g, unknown or other
  modified_base (262)..(262): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttcctcgttgcttcttttaagaggtgtccagtgtcaggtgcagttggaggaatcgtgggggagcgtggtccagccgagggcgtcccngagactctcctgtcgcagcctntggattggagttacaatactatgctatgcacgtcggccgccaggcctaccggaggggagggctagggaatggatgactagtttacttccacacgtatcgaaccaaaacccaaaatacgtacctaacggacggggtagtttccgggagggaacgggggtcccgcgtacgaccgtacgttccgtaccgtacccgaagaaccgtaactaaacgtaccgaaaacgtaacctaccgttaccgttacggtaaccctagaaacctaacgtaaagtaaacgtacggttaacgacggaaggaaccggaccgggaaacggacccggttaaccgggtccccgtttacgttaccgtttttcggacggttaccgtacgttaaagggaggggtaagggtacggtacgttacgggtaagggtttacgtttacggttacggtttacccggggg

SEQ ID NO: 406486 - DNA, 725 bp, Homo sapiens
  misc_feature: GZ8MTXP02FLZMC.10.12.B01.1.454.CMB.2.raw
  modified_base (238)..(238): a, c, t, g, unknown or other
  modified_base (266)..(266): a, c, t, g, unknown or other
  modified_base (285)..(285): a, c, t, g, unknown or other
  modified_base (291)..(291): a, c, t, g, unknown or other
  modified_base (331)..(331): a, c, t, g, unknown or other
  modified_base (465)..(465): a, c, t, g, unknown or other
tcagcatagtagtgcacgaccggtgctcgatttagtagtgtagattccgcgggggagctctgggagacgagcccagcactggaagtcgccggtgtttccattcggtgatcatcactgaacacagaggactcaccatggagttggggctgagctgggttttcctcgttgctcttttaagaggtgtccagtgtcaggtgcagttggaggaatcgtgggggagcgtggtccagccgagggnggtccctgagactctcctgtgcagcctntggattgagtcaataactntgctangcacgtcgggtcccgctacggccgtacggaggggacgggngtaggaagtggtagtacgtacttagtttacttaccgacgaacgtatacgaacccaaacctaaaactacgttaaacccgtaaccggggtacggttagggtttacccggtagggggtaacccgggggccgtaccgngtacctacgtcccgttaccacccgtaaagaaacgtaacgtaaaacttacgggaaaaactaaccctacgttccctaagttaaccccttggaaaaccttaacgtaagaaacctagggttaccgaggaacggggtaccggggacccggggaaaaccgtcccggggtccgtttaccgtttaccggtttaggccggaaccggtagtaaggggaacggggtacggtacggttacgtaaagggttggggtatttacgggttacccgg

SEQ ID NO: 406487 - DNA, 809 bp, Homo sapiens
  misc_feature: GZ8MTXP02ITGE2.10.12.B01.1.454.CMB.2.raw
tcagcatagtagtgcacgaccggtgctcgatttagtagtgtagattccgcggggctggggagacgagcccagcactggaagtcgccggtgtttccattcggtgatcatcactgaacacagaggactcaccatggagttggggctgagctgggttttcctcgttgctcttttaagaggtgtccagtgtcaggtgcaggttggaggaatcggtgggggagcggtggtccaggcccgaggggacggtccctgacgtactctccgtgtcgcacgcctcgtggtattggaggttacaaattaactatgactagtcgactacggtcgggtccgccgaggccgtaccggaagggggtaacggggtcgtagggaaaggtgggtaacgtcggtaacttaagggtttttaacttcccgaaaaccgtacgtaagttaaccggaaaccctaaaaaacccccgaaaaacgttacgtaaaccgtttaaacccggggaccgggggtttaacggtttcccgggggacgggggaaccgggggtcccgtcggtacggtaccgtacgtaccggttacctaaccccgaaaggtaaccggtaaacctaaacggttaaaccggaaacgtaaccttaaccgttaccttaaccggtaaccgtagtaacccaaaacgtaacgtaaccgtagtaccgtaggaacggcggaccggaacggaccgaccgggttcgttacctttacggttttacggacgtaacggtaacggtaacgtaggtaaggggtacgtaacggttaagggtaacgggttgtttacggtaccggtttaccggggg

SEQ ID NO: 406488 - DNA, 761 bp, Homo sapiens
  misc_feature: GZ8MTXP02F3PQ0.10.12.B01.1.454.CMB.2.raw
tcagcatagtagtgcacgaccggtgctcgatttagtagtgtagattccgcgggggtgggtccaggaggcagaactctgggtgtctcaccatggcctggatccctctacttctccccctcctcactctctgcacagggtccgaggcctcctatgagctgacacagccaccctcggtgtcagtcgtccccatgacagacggccaggatcacctgctctggagatgtctttgaccgaagcaatatgcttacgtggtaaccagcaagacgccgaggccacggcccctaggtacggtaacttgtaataagtaaagggactacgtaggaacggaccggaccccccgaaggggacctccccgtaggacgtccgtatttccgtcgtacggtcctaccgagtccgtacggacgggaaccacgtacgggtacggtaccggttacgaaccctagtaccggaggacccggggacgggaccccggggagaacgggacgggtaaccgggaacggtccgtaagggttaaccttacgttaaccgttacggtaaacgtaaacgttaaccctaaagggaaacgttaaacttaaacgtttaacggttaaccggtttaaccgtttaaggggttcggggttacgggttccggggtaacgggtacgggttaccgaaacggtccgtaccggtaccggttaccgtacggtaccgaaacgcccgttaacgggcccttacccggcccccgttcggtacctacccgtttccgtacccgtttccccccg

SEQ ID NO: 406489 - DNA, 606 bp, Homo sapiens
  misc_feature: GZ8MTXP02H8NKK.10.12.B01.1.454.CMB.2.raw
  modified_base (278)..(278): a, c, t, g, unknown or other
  modified_base (287)..(287): a, c, t, g, unknown or other
  modified_base (305)..(305): a, c, t, g, unknown or other
  modified_base (568)..(568): a, c, t, g, unknown or other
tcagcatagtagtgcacgaccggtgctcgatttagtagtgtagattccgcggggagctctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcaggttggaggaatcgtgggggagcgtggtccagccgagggcggtcctgagctctcctgtgcagcctctggattgagttnaatactatnctatgcacgtcgggtccnccgaggcctacggaggggaacggggtctaggaatggatggactagtttatcacacgatacgactaaccaaaactactaacgtacgaccggtagttcgggtgggacgggggtcgctagcagtcgtactccgaagacgtaactacgtacgaaacgtacctactacgttacgtaccgtgaaccaaagtacgaaacctagtcagagacgcccggaaacggaccgtaccggtccgttacttaaccgttttgacgtaccgagttaaagnggtaaggacgtagtttaggggtaggggtacttttcggg

SEQ ID NO: 406490 - DNA, 551 bp, Homo sapiens
  misc_feature: GZ8MTXP02FJ0PK.10.12.B01.1.454.CMB.2.raw
  modified_base (158)..(158): a, c, t, g, unknown or other
  modified_base (248)..(248): a, c, t, g, unknown or other
  modified_base (258)..(258): a, c, t, g, unknown or other
  modified_base (298)..(298): a, c, t, g, unknown or other
  modified_base (367)..(367): a, c, t, g, unknown or other
  modified_base (384)..(384): a, c, t, g, unknown or other
  modified_base (395)..(395): a, c, t, g, unknown or other
  modified_base (451)..(451): a, c, t, g, unknown or other
  modified_base (485)..(485): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagctgggttttccncgttgctcttttaagaggtgtccagtgtcaggtgcagttggaggaatcgtgggggagcgtggtccagccagggagtccctgagctctccngtgcagcctntggattggaggttcaaatactatgctatgcacgtgggccnccaggctccgagggagggctgggaactgggatgaactagtttacttccgacacgatcgacaaaccaaantacacggcggagttcgnggacggggccntgcagtcgtctcgagagaacagttacgaaagactactctagtcctagacctaaagngaacagtctaggagcgacgaggacacggtccgtnttacgtttgacgcgtaacgtagaacggtgggactcgtaaggtggggtaatttcggacgtttaccgg

SEQ ID NO: 406491 - DNA, 824 bp, Homo sapiens
  misc_feature: GZ8MTXP02FREZF.10.12.B01.1.454.CMB.2.raw
  modified_base (257)..(257): a, c, t, g, unknown or other
  modified_base (259)..(259): a, c, t, g, unknown or other
  modified_base (265)..(265): a, c, t, g, unknown or other
  modified_base (282)..(282): a, c, t, g, unknown or other
tcagcatagtagtgcacgaccggtgctcgatttagtagtgtagattccgcggggctgggagacgagcccagcactggaagtcgccggtgtttccattcggtgatcatcactgaacacagaggactcaccatggagttggggctgagcttgggttttcctcgttgcttcttttaagaggtgtccagtgtcaggtgcaggttggaggaatcgtgggggagcgtggtccaggccgagggacgtccctgagctctcctgtncngcctgnggatgagtcaataactntgctatgctacggtggtcccgcaggcctaccggaaggggaacggggtctagggaaagttgggaattacgaacttaaggtttactttaccccgaaacgtacgtaagtaccgaaaccctaaaaaacccaaaaaacgtctaaaacccggtaccgggtacggggttaaacgggtttcccgggtaaggggaacccgggggtccccgtaagttcgggaaccctacggttacccggttctaacccgtaagggacggtaaacttaaaacggttccgaaaaaacggtacccttaaacttcctaaacgggtttaccccaggtaaaacctaaaacggttacgaaaaacccgttggttacctaggggaaaacgtccggaaccggggaaacggtaacggttaacccggggtccctttagttttaacgggttttacggacgggtaaacccgttaaacgggtaacggggtttaaaacgggggtcggggtaaacgtaacgggttttaaaggggtaagggggtttaactttcggtttaaccggggtttaaccccggggg

SEQ ID NO: 406492 - DNA, 527 bp, Homo sapiens
  misc_feature: GZ8MTXP01BZFHW.15.2.A02.1.454.CMB.2.raw
  modified_base (292)..(292): a, c, t, g, unknown or other
  modified_base (362)..(362): a, c, t, g, unknown or other
  modified_base (520)..(527): a, c, t, g, unknown or other
tcagtctacgtagccacgaccggtgctcgatttagactcatctacaggggtccctgagactctcttgtgcagcgtctggattcaccttcagaagttggggcatgcactgggtccgccaggctccaggcaaggggctgcaatgggtggcgctaatatgggatgacggaagtaaggaatattatgcagactccgtgaaggccgattcaccatctccagagacaattccaagaagacgctgtttctgcaaatgaacagcctgagagtcgaggacacggctgtatattatgtgcgngagagggggttgtagcacgggtcacgtggactacgtggggccacgggaaccctggtcacccgtctcctcngcctccaccagggccccagtccggtccttcccctgccaccctcctccaacgacgcacctcgtcgggacacacgccggcccgtgggcctcgcccgtcggtccaacggacctaccgtccgtctacgtagactggacgcgggcttgggcaagggcgcatgnnnnnnnn

SEQ ID NO: 406493 - DNA, 550 bp, Homo sapiens
  misc_feature: GZ8MTXP01EU02G.15.2.A02.1.454.CMB.2.raw
  modified_base (245)..(245): a, c, t, g, unknown or other
  modified_base (279)..(279): a, c, t, g, unknown or other
  modified_base (295)..(295): a, c, t, g, unknown or other
  modified_base (538)..(538): a, c, t, g, unknown or other
  modified_base (543)..(550): a, c, t, g, unknown or other
tcagtctacgtagccacgaccggtgctcgatttagactcatctacaggggtccctgagactctcttgtgcagcgtctggattcaccttcagaagttggggcatgcactgggtccgccaggctccaggcaaggggctgcaatgggtggcgctaatatgggatgacggaagtaaggaatattatgcagactccgtgaagggccgattcaccatctccagagacaattccaaagaagacgctgtttcngacaaatgaacagcctgagagtcgaggacacggntgtatattatgtgcgngaggaggggttgagcacggtcactggactacgtgggggccacgggaacccctggtccaccgtctccctcaacgccctaccaaccgaacggggcccctaagtccgggtcccttcccccgtggccaccctcctccaagacgcacctcgtgggaccacgacgccggcccgtggggcctcgccgtggtccaaggacctaccgttccgactacgtagcgtggacgcggggcttgggacaagggccganagtgnnnnnnnn

SEQ ID NO: 406494 - DNA, 610 bp, Homo sapiens
  misc_feature: GZ8MTXP01AFDTU.15.2.A02.1.454.CMB.2.raw
  modified_base (330)..(330): a, c, t, g, unknown or other
  modified_base (603)..(610): a, c, t, g, unknown or other
tcagtctacgtagccacgaccggtgctcgatttagactcatctacaggggtccctgagactctcttgtgcagcgtctggattcaccttcagaagttggggcatgcactgggtccgccaggctccaggcaaggggctgcaatgggtggcgctaatatgggatgacggaagtaaggaatattatgcagactccgtgaagggccattcaccatctccagagacaattccaagaagacgctgtttctgacaaatgaacagcctgagagtcgaggacacggctgtatattattgtgcgcgaggagggggttgagcgacggtcacgtggactacgnggggccaagggacccctggtccacccgtctaccctcaacgccctacccgaaccgaacggggccccctaagttccccgggtaccctttcccccccgtgggtcccctaacccccgtcccgtacccgaaacgaccgaccctaacccgtccgtacggggaccaccgacggcccggaccccggtcgggccgtcggtcccgtcggtaccgaacggtaccttaccgttcccgtacgtaccgtacgcgtggacggcgggcgttcggacgaaggcgcagtgnnnnnnnn

SEQ ID NO: 406495 - DNA, 581 bp, Homo sapiens
  misc_feature: GZ8MTXP01CIOC4.15.2.A02.1.454.CMB.2.raw
  modified_base (245)..(245): a, c, t, g, unknown or other
  modified_base (321)..(321): a, c, t, g, unknown or other
  modified_base (373)..(373): a, c, t, g, unknown or other
  modified_base (417)..(417): a, c, t, g, unknown or other
  modified_base (574)..(581): a, c, t, g, unknown or other
tcagtctacgtagccacgaccggtgctcgatttagactcatctacaggggtccctgagactctcttgtgcagcgtctggattcaccttcagaagttggggcatgcactgggtccgccaggctccaggcaaggggctgcaatgggtggcgctaatatgggatgacggaagtaaggaatattatgcagactccgtgaagggccattcaccatctccagagacaattccaaagaagacgcttgtttcngacaaatgaacagcctgagagtcgaggacacggctgtatattattgtgcgcggaggagggggttggagcacgggtnacgtggactacgtgggggccacggggacccctggtccacccggtctccctcncgccctcccgaccgaacgggccccagtcccggtcccttcccccnggcccaccctcctacccgaacgacgcccaccgtcgtacggggaccacgacgccgggccccggtggggccttcggccgtggtaccaacgggtacctaccgttcccgcttacgttacgaccgttggaggttcggggcgttggaccgaggcgcagtaagnnnnnnnn

SEQ ID NO: 406496 - DNA, 555 bp, Homo sapiens
  misc_feature: GZ8MTXP02IBSF4.15.2.A02.1.454.CMB.2.raw
  modified_base (361)..(361): a, c, t, g, unknown or other
  modified_base (548)..(555): a, c, t, g, unknown or other
tcagtctacgtagccacgaccggtgctcgatttagactcatctacagggtccctgagactctcttgtgcagcgtctggattcacctttcagaagttggggcatgcactgggtccgccaggctccaggcaaggggctgcaatgggtggcgctaatatgggatgacggaagtaaggaatattatgcagactcgtgaaggccgattcaccatctccagagacaattccaagaagacgctgtttctgcaaatgaacagcctgagagtcgaggacacggctgtatattattgtgcgcgaggaggggttggtagcacgggtcactggactacgtggggccagggaaccctggtcaccggtctcctcngccctcacccaaacggggccccagtccggtccttcccccctcggccaccctccctcccaacgacgccacctcgtcggggacacgacggccggcccgtcggggcctcggcccgtcgggtccaaacgggtacctaccgttcccgcctacgtagacgtcgacggcgggcgtggcgtaaggcgacataagnnnnnnnn

SEQ ID NO: 406497 - DNA, 522 bp, Homo sapiens
  misc_feature: GZ8MTXP02HVJW4.15.2.A02.1.454.CMB.2.raw
  modified_base (295)..(295): a, c, t, g, unknown or other
  modified_base (362)..(362): a, c, t, g, unknown or other
  modified_base (364)..(364): a, c, t, g, unknown or other
  modified_base (399)..(399): a, c, t, g, unknown or other
  modified_base (418)..(418): a, c, t, g, unknown or other
  modified_base (436)..(436): a, c, t, g, unknown or other
  modified_base (450)..(450): a, c, t, g, unknown or other
  modified_base (515)..(522): a, c, t, g, unknown or other
tcagtctacgtagccacgaccggtgctcgatttagactcatctacaggggtccctgagactctcttgtgcagcgtctggattcaccttcagaagttggggcatgcactgggtccgccaggctccaggcaaggggctgcaatgggtggcgctaatatgggatgacggaagtaaggaatattatgcagactcgtgaaggccgattcaccatctccagagacaattccaaagaagacgcttgtttctgacaaatgaacagcctgagagtcgaggacacggctgtatatttatgtgcgngaggaggggttgagcgacggtcacgtggactacggtggggccacggggaccctggtcaccgtctccncncgcctccaccacgggccagtccggtcccttcccgngcccaccctcctcaaagcnccacctcgcgggacacgngcccggcctgggcngcccgtgtcaacggtctacgtccgactacgtagactggacgcgggctggaccagggtcacagtgnnnnnnnn

SEQ ID NO: 406498 - DNA, 519 bp, Homo sapiens
  misc_feature: GZ8MTXP01CU7JP.45.53.E09.1.454.CMB.2.raw
  modified_base (348)..(348): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctcctgcatagtaatggatacaactatgtggattggttcctgcagaagccagggcagtctccacagctcctgatctatcgtggatcctagttccggccctccgggggtccctgacnggttcagtggcagtggtcagcacagtatttacactagaaatcagacagagtggagcgtgggaggtagttggttggggtttattacgtgctagtgactaaggtctgaactaaattcgtaccgttggtagtttggacgttaggggaccaagcgtggagagactaacgaacgtg

SEQ ID NO: 406499 - DNA, 528 bp, Homo sapiens
  misc_feature: GZ8MTXP01EJJV7.45.53.E09.1.454.CMB.2.raw
  modified_base (293)..(293): a, c, t, g, unknown or other
  modified_base (342)..(342): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggtctcagtgaaggtttcctgcaaggcttctggatacactttcgctgcccatgccattcattgggtgcgccacggcccccgganaagggcttgagtggagtgggatggatcaacgctggctacgtggttacanagaatatcaacagaaaacttccgaaggacagagtcaccgtatttcgtaagggactatattcgacgaaacacagcctacagtgacctgagcaggtttgagtatctgacgacgacggctgtctattactgtgcgaggagggaggggggaggtagttagttgactaatagtgtattagttatgttgtcg

SEQ ID NO: 406500 - DNA, 580 bp, Homo sapiens
  misc_feature: GZ8MTXP01DA22D.45.53.E09.1.454.CMB.2.raw
  modified_base (198)..(198): a, c, t, g, unknown or other
  modified_base (224)..(224): a, c, t, g, unknown or other
  modified_base (253)..(253): a, c, t, g, unknown or other
  modified_base (259)..(259): a, c, t, g, unknown or other
tcagacgcgatcgacacgaccggtgctcgatttagagagagtgtgttgggtttgggggagtcagacccactcaggacacagcatggacatgagggtccccgctcagctcctggggctcctgctgctctggctcccaggtgccagatgtgccatccagatgacccagtctccattctccctgtctgcatctggtagganacagagttaccaataacttgccgggnaaagtcaggatattagaaatgagttaggntggtancagcagagaccgagggggacgcccccaatcctagtctatggtgtcttccgaggttacaaaggtcggggtaccatcgaaggttcagtggcggtgggtctggacacaagaattcactctacaccatcagtccgcctgacacgcccgaaagtattttgactaaacttattactagtacctaacggaaattatttacaaacttaccctcggactagttaccgaccgtaaaggggacccaaagtcgttaaggaagaacttaaacgaaaacgtaaactggttcggcttagaacctaacccttcttcgttcgttcttcttccttcccg

SEQ ID NO: 406501 - DNA, 518 bp, Homo sapiens
  misc_feature: GZ8MTXP01CV59E.45.53.E09.1.454.CMB.2.raw
  modified_base (276)..(276): a, c, t, g, unknown or other
  modified_base (291)..(291): a, c, t, g, unknown or other
  modified_base (399)..(399): a, c, t, g, unknown or other
  modified_base (481)..(481): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtncgccaggcccccganaggcttgagtggatgggatggatcaacgctggcactggtacacagaatatcacagaaaattccaagacagagtcactatttcaggacatatcgacgaacacagcctanagtggacctgagtctaggtttgagtatcgtagacgacgacggtctgtctattactgtgcggaggagggacggggggtaaggnttaagttggactaataatgtattattacgtgttgtcg

SEQ ID NO: 406502 - DNA, 516 bp, Homo sapiens
  misc_feature: GZ8MTXP01BEDSC.45.53.E09.1.454.CMB.2.raw
  modified_base (292)..(292): a, c, t, g, unknown or other
  modified_base (428)..(428): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccgganaagggcttgagtggatggggatggatcaacgctggcactggtacacagaatatcacagaaaattccaaggacagagtcacctatttcagggactatattcgacgaacacagcctacatggacctgagcagggtttnagatctgacgacacggctgtctattactgtgcgaggacgggaggggggagggattagttggactaatagtgtattattactgttgtcg

SEQ ID NO: 406503 - DNA, 551 bp, Homo sapiens
  misc_feature: GZ8MTXP01CB60B.45.53.E09.1.454.CMB.2.raw
  modified_base (296)..(296): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctctgcatagtaatggatacaactatgtggattggttcctgcagaagccgagggcagtctccanagctcctgatctatcgtggatcctagttcggcccgtccggggtcctgactggttcaggtggctaggtggtacaggcacagtatttacactagaaaatcagcagagtggagcgtagggaggtagttgggtttaggggtttattacgtgactagtgtacgtaaggtctgtaactaaagttcggtccgttgggttagtttcgggaccggttaggggaccgtaaggcgtaagggagacgacgaaaaccgttaagtaagg

SEQ ID NO: 406504 - DNA, 553 bp, Homo sapiens
  misc_feature: GZ8MTXP01COL41.45.53.E09.1.454.CMB.2.raw
  modified_base (419)..(419): a, c, t, g, unknown or other
  modified_base (429)..(429): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtcccgtcacccctggagacgccggcctcatctcctgcagggctagtcagacgcctctgcaatagtaatggataacaactatgtgtattcggtcctgacaagaacgccgagggcagtcctccacagctctgacttctatcgtggactcccgtacgttccggcccgtcccgggggtccctacggacgtggttcagggtggcgtaggtggtacagcacagtatttacactaagaaatcagnagagtggagngtgggaggtaggttgggtttaggggtttattacgtgactagtgtacgtaaggtctagaactaaagttcgtacgttggtagttcggacggaggacaagcgtaaggagagacaaacgttaacgtgg

SEQ ID NO: 406505 - DNA, 572 bp, Homo sapiens
  misc_feature: GZ8MTXP01AIXJQ.45.53.E09.1.454.CMB.2.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctcctgcatagtaatggatacaactatgtggattggttcctgcagaagccgagggcagtctccacagctcctgatctatctgggatcctacgttcggcccgtcccggggtccctagactggttcaggtgggcaggttggttcaggcacagtatttacactagaaatcagcagagtggaggcgtaggggaggtagttgggtttaggggtttattacgtgcgtagtgaccgtaagggtctgaactaaagttcggtaccgttgggttagttttcgggaccggaacgggggacccgaagggtaccggtaagggaaggaacggaacgaaaaccggttaacgtggg

SEQ ID NO: 406506 - DNA, 783 bp, Homo sapiens
  misc_feature: GZ8MTXP01DEBHX.45.53.E09.1.454.CMB.2.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtgggatattgtgatgactcagtctccactcctcctcgtccgtccacccgtggacgcgcccgtcctctactcctcgtgacgacggtactagtcgaagccgtcctccgtagactaagtaaagtaagagtaactaactaaatgtggtagttagtttcggtcagacgaaagaacgccggaggctacgtcccaccaatcgtcctcgtagtactactacgtcggtaggtacttccgttaccgggttccggtccccgggttcccggggttccaacgtaacggttaacgggtacgtaagggtcgggtacgtagggtttcgggtaacgacgggtaaccctaaacggttaagtttaaaactttaaccaaacggttaaaaaacgtaaaacgtacggaacgtaaacgggtaagggtaggggtaacgggacgggttaggttaaggggggttaagggttttagggttttacggggttttaaaggtttaactacgtggtaacgttaacgtacggtaaacggtaaccgttacgtaaacgtaaacggttaacggtttcggttacgggttagggtttacgggttaccgggaaccgggaacggttaaacgaaggtacggtaaggaacgtaaacgttaaaaccgtaaacgttcggttgg

SEQ ID NO: 406507 - DNA, 661 bp, Homo sapiens
  misc_feature: GZ8MTXP01B5N4X.45.53.E09.1.454.CMB.2.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagacgccggcctccatctcctgcagggctagtcagacgcctcctgcatagtaatggaatacaactatgtggattggttcctgcagaagccagggcagtctccacagctcctgatctatcgtgggacttccgttacgttccgggtccccgtcccgggggtccctaggaaccgtaagggtttccaagggttcgggaccgtagggtttcgggttcgaagggtacctacgtaaggttaacttttaacaactaagtaaaaactcgaaggacgaaggagggtagggagggtcgtagggggtaagggttaaggtttgggtttagggggtttattacgtggtatagtgacgtaaggtctaggtaactaaagttcggttaccgttgggttaacgggttttcgggacccgggttacgggggacccgtaagggtcggtaagggaacggacggaaccgtaaaacggttaacggttggg

SEQ ID NO: 406508 - DNA, 576 bp, Homo sapiens
  misc_feature: GZ8MTXP01BHA66.45.53.E09.1.454.CMB.2.raw
tcagacgcgatcgacacgaccggtgctcgatttagagagagtgtgttgggtttggggtgatcagtactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctctgcatagtaatggatacaactatgtggattggtcctgcagaagccagggcagtctccacagcctcctgatctatcgtgggactccgtattcggccccgtccgggggtccctgactggttcaggtggcaggtggtcaggcacgagtatttacaactagaaaatcagcagagtggaggcgtaggggaggtagttggttaggggtttattacgtgactagtgtacgtaaggttctggaactaaagttcggttaccgttagggttaacggttttcgggacccggttacgggggaacccgtaaggcggttaagggaagaacggacgtaaaaccggttaacgttggg

SEQ ID NO: 406509 - DNA, 680 bp, Homo sapiens
  misc_feature: GZ8MTXP01DKUY2.45.53.E09.1.454.CMB.2.raw
  modified_base (242)..(242): a, c, t, g, unknown or other
  modified_base (333)..(333): a, c, t, g, unknown or other
  modified_base (548)..(548): a, c, t, g, unknown or other
tcagacgcgatcgacacgaccggtgctcgatttagagagagtgtgttgggtttgggtgatcaggactcctcagttcaccttctcacaatgaggctccctgctcagctcctggggctgctaatgctctgggtctctggttccagtggggatattgtgatgactcagtctccactccctcctcgtccgtccacccgtggagacggcccgcctcactcctctgcgaggctagtcagacgtcctcngctataagtagtgataacaactagtggtagtagtttcgttcctgacgaagaacgccggagggctaggtcctaccacgacgtccttccgtanacttcttaacgttcggtaggtacttctaccggttcccggccccgggttcccggggtccctaacggaacggttcggtacgtagggtcggacgtagggttcgttacgacgggacctagtaactttaactttaacgacgttaaagaaactcgacacgaaggtaggaggaacggtcgtaggggaaggttaggtttgggttttaacgggttacttacggngtacgtagtcgtaagtacgtcgtaacgtaacgttaacggttcggtacggttgggtttacggttcgggaaccgggttacgggaaaccgtaaggtacggtaagggaacgaacggaaacgtaaacggttcggtgg

SEQ ID NO: 406510 - DNA, 559 bp, Homo sapiens
  misc_feature: GZ8MTXP01CKYP5.45.53.E09.1.454.CMB.2.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtcccgtcacccctggagacgccggcctccatctcctgcagggctagtcagagcctcctgcatagtaatggatacaactatgtggattggttcctgcagaagccgagggcagtctccacagctcctgatctatcgtgggtatccttagttccggccccgtcccggggtccctagaccgtaaggttccagggttgggctaggtcggttcaggcacagtatttacactagaaatcagcagagtggaggcgtggggaggtagttgggtttaggggtttattacgtgcgtagtgtctaagggtctggaactaaagttcgtcgttgggttacggtttgggccgttaggggaccaaggcgtaagggagaggacgaacgaacgtgg

SEQ ID NO: 406511 - DNA, 570 bp, Homo sapiens
  misc_feature: GZ8MTXP01D95D6.45.53.E09.1.454.CMB.2.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagacgcctcctgcatagtaatggatacaactatgtggtattggtcctgcagaagccgagggcagtcctaccacagctcctgatctatcgtgggacttccgtacgttccggccccgtcccgggggtccctagactgggttcaggtggctaggtggtcaggcactagtatttacactagaaatcagcagagtggaggcgtaggggtaggtagtttgggtttagggtttagttacgtgctaagtgtacgtaaggtcgagtaactaaagttcggtcgttagggtacggtttcggaccggttaggggaccgaaggtacgtaagggaagacgaacgtaaaccgaagtgg

SEQ ID NO: 406512 - DNA, 578 bp, Homo sapiens
  misc_feature: GZ8MTXP01DDTFU.45.53.E09.1.454.CMB.2.raw
  modified_base (215)..(215): a, c, t, g, unknown or other
  modified_base (229)..(229): a, c, t, g, unknown or other
  modified_base (277)..(277): a, c, t, g, unknown or other
  modified_base (295)..(295): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctnagtgaaggtttccngcaaggcttctggatacactttcgctcgcccatgccattcattgggtncgccacggccccccgganaagggcttgagtggatggggatggatcaacgctggcacgtggttacacagaatattacacaagaaaacttccaaggacagagtacacctatttcaggactatattcgacgaacacagcctacagtaggacctgaacgctaggtttagagtatactagaaccgacgacggtactgttctagttaacctggtgacggagggaaggggacggggggggtaaagggtagttagttcggaccgtaatttaaagtaaggttaatttaagttacgttggttcgttaacgg

SEQ ID NO: 406513 - DNA, 526 bp, Homo sapiens
  misc_feature: GZ8MTXP01B54H8.45.53.E09.1.454.CMB.2.raw
  modified_base (275)..(275): a, c, t, g, unknown or other
  modified_base (292)..(292): a, c, t, g, unknown or other
  modified_base (417)..(417): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtncgccacggcccccgganaagggcttgagtggatgggatggatcaacgctggcactggtacacagaatattcaacagtaaaaattcccaaggacagacgtcacctatttcgtaagggactatattcgacgaacacacgcctanatgacctgagctaggtttgagtatcgtgacgacgacggctgtctattactgtgcgaggaggacggggggaggtagttagttggactaataagtgtattattatgttgtg

SEQ ID NO: 406514 - DNA, 567 bp, Homo sapiens
  misc_feature: GZ8MTXP01DBA2H.45.53.E09.1.454.CMB.2.raw
  modified_base (366)..(366): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagacgcctctgcaatagtaatggatacaactatgtggattggttcctgcagaagccaggggcagtctccacagcctcctgatctatctgggacttcctacgttccggcccgtccggggtccctgactggttcagtggcnggtggtcaggcacagtatttacactagaaaatcagcagagtggaggcgtaggggagggtagttgggtttaggggtttattacgtgtcgtagtggtacgtaaggtcgtagtaacgtaaagttcggttccgttgggttaaggtttcgggaccggttacggggaaccgaaggtcgtaagggagacgacgtaaacgaacgtaagg

SEQ ID NO: 406515 - DNA, 552 bp, Homo sapiens
  misc_feature: GZ8MTXP01AGG2Y.45.53.E09.1.454.CMB.2.raw
  modified_base (293)..(293): a, c, t, g, unknown or other
  modified_base (303)..(303): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctcatctcctgcagggctagtcagagccctcctgcatagtaatggatacaatatgtggattggttcctgcagaagccgagggcagtccncacagctccngactctatcgtggacttcctacgttccggcccgtccggggtcctagactggttcaggtggctaggttggtcaggcacagtactttacactagaaatcagacaggagtggaggcgtaggggaggtagttgggtttaggggtttattacgtgtatagtgtacgtaaaggtctggaactaaagttcgtaccgttgggtagtttcgggcggttacgggaaccaaggcgtaaggagagacgtaaacgaacgtgg

SEQ ID NO: 406516 - DNA, 791 bp, Homo sapiens
  misc_feature: GZ8MTXP01AH2ZJ.45.53.E09.1.454.CMB.2.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcaggctagtcagagcctcctgcatagtaatggatacaactatgtggattggttcctgcagaacgccaggggcagtctccacagctcctgactctatcgtagggtatcctaacgttccgggcccccttcccggggggtcccctagggtaaccgtaacgggtttccgaaagggtttcgggccgtaaggggtttcggggttaccacggggacctaaaccgtaagggttaaactttttaaaccaaaccgttaaggtaaaaaaacttaccgaaggtaccgaaagggtaagggttacgggggaaagggtcccggttaggggggtaacggggttaagggttttacgggggttttacgggggggtttttaaagtttaaacccggtttgggaccttaacggttagggtacgtaaacggggttaccgttaacggggtaaccctaaaaaggttttcggttaacccggttggggttaacgggtttttaccggggacccgggttaaacggggggaccccgttaaaagggcccggttaacgggggaaggaacggttaaccggtaaaaacgggaaacccggtttcggggg

SEQ ID NO: 406517 - DNA, 739 bp, Homo sapiens
  misc_feature: GZ8MTXP01CLDOE.45.53.E09.1.454.CMB.2.raw
  modified_base (312)..(312): a, c, t, g, unknown or other
tcagacgcgatcgacacgaccggtgctcgatttagagagagtgtgttgggtttggggtgatcaggactcctcagttcaccttctcacaatgaggctccctgctcagctccgtggggctgctaatgctctgggtctctggttccagtggggatattgtgatgactcagtctccactcctccctgtcccgtccaccccgtggagacgccggcctccatcctcctgcgagggctagtcagacgccctcctgacatagtaatggaataacaatatggtggtattcggtcctgcaagaagccgagggcagtctccancgtcctcctgactctatcgtggtacttcccgttacgtccggtccccgttcccgggggtccctaggtaaccgtcgggttacgtagggtcgggtacgtagggtttcgggttacgacgggtacctaacgtaaggttaactttttaaacaacgttaaagtaaaaacgttcgaaacggtacgaagggtaagggttaggggagggttacggtaggggggtaaggggtttaggttttacggggtttttacgggggtttaatttaaccggtgtacgtagttcggaacgtaaagggttcgtaacggtaaaccgtaaaggttcgggtttaacccggttggggtttaaacgggtttccggggaccgggttaacgggggttaacccgaaggtcgggtaagggaacggtacggaaaccgtaaaacgggttaacgtcgggg

SEQ ID NO: 406518 - DNA, 543 bp, Homo sapiens
  misc_feature: GZ8MTXP01C2ANG.45.53.E09.1.454.CMB.2.raw
  modified_base (217)..(217): a, c, t, g, unknown or other
  modified_base (283)..(283): a, c, t, g, unknown or other
  modified_base (300)..(300): a, c, t, g, unknown or other
tcagacgcgatcgacacgaccggtgctcgatttagagagagtgtgttgggtttgggacccaacaaccacatccctcctcagaacgcccccagagcacaactcctcaccatggactggacctggaggatccttctttttggtggcagcagccacaggtgtccactcccaggtccagcatgtgcagtcgtggggctgaggcgaagaagcctggggcctnagtgaaggtttcctgcaaggtcttctggatactactttcgctgcccatcgccattcagttgggtcncgccgacggcccccganaagggcttgagtggatgggatggatcgaacgctggctactggttacacgaagtaatattcgaacaagtaaaaaacttcccaaggacagagtcaacctatttcaagggtacatatcgacgaacacacgacctacataggacctgaagctaggtttgagtatcgtagacgacgacgtctgtactattactgtgcgaggaggagggggagattagttgactaataatgtattattacgtgttgtcg

SEQ ID NO: 406519 - DNA, 641 bp, Homo sapiens
  misc_feature: GZ8MTXP01EULAY.45.53.E09.1.454.CMB.2.raw
  modified_base (374)..(374): a, c, t, g, unknown or other
tcagacgcgatcgacacgaccggtgctcgatttagagagagtgtgttgggtttggggacccaacaaccacatcccctcctcagaagcccccagagcacaactcctcaccatggactggacctggaggatcctctttttggtggcagcagccacaggtgtccactcccaggtccagcatgtgcagtcgtggggctggaggcgaagaagccgtggggcctcgagtgaacggtttcctgcaaggtcttcgtggatactactttcgctgcccatcgcctattcagttgggtcgccgccgacgggccccccggaagaagggtcttggagtggagtgggatggatcgaacgcgtggcacgtggtacacaagaatatacanaagtaaaacttccaaggacagacgtcacctatttcgaggactatactacgacgaacacacgactacagtgacctgacgtcgtagggtttagagtacttacgtacgaccgaacgtaccgggtacttcgttacctttaagtttaccgtgggtaacggtacgggaagggggtaacgggggaacgggggggggtaaggttaaggttaagttcgggaaccgttaaagttaaagtaaggttaaatttacgttaacggttgggttcgttaacgg

SEQ ID NO: 406520 - DNA, 618 bp, Homo sapiens
  misc_feature: GZ8MTXP01BT8OB.45.53.E09.1.454.CMB.2.raw
  modified_base (277)..(277): a, c, t, g, unknown or other
  modified_base (297)..(297): a, c, t, g, unknown or other
  modified_base (591)..(591): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccaggtggggatattgtgatgactcagtctccactctccctgtcccgtcacccctggagacgccggcctccatctcctgcagggctagtcagacgccctctgctatagtaatggatacaatatgtggtattggtccngcaagagccgagggcagtcnccacacgtctcctgactctatcgtaggtactcccgttacgttccggccccgtccggggtccctaggacgtggttccgagggttcggacgtagggttcggtacgacgggtacaacgtaagttaacgttttaacaacgttaagtaaaacgtcgtaagacgaaggtaggtagggacggtagtggggtaagggttaggtttcgggtttagggtttacttagtcgacgtagtgtacgtaaggtctagtaactaagttcggttcgttggtaggtttcgggacggttacgggacgtaacgngtaaggagaacgacgtaaacgcgtaag

SEQ ID NO: 406521 - DNA, 668 bp, Homo sapiens
  misc_feature: GZ8MTXP01CTZRK.45.53.E09.1.454.CMB.2.raw
  modified_base (142)..(142): a, c, t, g, unknown or other
  modified_base (233)..(233): a, c, t, g, unknown or other
  modified_base (244)..(244): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggnggcagcagccacaggtgtccactcccaggtccagcatgtgcagtcgtggggctggaggcgaagaagccgtggggcctgagtgaagtttccngcaaggtcttnggatacactttcgctgcccatcgcctattcagttggcgccgccgacgggcccccggaagagggcttggagtggagtggggatggatcgaacgcgtaggctacgtaggtacaacgtagaaattattcgaaacgtaagtaaaaaacgttcccgaagggtaacaacggtaacgttacccaaacctaagttttaccggaaagggtacctaattacgttaccgaacgaaaccaacgaacgtacctaacagtacggacctgaacgtcgtagggtttgagtactacgtacgaaccgacgtcggtacttcgtacttacgttacgttgggtaaggtacggaagggggtacgggggaacggggggggaaaggtagttagttggttaacgtaacgttaaagttgtaatttacgttacgttaaggttggttaacgg

SEQ ID NO: 406522 - DNA, 572 bp, Homo sapiens
  misc_feature: GZ8MTXP01D8BJL.45.53.E09.1.454.CMB.2.raw
  modified_base (231)..(231): a, c, t, g, unknown or other
  modified_base (241)..(241): a, c, t, g, unknown or other
  modified_base (334)..(334): a, c, t, g, unknown or other
  modified_base (349)..(349): a, c, t, g, unknown or other
  modified_base (359)..(359): a, c, t, g, unknown or other
  modified_base (388)..(388): a, c, t, g, unknown or other
  modified_base (418)..(418): a, c, t, g, unknown or other
  modified_base (427)..(427): a, c, t, g, unknown or other
tcagacgcgatcgacacgaccggtgctcgatttagagagagtgtgttgggtttgggacccaacaaccacatccctcctcagaagcccccagagcacaactcctcaccatggactggacctggaggatccttctttttggtggcagcagccacaggtgtccactcccaggtccagcatgtgcagtcgtggggctgaggcgaagaagccgtgggcctcgagtgaaggtttccngcaaggcttntggatacactttcgctgcccatcgcctattcagttgggtgccgcccgacgggccccccggagaagggcttgagtggatgggatggatcaacgntggcacgtggtacanagatatcaanagaaaacttcaaggacagactcaaccttntttacgaagggactagtattcgacgaacanacgacctanatcggacctgaacgtctagggtttagaggtataccgtagaaccgacgtacggtcttcgtccttagttactggtaacgcggagggagggggacggggggtaggtattagttggactaagtaagtgtattaagttgttgttcgtaag

SEQ ID NO: 406523 - DNA, 581 bp, Homo sapiens
  misc_feature: GZ8MTXP01DD3HH.45.53.E09.1.454.CMB.2.raw
  modified_base (143)..(143): a, c, t, g, unknown or other
  modified_base (220)..(220): a, c, t, g, unknown or other
  modified_base (234)..(234): a, c, t, g, unknown or other
  modified_base (311)..(311): a, c, t, g, unknown or other
  modified_base (351)..(351): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttcttttttggnggcagcagccacaggtgtccactcccaggtccagcatgtgcagtcgtggggctgaggcgaagaagccgtggggcctnagtgtaagtttccngcaaggtcttcgtggactactactttcgctcgcccatcgcctattcagttgggtgccgccgacgggccccccggaanaagggtcttggagtggagtggggatgggatcgaacgtcgnggcacgttggttacacgtaagaatatcaataagtaaaaacttccgaaggacagtaacgtccaacctagtttcgaagggactatatcgacgaacaacacgcctacagtcggactgagtactaagtttgagtattcgagacgacgtcggacttgtacttagttcgtgtgcggaagggaggggacggggggtaggtattagttgactaataagtgtattattacgtgttgtcg

SEQ ID NO: 406524 - DNA, 579 bp, Homo sapiens
  misc_feature: GZ8MTXP01EYH08.45.53.E09.1.454.CMB.2.raw
  modified_base (505)..(505): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctggaggcgaagaagccgtggggcctcgagtgtaaggtttcctgcaaggtcttctggatactactttcgctcgcccatcgccattcagttgggtcgccgcccgacgggccccccggaagaacgggtcttggaggtggagtgggatggatcgaacgctggctacgtggtacacaagaatatacaacaagtaaaacttccaaggacagagtcactagttcaaggactatatacgacgaacacagacctacagtcgacctagacgtcgtaggtttagagtactacgtagacgacgtaggacttgtacttattacgnggtcgaggagggaggggaaggggggaggtaagttagttggactaagtaagtgttaattattagtggttgtaacg

SEQ ID NO: 406525 - DNA, 725 bp, Homo sapiens
  misc_feature: GZ8MTXP01AL1CI.45.53.E09.1.454.CMB.2.raw
  modified_base (260)..(260): a, c, t, g, unknown or other
tcagacgcgatcgacacgaccggtgctcgatttagagagagtgtgttgggtttggggtgatcaggactcctcagttcaccttctcacaatgaggctccctgctcagctccgtggggctgctaatgctctgggtctctggttccagtggggatattgtgatgactcagtctccactctccctgtccgtcaccctggagagccggcctccatctcctgcagggctagtcagacgcctcctgcaatagtaatggatacaactntgtaggtattggttcctagcagaacgccgaggggcacgtcctaccacacgtcctccgtgactctactcgtaggggtacttcccgtacgttccgggcccccgttaccgggggtcccctaagggtactgggtttacgacgggttcggcgtaggttcgggttacacgggtacctaacgtaaggttaactttttaacaaccgttaaggtaaaaccttagaaacgtacgaaggtaacgggttacgggaagggtcgttagggggtaagggtttaaagggtttgggttttaagggggtttttaacttaacggttgaccgtaaagttcggtaccggtaaagggttcgtaagtaacgtaaaggtttcggttaccgggttaagggttacgggttttacgggacccgggttaacgggggttaaccgtaaacgggcgtaacgggaaggaacgaccgtaaaacggttaacgttcgggg

SEQ ID NO: 406526 - DNA, 589 bp, Homo sapiens
  misc_feature: GZ8MTXP01CEO89.45.53.E09.1.454.CMB.2.raw
  modified_base (563)..(563): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagccgtggggcctcagtgaaggtttcctgcaaggtcttcgtggatacactttcgctgcccatcgcctattcagttgggtgcgccacgggccccccggagaagggcttggagtggagtgggatggatcgaacgctggcagtggttacactagaatatcactaagaaaacttccaaggacagagtcactatttcgagggactatattcgacgaacacgacgacctacacgtacggacctagacgtactagggtttgaagtactacgtacggacgacgacggtcctgtaccgttatttacgtggtcggcggaggggacggggacgggggggtaaggtagttacggttgaccgttaattaaggtntaaggttattacggtgttgttaacgg

SEQ ID NO: 406527 - DNA, 605 bp, Homo sapiens
  misc_feature: GZ8MTXP01ATH5Q.45.53.E09.1.454.CMB.2.raw
  modified_base (229)..(229): a, c, t, g, unknown or other
  modified_base (362)..(362): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttccngcaaggtcttctggatacactttcgctgcccatcgccattcagttgggtgcgccgacggcccccggagaagggcttgaggtggagtggggatggatcgaacgctgggctacgtggttacactagaatattcanagaaaacttcccaaggacagtatacacctatttacgagggtacattactacgacgaacacacgacctacgacgtaggtaccctaggacgtcgtaggggtttagaaggtactccgtaggaccgacgtacgggtcttaggtacttaacgttaccgtggttcgcgggaagggacgggggacggggggggtaggtaagttaggttggacctaagtagtaagtaattattaccgttggttaagtccgg

SEQ ID NO: 406528 - DNA, 601 bp, Homo sapiens
  misc_feature: GZ8MTXP01EG5KN.45.53.E09.1.454.CMB.2.raw
  modified_base (226)..(226): a, c, t, g, unknown or other
  modified_base (276)..(276): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctgggctgaggcgaagagcctgggcctcagtgaaggtttccngcaaggtcttctggatactactttcgctcgcccatgccattcattgggcncgccgacggccccgagaggtctaggagtggagtgggatgactacgaacgtcgtggctacgtgtaacacgtaagtaatatacaactaagtaaaacttcgaaggacagactacactattcgaagactatacgtacgacaacacacgtacctacgacgtacgacgtgacgtacgttagggttgagtatacgacgacgacgtacggtcttacgttacttaacgttcgtggtaacggacggttaggggaacgggggaaggggggtaggtaagttaggttcggaacgttaacgttaagtaagttaacgtttacgttacgttggttcggtcg

SEQ ID NO: 406529 - DNA, 591 bp, Homo sapiens
  misc_feature: GZ8MTXP01B2SMM.45.53.E09.1.454.CMB.2.raw
  modified_base (233)..(233): a, c, t, g, unknown or other
  modified_base (452)..(452): a, c, t, g, unknown or other
  modified_base (518)..(518): a, c, t, g, unknown or other
  modified_base (549)..(549): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtctggggctggaggcgaagaagccgtggggcctcagtgtaaggtttccngcaaggtcttctggatactactttcgctcgcccatcgcctattcagttgggtcgccgccgacgggcccccgaagaagggtcttggaggtggagtgggatggatcaacgctggacacgttggtacacgagtaatatacaacgtaagtaaaaacttcccgaaggacaggacgtcaccttatttcgaagggtactatacttacgacgaaacacacgccctanagtcgacctgacgtctaggggtttgaagtactcgtagaaccgacgaggtcctgttactagttacgnggtgacggaggtagggggacggggggaagtnttagttcggactaagtaatgtaattagttactggttaagtcg

SEQ ID NO: 406530 - DNA, 581 bp, Homo sapiens
  misc_feature: GZ8MTXP01ARK1G.45.53.E09.1.454.CMB.2.raw
  modified_base (301)..(301): a, c, t, g, unknown or other
tcagacgcgatcgacacgaccggtgctcgatttagagagagtgtgttgggtttgggtgatcaggactcctcagttcaccttctcacaatgaggctccctgctcagctcctggggctgctaatgctctgggtctctggttccagtgggatattgtgatgactcagtctccactctccctgtccgtcacccgtggagacgccggcctccatctcctgcaggctagtcagacgcctcctgcagtagtaatggaatacaactatggtgtattggttcctgcaagacgccgagggcagtcctacanacgctcctgactctatcgtggactcctacgttccggccccgtccggggtccctagaccgtggttcaggttcgctagggttcggtacgagacaacgtagtatttaacactaagaaaactcagagagagtggaagcgtaggggtagtagttggtttagggtttataacgtgtactagtgtacgtaacggtctagtaactaaagttcgttacgttgggttacgtttcggacggttacgggaccgaaggtcgtaaggaacgagttaccgaaacgttcgtaaggg

SEQ ID NO: 406531 - DNA, 534 bp, Homo sapiens
  misc_feature: GZ8MTXP01BIURO.45.53.E09.1.454.CMB.2.raw
  modified_base (413)..(413): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccacggcccccggacaagggcttggagtggatgggatggatcaacgctggcactggtacacagaatatcacagaaaacttccaaggacagacgtcacctattcgtaagggactatatcgacgaacacacgcctanatgacctgagcgtaggtttgagtatcgtagacgactacggcttgtctattacgtggtgcggagggacggggaggggggtaggattagttggacaacttagtgtagttattacgtgttgtcg

SEQ ID NO: 406532 - DNA, 615 bp, Homo sapiens
  misc_feature: GZ8MTXP01AUEQN.45.53.E09.1.454.CMB.2.raw
  modified_base (247)..(247): a, c, t, g, unknown or other
  modified_base (291)..(291): a, c, t, g, unknown or other
tcagacgcgatcgacacgaccggtgctcgatttagagagagtgtgttgggtttgggacccaacaaccacatccctcctcagaacgcccccagagcacaactcctcaccatggactggacctggaggatcctctttttggtggcagcagccacaggtgtccactcccaggtccagcatgtgcagtcgtgggctggaggcgaagagccgtggggcctcgagtgtaacggtttcctgacaaggtcttcgnggactactactttcggctcgcccatcgcctattcagttgggtcnccgccgacgggcccccgagaggtcttgaggtggagtgggatggatcgaacgctggctagtggtacacgtagaatatcaacaagtaaaacttccgaaggacaggactacacttagttcgaaggactagtacgtacgacgtaacacgacgtacctacagtacgacctaggacgtcgtaagggttgagtactcgtacggaccgacgacggtcgttacgtacttaacgttaccgtggtggacgggaaggggaacgggggaggggggtaaggtaagttaggttcggacctaaggttagtaagtaagtttacttacgttggttgtaaccg

SEQ ID NO: 406533 - DNA, 563 bp, Homo sapiens
  misc_feature: GZ8MTXP01DT9AV.45.53.E09.1.454.CMB.2.raw
  modified_base (352)..(352): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctcctgcatagtaatggatacaactatgtggattggttcctgcagaagccagggcagtctcacagctcctgatctatcgtgggacttcctacttccggcccgtcccgggggtccctgacnggttcaggtggcagtggttcaggcacagtatttacactagaaaatcagacagagtggagcgtagggaggtagttggtttaggggtttattacgtgcgattgactaaggtctggaactaaagttggttccgttagggttaaggttttcgggaccggttaacgggggaacccgaaggtacgtgggaagaggacgtaaaacggttaacgttggg

SEQ ID NO: 406534 - DNA, 532 bp, Homo sapiens
  misc_feature: GZ8MTXP01AFFA2.45.53.E09.1.454.CMB.2.raw
  modified_base (276)..(276): a, c, t, g, unknown or other
  modified_base (293)..(293): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtncgccacggcccccgganagggcttgagtggagtgggatggatcgaacgctggcactggttacacgagaatatacacaagaaaacttccgaaggacaggagtcacctatttcgagggacatattcgacgaacacacgcctacagtcggacctgagtctaggggtttgaggtatcgtagacgacacggtctgtctattactgtgcgaggagggagggggagtagttagttgactaatagtgtattagttatgttgtcg

SEQ ID NO: 406535 - DNA, 540 bp, Homo sapiens
  misc_feature: GZ8MTXP01CUJHQ.45.53.E09.1.454.CMB.2.raw
  modified_base (296)..(296): a, c, t, g, unknown or other
  modified_base (356)..(356): a, c, t, g, unknown or other
  modified_base (368)..(368): a, c, t, g, unknown or other
  modified_base (374)..(374): a, c, t, g, unknown or other
  modified_base (412)..(412): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagccgtggggcctcagtgaaggtttcctgcaaggcttctggatacactttcgctgcccatgccattcagttgggtgcgccacgggccccccganaagggcttgagtggatggggatggatcgaacggctggcacgtggttacacagaatatcanagtaaaattccngacagngtcacatttcagggacatatcgacgaacacagacctanatggacctgagctaagtttgagtatcgtagacgagacggctgtactattactggtgtcggaggacgggaagggggggaggtagttagttgaccgtaataagttgtaagttattacgttggttgtaacg

SEQ ID NO: 406536 - DNA, 584 bp, Homo sapiens
  misc_feature: GZ8MTXP01CHOX3.45.53.E09.1.454.CMB.2.raw
  modified_base (284)..(284): a, c, t, g, unknown or other
  modified_base (461)..(461): a, c, t, g, unknown or other
  modified_base (529)..(529): a, c, t, g, unknown or other
  modified_base (551)..(551): a, c, t, g, unknown or other
  modified_base (574)..(574): a, c, t, g, unknown or other
tcagacgcgatcgacacgaccggtgctcgatttagagagagtgtgttgggtttgggacccaacaaccacatccctcctcagaagcccccagagcacaactcctcaccatggactggacctggaggatccttctttttggtggcagcagccacaggtgtccactcccaggtccagcatgtgcagtcgtggggctggaggcgaagaagccgtggggcctcagtgtaaggtttcctgcaaggcttctggatactactttcgctgcccatcgcctattcagttgggtnccgccacgggcccccggagaagggcttgagtggagtggggatggatcgaacgtcgtggctacgttggttaacacgtaagtaaattacgttacaacgtaagtaaaaaacttcccgaaggtacaaggtacgtaccaacctatttacgagggtactattactacgacgaacacagcctanagtcgacctgagtctagggtttgagtactcgtagaccgacgacggtccttagtccttattacgtgcgnggagggaggggcgggggtagtnttagttgactaagtatgtattanagtgttcgtg

SEQ ID NO: 406537 - DNA, 599 bp, Homo sapiens
  misc_feature: GZ8MTXP01BX1S9.45.53.E09.1.454.CMB.2.raw
  modified_base (270)..(270): a, c, t, g, unknown or other
  modified_base (282)..(282): a, c, t, g, unknown or other
  modified_base (302)..(302): a, c, t, g, unknown or other
  modified_base (335)..(335): a, c, t, g, unknown or other
  modified_base (349)..(349): a, c, t, g, unknown or other
  modified_base (355)..(355): a, c, t, g, unknown or other
tcagacgcgatcgacacgaccggtgctcgatttagagagagtgtgttgggtttgggacccaacaaccacatccctcctcagaagcccccagagcacaactcctcaccatggactggacctggaggatcctctttttggtggcagcagccacaggtgtccactcccaggtccagcatgtgcagtctggggctggaggcgaagaagccgtggggcctcagtgaaggtttcctgcaaggtcttcgtggatactactttcgctcgcccatgccnttcagttgggcncgccgacgggccccccgganaagggcttgaggtggagtgggatggatcaacgngtgcagtggtacanagaatntacaacagaaaaacttcgaagacagacgtcctaactatttacgtaacgggactaattacgttccgaacgaaaccacgaacgtacctaaccagtacggaaccctggaacgtcgtaaggggtttagacggtaactcgtacgaacgtacgacggtccttgtacttaacttcgtaggtggcggaagggaggggacggggggtagtagttagttggacctaagtattaaggattagttacgtgttgtcg

SEQ ID NO: 406538 - DNA, 558 bp, Homo sapiens
  misc_feature: GZ8MTXP01CXVAM.45.53.E09.1.454.CMB.2.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctgggctggaggcgaagaagcctggggcctcagtgaaggtttcctgcaaggtcttctggatacactttcgctgcccatgcctattcagttgggtgcgccgacggccccccggagaagggcttgagtggagtggggatggatcgaacgctggcacgtggttacacagaatattcacaagaaaacttccaaggtacagacgtacacctatttcgaggactatattcgacgaacacagtcctacatcggacctgacgcgtaggtttgagtatcgtagaaccgacgacgtcttgtacttattacgtgtcggaggagggaggggacggggggtaggtagttagttcgacgtaagtaatggtattagttacgtgttgtcg

SEQ ID NO: 406539 - DNA, 629 bp, Homo sapiens
  misc_feature: GZ8MTXP01EQR8M.45.53.E09.1.454.CMB.2.raw
  modified_base (235)..(235): a, c, t, g, unknown or other
  modified_base (291)..(291): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtcgtggggctggaggcgaagagccgtggggcctcgagtgtaaggtttccngcaaggtcttcgtggatactactttcgctcgcccatcgcctattcgagttgggtcnccgacccgacgggccccccggaagaagggtcttggagtggagtgggatggactcgaacgcgtaggctacgttggtaacacgtaagtaattatacaactaagtaaaaacttccgaaggacaggtacgtaccaactagtttacgaaggactatactacgacgtaacacacgacctacgacgtacggacctagacgtacgtaggtttagaagtactacgtagaccgacgtacgtctcgttacttagttacgtggtcggacggttaggggagggggttacggggggtaggtaagttagttcgacgtaagtaagtaagttaattacgttacgtgttgtaacgg

SEQ ID NO: 406540 - DNA, 524 bp, Homo sapiens
  misc_feature: GZ8MTXP01BWNBD.45.53.E09.1.454.CMB.2.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctctgcatagtaatggatacaactatgtggattggttcctgcagagccagggcagtctcacagctcctgatctatcgtgggatcctattccggcccgtccggggtccctgactgggttcagtggctaggtggtcaggcacagtatttacactagaaaatcagcagagtggagcgtgggaggtagttggttagggtttatacgtgctagtgactaaggtctgaactaaattgtccgttgggtacgtttggccgttaggggaccaaggcgtaaggagagacgtaaacgaagtgg

SEQ ID NO: 406541 - DNA, 604 bp, Homo sapiens
  misc_feature: GZ8MTXP01DU8LC.45.53.E09.1.454.CMB.2.raw
  modified_base (214)..(214): a, c, t, g, unknown or other
  modified_base (224)..(224): a, c, t, g, unknown or other
  modified_base (232)..(232): a, c, t, g, unknown or other
  modified_base (238)..(238): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtcgtgggctgaggcgaagagctgggcctnagtgagttcngcagcttngatacnctttcgctgccatgcctattcagttgggcgccgaccgacgggcccccggagaagggcttggaggtggagtggggatgggactcgaaccggtgtcggactacgttggtaacacgtaagaattatacaactaaggtaaaaacttccgaagggacagtacgtaccaaccttagtttacgaagggactagttacttcgacgaacacgacgtacctaacgagtacggtacctggtacgtcgttagggtttaggaaggtactacgtacggaccgtacgtacggtacttgttaccttagttacgtggtaagtggagggaggggacggggggagtgttagttcggataacgtatgtattagttagttgttgtcg

SEQ ID NO: 406542 - DNA, 652 bp, Homo sapiens
  misc_feature: GZ8MTXP01C6YZK.45.53.E09.1.454.CMB.2.raw
  modified_base (230)..(230): a, c, t, g, unknown or other
  modified_base (280)..(280): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctgaggcgaagaagcctggggcctcagtgaaggtttccngcaaggtcttctggatacactttcgctgcccatgcctattcagttgggtncgccgacgggcccccggagaagggcttgaggtggagtggggattgggatcgaaacgtcgtggactacgtggttacaacgtaagtaaattacttcaaacgtaaagtaaaaaaactttcccgaagggaaaccaaggtaacgttacccaaacccgttaagttttaccgaaaggggtaaaccttaagttaacgtttaccggaaccgtaaaaccaaccgaaacgtacccttaacaacgttacgggaacccttggaacgtacgttaagggtttacgaggtaactcgtagaaccgacgacgtctgtcttagtcgtgtggacgagggaggggacggggggaggtattggttgactaagtaatgtattattcgtgttgtcg

SEQ ID NO: 406543 - DNA, 574 bp, Homo sapiens
  misc_feature: GZ8MTXP01DTCH4.45.53.E09.1.454.CMB.2.raw
  modified_base (220)..(220): a, c, t, g, unknown or other
  modified_base (455)..(455): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtcgtggggctggaggcgaagaagccgtggggcctnagtgtaaggtttcctgcaaggtcttctggatactactttcgctcgcccatcgcctattcagttgggtcgccgcccgacgggccccccggaagaacgggtcttggaggtggagtggggatggactcgaacgcgtggcctacgtggttaacacgaagtaattattcaacaagtaaaaacttccgaaggacaagacgtcacctatttcgtagggactatatcgacgaacacagcctanatgactgagtctaggtttagagtatcgtagacgacacggtcttgtctattcgtggtggcggagggacggggaggggggaaggtattagttgacaattaatgtaattattacgtgttgtg

SEQ ID NO: 406544 - DNA, 611 bp, Homo sapiens
  misc_feature: GZ8MTXP01B7F78.45.53.E09.1.454.CMB.2.raw
  modified_base (232)..(232): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctggaggcgaagagccgtggggcctgagtgaaggtttccngcaaggtcttcgtggactactactttcgctcgcccatcgcctattcagttgggtcgccgcccgacgggccccccggaagaacgggtcttggaggtggagtggggatggactcgaacggtctggactacgttcggttaacacgtaagaattattacaacaagtaaaacttccgaaggacagactacactatttacgaaggactatactacgacgaacacacgacctacgagtcgactgacgtacgtaggtttgaagtactcgtacgaccgacgacggtctagttacctattacgtggtaacgcgggagggacgggggttaggggggtagtaacgttagttcgaccgtaagtagtgttaattagttagttgttggtaacgg

SEQ ID NO: 406545 - DNA, 617 bp, Homo sapiens
  misc_feature: GZ8MTXP01CQ23L.45.53.E09.1.454.CMB.2.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagacgccggcctccatcctcctgcagggctagtcagagtcctctgcatagtatgatacaatagtgtgtattcggttctgacagaagccgagggctagtcctaccaacacgtccttcccgtagtacttctaacgttcgtagggtaacttcccccgttacggttcccgggtccccgttcccgggggtccctaagggaacctgggttccagggtcgcgtagggttggttcgaggactaagtagtaactttacaacttaagaaattacgagcgtaaggagtgggaggtacgtaggggtaaggttaggtttagggtttaggggtttaattaacgtgtagtagtcgtacgtaaggtctagaactaaagttcggtacttgggtagtttggacggttagggactaagcgtggagagacgtaacgaaggtg

SEQ ID NO: 406546 - DNA, 624 bp, Homo sapiens
  misc_feature: GZ8MTXP01EH50O.45.53.E09.1.454.CMB.2.raw
  modified_base (234)..(234): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtcgtgggctggaggcgaagacgccgtggggcctgagtgtaaggtttccngacaaggtcttcgtggatactactttcgctcgcccatcgcctattcagttgggcgccgaccgacgggcccccggagaacgggtcttaggacggtggagtgggatggactacgaacgtctggctacgttggtaacacaagtaattatacaactaagtaaaacttccgaagggtacaagtacgtacctacctagtttacgaaggtactattacgtcgacaaacacaacgtctaacagtacggacctagagtacgtaagggtttgagttaatccgtagaacccgacgtaacggtcctgttacctagttacgtggtaaggacggaggggtaggggaagggggtaggtattaggttcgaactaataagtggtaacttagttacgttgttaagtcg

SEQ ID NO: 406547 - DNA, 538 bp, Homo sapiens
  misc_feature: GZ8MTXP01A0Q98.45.53.E09.1.454.CMB.2.raw
  modified_base (351)..(351): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccacggccccccggagaagggcttggagtggatgggatggatcgaacgctggcactggtacacagaatatcanagaaaattccaaggacagagtacacctatttcgtagggactatattacgacgaacacagacctacatcggacctgagcgtaggtttagagtatcgtagaccgacgacggtctgtcctagttacgtgtgacgagggagggacggggggaggtagttagttgactaagtatgtatagttactgttgtcg

SEQ ID NO: 406548 - DNA, 606 bp, Homo sapiens
  misc_feature: GZ8MTXP01DOPGV.45.53.E09.1.454.CMB.2.raw
  modified_base (270)..(270): a, c, t, g, unknown or other
  modified_base (298)..(298): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcaccctggagacgccgcctcatctctgcaggctagtcagacgcctctgcatagtaatggaatacaatagtgtggtattggtccngacagaacgccgagggcagtcctacacncgctcctgactctatcgtggtacttcccgtacgttccggcccgtccggggtaccctagacgtggttcagggtcgacgtaggtggttcgacggctaagtagttaactttacacgtaagaaactcgaagcgagaggtggagtcgtaggggtagtaggtttggtttagggtttattacgtgtacgtagtcgtacgtacggtcgtagtaactaagttcggttaccgttagggttacggttttcgggacccggttacggggttaaccaagggtacgtaagggaacgaacggaacgtaaaccgttaagttcggg

SEQ ID NO: 406549 - DNA, 553 bp, Homo sapiens
  misc_feature: GZ8MTXP01AH117.45.53.E09.1.454.CMB.2.raw
  modified_base (229)..(229): a, c, t, g, unknown or other
  modified_base (240)..(240): a, c, t, g, unknown or other
  modified_base (277)..(277): a, c, t, g, unknown or other
  modified_base (294)..(294): a, c, t, g, unknown or other
  modified_base (353)..(353): a, c, t, g, unknown or other
  modified_base (483)..(483): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttccngcaaggcttcnggatactactttcgctgcccatgccattcattgggtncgccacggcccccgganaagggcttgagtggatggggatgggatcgaacgctgggctacgtggttaacacagaatntacacagaaaaattccaaggacagagtcactatttcgaagggacatacttcgacgaacacaacgccttaacagtcggacctgagtctagggtttgagtactcgtagacgacacgggtctagtctattacnggtgcggagggagggacggggggtaggagttgttggactaacgtatggtaattagttacgttgttggtcg

SEQ ID NO: 406550 - DNA, 577 bp, Homo sapiens
  misc_feature: GZ8MTXP01E1LK5.45.53.E09.1.454.CMB.2.raw
  modified_base (229)..(229): a, c, t, g, unknown or other
  modified_base (477)..(477): a, c, t, g, unknown or other
  modified_base (505)..(505): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttccngcaaggtcttctggatacactttcgctgcccatgccattcattgggtgcgccgacggccccccggagaacgggcttgaggtggagtgggatggatcgaacgctggcacgtggttaacacgaagaatattcgaacagaaaaacttccaaggtaccagacgtcaacctatttcgtaagggactaatacgttacgacgaacaacacgcctaacagtacggaccctagacgactagggtttgaaggtattcnggacgaccgacggtctgtcttattacgnggtgcggagggacggggttaggggggagtagttagttgactaacgtagtaagtattacttagtgttgtaacg

SEQ ID NO: 406551 - DNA, 726 bp, Homo sapiens
  misc_feature: GZ8MTXP01C07RE.45.53.E09.1.454.CMB.2.raw
  modified_base (215)..(215): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctgggctgaggcgaagaagccgtggggcctnagtgtaaggtttcctgcaaggtcttcgtggatacactttcgctcgcccatcgcctattcagttgggtcgccgccgaccgggccccccggaagtaacgggtccttagggacgtgggtagtgggggtacgttggactaccgaaacgtcgtacggtctaacgtacgggttaacaaccgtaaagtaaacttactttacgaaacgtaaagtaaaaaaaccgtttcccgaaggggtaaaccaaaggtacggttaccctaaccgttaacgttttaaccgaaacggggtactaagttacgtttacgaaccgtaaaccaacgtacgtaccctaactacgtacggtacccgtagacgtacgttagggtttagaagtctacgtcgaaccgacgacgggtactcgttacgtagttacgtggtaacggacggaggggtaaccgggggaggggggtaaggtagttaagttcggaaccgtaagttaaagtggttaaattagttaaccgttggttaaggttaaccgg

SEQ ID NO: 406552 - DNA, 541 bp, Homo sapiens
  misc_feature: GZ8MTXP01AKFYC.45.53.E09.1.454.CMB.2.raw
  modified_base (302)..(302): a, c, t, g, unknown or other
  modified_base (519)..(519): a, c, t, g, unknown or other
  modified_base (538)..(538): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagcccggcctccatctcctgcagggctagtcagagcctcctgcatagtaatggatacaactatgtggattggttcctgcagaagccagggcagtctcacagctcngatctatcgtgggatccttacttccgggccccttccgggggtccctaggacctgggttcagggttggcaggttcggtcaggcacagtatttacacgtagaaatcagcagagtgggaggtcgaggggtaggtagtttgggtttaggggtttattacgtgtctagtgcgtaaggtctgaactaagttgtcgttggtagtttcggccgagggaccaaggngaaggagacgacgtaacgngtg

SEQ ID NO: 406553 - DNA, 625 bp, Homo sapiens
  misc_feature: GZ8MTXP01BVUIX.45.53.E09.1.454.CMB.2.raw
  modified_base (229)..(229): a, c, t, g, unknown or other
  modified_base (240)..(240): a, c, t, g, unknown or other
  modified_base (339)..(339): a, c, t, g, unknown or other
  modified_base (353)..(353): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatcctctttttggtggcagcagccacaggtgtccactcccaggtccagcatgtgcagtcgtggggctggaggcgaagagccgtgggcctcagtgagtttccngcaaggtcttntggatactctttcgctgcccatcgcctattcagttgggtcgccggcccgacgggcccccggaagaagggcttggaggtggagtgggatggatcgaacgntggcagtggtacanagaattagtcaactagtaaaaacttccgaagggacaggtacgtacctaacctagttttacgaacgggactaagttacgtacgacgaaacaacgacgtacctaacgacgttacgggaccctgggtaactcgttaggggtttagacggtataccgtagaccgtacgtacggtaccttgttaccttagttacctggtaacgcgggagggtacgggggaggggggtagtagttgttgaccgttaatagtgttaattagttagttggttgttaacgg

SEQ ID NO: 406554 - DNA, 569 bp, Homo sapiens
  misc_feature: GZ8MTXP01AG8IF.45.53.E09.1.454.CMB.2.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctggaggcgaagaagccgtggggcctcagtgaaggtttcctgcaaggtcttctggatactactttcgctgcccatgccattcagttgggtgccgccgacggccccccggagaagggcttgagtggatgggatggatcaacgctggcagtggtacacagaatatcacagaaaaattccgaaggacagagtacacctatttcgaagggactatatcgacgaacacacgcctaacatacggacctggagtactagggtttgagtatcgtagacgacacggtctgtctattacgtggtgcggttaagggacggggaagggggggtaggtaagttaggttcgacgtaacgttaagtggtatttacgttacgttgttaaggtcgg

SEQ ID NO: 406555 - DNA, 763 bp, Homo sapiens
  misc_feature: GZ8MTXP01DL3FM.45.53.E09.1.454.CMB.2.raw
tcagacgcgatcgacacgaccggtgctcgatttagagagagtgtgttgggtttgggacccaacaaccacatccctcctcagaagcccccagagcacaactcctcaccatggactggacctggaggatcctctttttggtggcagcagccacaggtgtcccactcccaggtccagcatgtgcagtcgtggggctgaggcgaagaagccgtggggcctcagtgaaggtttcctgcaaggtcttctggatactactttcgctgcccatgccattcagttgggtgccgcccgacgggccccccggaagaaggggcctttaggagtggagtggggatggatcaacgctggctacgtggttacactaagaatattacaacaagtaaaaactttcccgaagggaacaggaacgtacctaaaccctagttttaccgaagggtaacctaattaagttaccgacgtaaaccaacgacgtaccctaactaacgttacggaacccgttaggaacgtacgtaagggggtttttacggaagtaacgttaccgttacggtaacccggaaccgtaccggggtacccgttaggtttaaccccttttaaagttaaccggtttgggttaaccgggtcggggttaaacgggggtaaaggggggaaaccgggggggggggggtaaagggttaacgggttaaaggttttccgggaaaccgttaaacggttaaaagttaacgggttaaatttaaggtttaaccggttaagggtttggttaaccggg

SEQ ID NO: 406556 - DNA, 598 bp, Homo sapiens
  misc_feature: GZ8MTXP01C8T5O.45.53.E09.1.454.CMB.2.raw
  modified_base (282)..(282): a, c, t, g, unknown or other
  modified_base (384)..(384): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactcctccctgtcccgtccaccccgtggagacgccggcctcatcctcctgcagggctagtcagacgcctcctgcaatagtaatggaataacaatatggtggtattggtccngacagacgccgagggcagtcctaccacacgtcctcctagacttctatcgtggtactccgtacgtccggcccgtccggggtccctagacgtggtcaggtcggntaggtggtcaggcatagttattacactaagaaatcagacgaggaggtggacgtgtaggggtaaggtaggtttgggtttagggtttattacgtgtacgtaagtgtacgtaggtctagtaaacgtaagttcggttcgttaggttacggtttcgggaccggttagggaacccgtaaggtacgtaaggaacgacggaacgtaaaccggttaagtcggg

SEQ ID NO: 406557 - DNA, 572 bp, Homo sapiens
  misc_feature: GZ8MTXP01AB4YW.45.53.E09.1.454.CMB.2.raw
  modified_base (280)..(280): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctggaggcgaagaagccgtggggcctcagtgaaggtttcctgcaaggtcttctggatacactttcgctgcccatgccattcattgggtncgcccgacgggccccccggagaagggctttggaggtggagtggggatggatcgaacggctgggcacgtggttaacacgtaagaatattacaacaagtaaaaacttccgaaggacagacgtacacctatttcgtagggactatattcgacgaacacagcctaacagtcggacctgacgctagggtttgagtatcgtagaccgacgacggtctgtactattactggtgacgagggaggggacggggggtaggtgttaggttgacgtaagtatggttattattagtggttgtcgg

SEQ ID NO: 406558 - DNA, 600 bp, Homo sapiens
  misc_feature: GZ8MTXP01BLBKC.45.53.E09.1.454.CMB.2.raw
  modified_base (235)..(235): a, c, t, g, unknown or other
  modified_base (523)..(523): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctggaggcgaagaagccgtggggcctcgagtgtaaggtttccngcaaggtcttcgtggatactactttcgctcgcccatcgcctattcagttggggtcgccgccgacgggccccccggagaacgggtcttggagtggagtgggatggatcgaacgctggctactggtacacaagatattcaactagtaaaacttccgaagacagacgtcacctatttcgaagggtactattacttacgacgaaacacacgactacagtcgacctgaagtcgtagggtttgaaggtacttcgagaccgacgacggtcttcggtactagttacgtggtaacgngggaagggaacgggggcggggggtaaaggtagttagttcggactaagtagtgtaagttattagttaagttggtaacg

SEQ ID NO: 406559 - DNA, 577 bp, Homo sapiens
  misc_feature: GZ8MTXP01DY27L.45.53.E09.1.454.CMB.2.raw
  modified_base (213)..(213): a, c, t, g, unknown or other
  modified_base (288)..(288): a, c, t, g, unknown or other
  modified_base (296)..(296): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctgggctgaggcgaagaagcctgggcctnagtgaagtttcctgcaaggcttctggatacactttcgctgcccatgccattcattggtgcgccacggcccccganaggcttgngtggatggggatggatcgaacgctggctacgtggttacacagaaatattcaactaagaaaaacttccaaggacagacgtacacctatttcgagggactatattacgacgtaacacaacgcctacatcggaacctggaagtcgtagggttttagagtaactcgtacggacgacgtacggtcttaggttccttattacgtggtcgcggttagggacggggaggggggtaaggtagttagttgaccgtaagttaaatggtaattagttacgttgttcggtaacg

SEQ ID NO: 406560 - DNA, 515 bp, Homo sapiens
  misc_feature: GZ8MTXP01ECA6R.45.53.E09.1.454.CMB.2.raw
  modified_base (278)..(278): a, c, t, g, unknown or other
  modified_base (294)..(294): a, c, t, g, unknown or other
  modified_base (404)..(404): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctggaggcgaagaagcctggggcctcagtgaaggtttcctgcaaggcttctggatacactttcgctgcccatgcctattcattgggtncgccaggcccccgganaagggcttgagtggatgggatggatcaacgctggcagtggtacacagatatcaacagtaaaattcaaggacagatcactatttcgaggacatatcgacgaacacagctanatgactgagctaggttgagtatactgacgtacacggtctgtctattactgtgcggaggagggacggggggaggagttagttgacgtaatatgtatattacgtgttgtaacg

SEQ ID NO: 406561 - DNA, 626 bp, Homo sapiens
  misc_feature: GZ8MTXP01BB20U.45.53.E09.1.454.CMB.2.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctggaggcgaagaagccgtggggcctcagtgtaaggtttcctgcaaggcttcgtggatactactttcgctgcccatgccattcagttgggtgccgccgacgggcccccggagaagggcttggagtggagtggggatggatcgaacgctggctacgtggtacacagtaatatcaacaagtaaaacttccgaaggacaggtactaccaacctagtttcgaagggactaattatcgacgaaaccacgacgtacctacagtcggacctaggagtactaagtttgagtactcgtagaaccgacgaccggtcttacggtcttagttacgtggtaagggacggttaggggaaacgggggttacggggggggtaaaggtaagttaggttcggaccgttaaagttaagttaagttaacgtttagttacgttgggttgtaaccgg

SEQ ID NO: 406562 - DNA, 647 bp, Homo sapiens
  misc_feature: GZ8MTXP01BFJHZ.45.53.E09.1.454.CMB.2.raw
  modified_base (229)..(229): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttccngcaaggcttctggatactactttcgctcgcccatcgcctattcagttgggtcgccgccgaccgggcccccgagaacgggtcttaggaggtggagtcggggatgggactcgaacgcgtgggacctacgttggttaacacgtaagaattacttcaaacaagtaaaacttccgaaggacaggactacactattcgaggactatattacgacgaacacacgcctacgagtcggaccgttagagtacgtaggggtttgaacgtactcgtacggacccgacgtacccggtacgtcgttacttacgttacgcggttaaggacgggaagggggaaccgggggttacgggggggtaaggtaagttacggttcggaccgtaaagtaaggtttgtaacgtttacgttacgttgttcgggttaacccggg

SEQ ID NO: 406563 - DNA, 593 bp, Homo sapiens
  misc_feature: GZ8MTXP01DL9RW.45.53.E09.1.454.CMB.2.raw
  modified_base (234)..(234): a, c, t, g, unknown or other
  modified_base (285)..(285): a, c, t, g, unknown or other
  modified_base (439)..(439): a, c, t, g, unknown or other
tcagacgcgatcgacacgaccggtgctcgatttagagagagtgtgttgggtttgggacccaacaaccacatccctcctcagaagcccccagagcacaactcctcaccatggactggacctggaggatccttctttttggtggcagcagccacaggtgtccactcccaggtccagcatgtgcagtcgtggggctggaggcgaagaagccgtggggcctcgagtgtaaggtttccngcaaggtcttctggatacactttcgctgcccatgcctattcagttgggtcncgcccgacgggccccccgaagaagggcttagagtggagtgggatggactcgaacgctggcacgttggtaacacgtaagaattatcaactagtaaaaacttcgaaggacagacgtcacctatttcgaaggtacatatcgacgaacacagacctanagtcgacctggacgtctagggtttagagtacttcgaggaaccgacgtacggtcttagtaccttagttacgtggtcggacggaaggggaagggggacggggggaaggtattacggttcgactaattaaagtgtaagttattacgttgttgtaacg

SEQ ID NO: 406564 - DNA, 703 bp, Homo sapiens
  misc_feature: GZ8MTXP01EGTSU.45.53.E09.1.454.CMB.2.raw
  modified_base (353)..(353): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtcgtggggctggaggcgaagaacgccgtggggcctcgagtgtaaggtttcctgcaaggtcttcgtggatactactttcgctcgcccatcgcctattcagttgggtcgccgaccgacgggccccccggaagaagggtcttaggaggtggagtggggatggatcgaacgntggctagtggtacataagaattatacaactaagtaaaaaacttccgaagggacaaggtaacgtacctaacccgttaagttttaccggaaagggtactaagttaacgttaccggaaccgaaaaccaactaacggtacccttaaacgtacgttacgggaacccttggaagtaccgttaaggggttttagaagttacgttacgtacgaaccgacgtacgggtacttacggttaccttaagttacgtggtcggacgggaagggggaacgggggttaaggggggggtaggtaagttaaggttcggaccttaaagttaaagttcgtaagtttacgttacggttgttcgggtaacgg

SEQ ID NO: 406565 - DNA, 667 bp, Homo sapiens
  misc_feature: GZ8MTXP01A0RRX.45.53.E09.1.454.CMB.2.raw
  modified_base (235)..(235): a, c, t, g, unknown or other
  modified_base (293)..(293): a, c, t, g, unknown or other
  modified_base (325)..(325): a, c, t, g, unknown or other
  modified_base (586)..(586): a, c, t, g, unknown or other
  modified_base (645)..(645): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtcgtggggctggaggacgaagagccgtgggcctgagtgtaacggtttccngacaaggtcttcgtggatactctttcgctcgccctatcgccctattcagttggggtcnccgccgacgggcccccggagaagggtctaggnggtggagttaggggatggtataccgaacggtctggacacgttaggtaccaactagtaactactacaaacgtaaggtaaaaacttcccggaagaacgacgtaaccgtaccaaccttaagtttaccgtaaacgggaccttaattacgttacgaacgtaaccacgtaacgtaccctactacggtacggtaccctaggacgttacgtaggggtttagaagtataccgtacgaaccgacgtacggtccttggtacttacgttacgnggttcggacgggttaggggaacggggaggggggtagtagttagttcgacgtaataagtnttaagtcgttagtgttgtaacg

SEQ ID NO: 406566 - DNA, 659 bp, Homo sapiens
  misc_feature: GZ8MTXP01DR8P3.45.53.E09.1.454.CMB.2.raw
  modified_base (219)..(219): a, c, t, g, unknown or other
  modified_base (286)..(286): a, c, t, g, unknown or other
  modified_base (340)..(340): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctggaggcgaagacgccgtggggcctnagtgtaaggtttcctgcaaggtcttctggatactactttcgctcgcccatcgccattcagttgggcnccgccgacgggcccccggagaagggtcttgagtggagtgggatggatcgaacgngtggctacgttggttacacgtaagtaacttattccaaactaacgtaaaaacttccgaagggactaaggtacgtaccctaacctagttttacggaaagggtactaagttagttaccgacgtaaacaacaacgtacctactagtacggaacctggacgtacgttaaggggtttagaagtacgtcgtacgaccgtacgaccggtacttgttaccttagttacgtggttaaggacgggagggaacgggggttaggggggtaaggtagttacggttcggaacctaagtaagtaagttaagttacgttacgttgttcggtaacgg

SEQ ID NO: 406567 - DNA, 560 bp, Homo sapiens
  misc_feature: GZ8MTXP01AYS44.45.53.E09.1.454.CMB.2.raw
  modified_base (231)..(231): a, c, t, g, unknown or other
  modified_base (244)..(244): a, c, t, g, unknown or other
  modified_base (284)..(284): a, c, t, g, unknown or other
  modified_base (301)..(301): a, c, t, g, unknown or other
  modified_base (344)..(344): a, c, t, g, unknown or other
  modified_base (350)..(350): a, c, t, g, unknown or other
  modified_base (495)..(495): a, c, t, g, unknown or other
tcagacgcgatcgacacgaccggtgctcgatttagagagagtgtgttgggtttggggacccaacaaccacatccctcctcagaagccccagagcacaactcctcaccatggactggacctggaggatccttctttttggtggcagcagccacaggtgtccactcccaggtccagcatgtgcagtcgtggggctggaggcgaagaagcctggggcctcagtgaaggtttccngcaaggtcttcgnggactactactttcgctcgccatcgccattcagttgggcncgccacggcccccgganaaggtctgaggtgagtggatggatcaacgctggcagtgtacanagaatntcaacagaaaaacttccgaaggacagagtacaccgtatttaccgaagggactatacgttacgacgaacactacgaccttacagtcggacctggacgctaagggtttgagtactcgtagacgacgacggtctgtcctagttaccgnggtcgaggagggacggggagggggagtagttagttcgacgtaatagtgtaatagttagtgttgtg

SEQ ID NO: 406568 - DNA, 591 bp, Homo sapiens
  misc_feature: GZ8MTXP01DQ57J.45.53.E09.1.454.CMB.2.raw
  modified_base (237)..(237): a, c, t, g, unknown or other
  modified_base (347)..(347): a, c, t, g, unknown or other
  modified_base (373)..(373): a, c, t, g, unknown or other
  modified_base (436)..(436): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtcgtggggctggaggcgaagaacgccgtggggcctcgagtgtaaggtttccngacaaggtcttcgtggatactactttcgctcgcccatcgcctattcgagttgggcgccgccgacgggcccccggagaagggtctaggaggtggagtgggatgatcaacgntgctactggtacactagtatatcaanagaaaactcgaaggacagactacactattcgaaggactatactcgacgaacacacgtacctanacgtacgactgagtactaagttgagtatcgagacgacgacgtcttgtacttagttacgtggtaacggacgggagggaacgggggttaggggggtaggtagttacgttggaacctaagttaagttaagtaattacgttacgttaaggttcgtaacg

SEQ ID NO: 406569 - DNA, 656 bp, Homo sapiens
  misc_feature: GZ8MTXP01E219K.45.53.E09.1.454.CMB.2.raw
  modified_base (260)..(260): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcaccctggagacgccggcctccatctcctgcagggctagtcagacgcctcctgacatagtaatggatacaactntgtgattggttcctgacgaagaagccgagggtcacgtcctaccgactacgtcctcctgacttcgtagtcggtagggtacttcccgttaccgttccgggtccccgtcccgggggtaccctaacgggtaaccgtaacgggtttcgaagggtcgggtacgtacggtcgggttacaacgggtactaacgtaacgttaactttaaccaacgtaaagtaaaactacgaaggacgtaagggaggttagggacgtagttagggggtaaggttaggtttagggttttacgggttaacttacgtcgactagtacgacgtaaggtccgtagtaacgtaagttcggtcgttaggtaccggttcggacggacgggacaaggcgtaagacgacgaacgtaacgaagtcgg

SEQ ID NO: 406570 - DNA, 679 bp, Homo sapiens
  misc_feature: GZ8MTXP01BU5R4.45.53.E09.1.454.CMB.2.raw
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtcgtgggctggaggcgaagacgccgtggggcctgagtgtaacggtttcctgacaaggtcttcgtgtactactactttcgctcgccctatcgcctattcgagttgggtcgccgtacccggaccgggcccccggaagacgggtcttggagtggagttgggatggactacgaacgtcgtcggacacgttacggtacaacgtaagtaactattacgaacaaacgtaaaacttaccgaaggtaccaacggtacgtacctaacgttacgttttacgaagggtactattacgtaccggaacaacgacaacgtcctaacgtacgtacgggtacctaggaactcgttacgggtttagaaacgttctacgtacggaccgtaccgcggttactcgttacttagtacgttggaacgggtcggaagggtaacgggggacgggggtaggtagttacgttcgaccgtaaagtaagttaacggtaatttacgacgttggtttcgtaacgg

SEQ ID NO: 406571 - DNA, 655 bp, Homo sapiens
  misc_feature: GZ8MTXP01CFFCO.45.53.E09.1.454.CMB.2.raw
  modified_base (218)..(218): a, c, t, g, unknown or other
  modified_base (232)..(232): a, c, t, g, unknown or other
  modified_base (241)..(241): a, c, t, g, unknown or other
  modified_base (584)..(584): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatcctctttttggtggcagcagccacaggtgtccactcccaggtccagcatgtgcagtcgtggggctgaggcgaagaagccgtggggcctnagtgaaggtttccngcaggtctntggatactactttcgctgcccatcgcctattcgagttgggtcgccgcccgacgggccccccggaagaacgggtcttaggaggtggagtggggacttgggactacgaacggtcgtggactacgtaggttaaccaacgtaagtaaactattacaaactaacggtaaaaaacttcccgaaggacctaaaggtaacgtaccaaccgttatttacggagggtactaagttaacgttccgaacgaaacacacgtacctaacagtacggacctagagtctaggggtttgaacggtactcgtagaccgacgaacggtcctgttacctatttacgtggtggacggttagggngggggaaaggggggaggtaagttacgttcggactaagttagtaaggttattagttacgttggttcgtaacg

SEQ ID NO: 406572 - DNA, 671 bp, Homo sapiens
  misc_feature: GZ8MTXP01BJ0ED.45.53.E09.1.454.CMB.2.raw
  modified_base (539)..(539): a, c, t, g, unknown or other
  modified_base (564)..(564): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtctggggctggaggcgaagaagccgtggggcctcgagtgtaaggtttcctgacgaaggtcttcgtggatactcttcgctcgccctatcgctattcgaggttggtacgccgaccgacgggcccccggaagacgggtctggaggtggagtgggatggactacgacgtcgtggctacgtggtacaagacgtaactagttacgaacgtaagtaaaacttccgaagtacaagtacgtaccctacgttacgtttacgagggtaacctagttacctacggactaaacacgtacgtaaccctagtacgtacggaccttagaacgtcgttaggttacgtaagtactacgtaaggcgtaaccgnggttctacgttacgtactttacggngtaagggcggaaagggggtagggggaaacggggggtaagtaacgttacggttcggaacccttaaagtaagttaacggttaattagttaccggttgttaaggtcccgg

SEQ ID NO: 406573 - DNA, 784 bp, Homo sapiens
  misc_feature: GZ8MTXP01BTJ78.45.53.E09.1.454.CMB.2.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccaggtgggatattgtgatgactcagtctccactcctccctcgtcccgtccaccccgtggacgcgcccggcctccatcctccgtgcgaggtctagtcagacgtccctctgactaatagtaataggaactaacaactagtggtaggttagttcggtcctggacaagacgccgaggcctaagtcctaccacgtacgtcctacccgtgtactcgttagtcggtaggtacttcccttaccggttcccggccccggttcccggggtccctaaggtacgtcggttagcgggtacggtacgtacgggttcgggtacgacgggtacctaacgttaagtttaaacgtttaactaaacgttaaagtaaacgtaccgtaaggacggtaacgggtagggtaggggtaaacgggtggttaaggggggtaaggggtttagggttttacggggtttagggttttaacttaggttcgtacgtaaggttcggtaacggttaacgtaccggttaagtaaacggttacgggtttacggtttacccggggtttagggtttaaccggggttttaccggggaacccggggttaacggggttaacccgtaagggtaccggtaaggggtaacggacggttaaaccggtaacggttaacggttccgggg

SEQ ID NO: 406574 - DNA, 495 bp, Homo sapiens
  misc_feature: GZ8MTXP02HQ0NV.45.53.E09.1.454.CMB.2.raw
  modified_base (258)..(258): a, c, t, g, unknown or other
  modified_base (338)..(338): a, c, t, g, unknown or other
  modified_base (389)..(389): a, c, t, g, unknown or other
  modified_base (391)..(391): a, c, t, g, unknown or other
  modified_base (413)..(413): a, c, t, g, unknown or other
tcagacgcgatcgacacgaccggtgctcgatttagagagagtgtgttgggtttgggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctcctgcatagtaatggatacaactangtggatggtcctgcagaagccagggcagtctccacagctcctgatctatctggatctattcgccctcggggtccctgacnggtcagtggcagtgtcagcacagatttacatgaaaatcagcagagtgaggngngagagtgttggttagttagtgnatgagagtagtagacaatagtcgtggtaggttacggtacgacgggaacgaacgacgtacggaggagaacgaaacgaacgtag

SEQ ID NO: 406575 - DNA, 499 bp, Homo sapiens
  misc_feature: GZ8MTXP02G4NU9.45.53.E09.1.454.CMB.2.raw
  modified_base (423)..(423): a, c, t, g, unknown or other
  modified_base (445)..(445): a, c, t, g, unknown or other
  modified_base (476)..(476): a, c, t, g, unknown or other
tcagacgcgatcgacacgaccggtgctcgatttagagagagtgtgttgggtttgggacccaacaaccacatccctcctcagaagccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgcaggcccccgaaagggctgagtggatgggatggatcaagctggcactggtacacagaatattcacagaaattccaggacagagtcaccatttcagggacatattcgcgaaacacagccctacatggacctgagcaagtttgagattcngacgacacggatgtctattacngttgcgagagagggggaggggagtagttagngaagtaagtagatatactgtgtg

SEQ ID NO: 406576 - DNA, 503 bp, Homo sapiens
  misc_feature: GZ8MTXP02IZQZG.45.53.E09.1.454.CMB.2.raw
  modified_base (295)..(295): a, c, t, g, unknown or other
  modified_base (343)..(343): a, c, t, g, unknown or other
  modified_base (364)..(364): a, c, t, g, unknown or other
  modified_base (397)..(397): a, c, t, g, unknown or other
  modified_base (422)..(422): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctcctgcatagtaatggatacaactatgtggattggtcctgcagaagccagggcagtctccanagctcctgatctatcgtggatcctattccgccctccggggtcctgacnggttcagtgcagtgtcagcanagtatttacactgaaaatcagcagagtgagcgngagtagtgttgggtttagttagtgntagtgtgaagtcgtgtacgaagtagtcgtggtacggtttgtacgtacggacgaacgcgtaggagagacgaacgaacgtagg

SEQ ID NO: 406577 - DNA, 579 bp, Homo sapiens
  misc_feature: GZ8MTXP02I30L7.45.53.E09.1.454.CMB.2.raw
  modified_base (342)..(342): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctcctgcatagtaatggatacaactatgtgattggtcctgcagaagccagggcagtctccacagctcctgatctatctgggatcctattccgccctcggggtccctgacnggttcagtgcagtgtcaggcacagtatttacactagaaaatcagcagagtggaggcgtgaggtagtggtttagggggtttattacgtggacaagttgacgtaaaggtcgtagtacgtaaaagttcggttaccgtagggttaacggtttttcgggtacccggtaagggggaaaccccgaaaagggtccgttaacggggaacggaaggaaccggaaaaaccggtaaaccgtttacgggg

SEQ ID NO: 406578 - DNA, 514 bp, Homo sapiens
  misc_feature: GZ8MTXP02JIDF4.45.53.E09.1.454.CMB.2.raw
  modified_base (291)..(291): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccgganagggcttgagtggatgggatggatcaacgctggcactggtacacagaatatcacagaaattccaggacagagtcactatttcagggtacatattcgacgaacacagcctaacatggacctgaagctagtttgagtatcgtagacgacacggctgtctattactgtgcgagacgggacggggggagtagtagttgactaagtaagtagagttatacgtgtgtcg

SEQ ID NO: 406579 - DNA, 505 bp, Homo sapiens
  misc_feature: GZ8MTXP02I4Z32.45.53.E09.1.454.CMB.2.raw
  modified_base (274)..(274): a, c, t, g, unknown or other
tcagacgcgatcgacacgaccggtgctcgatttagagagagtgtgttgggtttgggacccaacaaccacatccctcctcagaagccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtncgccaggcccccggacaagggcttgagtggatgggatggatcaacgctggcactggtacacagatattcacagaaattccaggacagagtcaccatttctagggacatattcgacgaacacagcctacatggactgagacaatttgagatctagacgacacggctgtctattactgtgcgagacggacggggggaggtagtagttggcaacgtaatgattatactgtgtcg

SEQ ID NO: 406580 - DNA, 512 bp, Homo sapiens
  misc_feature: GZ8MTXP02F6CZZ.45.53.E09.1.454.CMB.2.raw
  modified_base (275)..(275): a, c, t, g, unknown or other
  modified_base (290)..(290): a, c, t, g, unknown or other
  modified_base (337)..(337): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtncgccaggcccccganaggcttgagtgatggatggatcaacgctggcactggtacacagaatntcacagaaattccaggacagagtcaccatttcagggacatatcgacgaacacagccgtaacatggacctgacgctagtttgaagcttcgagaccgacacgggtctggtacctaattcgtgtagcgagaggagggggagggagtagtgtacgaagtagtagtagtatactgtagtg

SEQ ID NO: 406581 - DNA, 505 bp, Homo sapiens
  misc_feature: GZ8MTXP02IRMJP.45.53.E09.1.454.CMB.2.raw
  modified_base (291)..(291): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccgganaagggcttgagtggatgggatggatcaacgctggcactggtacacagaatattcacagaaattccaggacagagtcactatttcagggacatattcgacgtaacacacgccacatggacctgagcagtttgagatcgtagacgacacggctgtctatactgtcgacgaggagggacgggggaggatagttgacgaatatagatatactgtgtcg

SEQ ID NO: 406582 - DNA, 530 bp, Homo sapiens
  misc_feature: GZ8MTXP02IYSMV.45.53.E09.1.454.CMB.2.raw
  modified_base (403)..(403): a, c, t, g, unknown or other
tcagacgcgatcgacacgaccggtgctcgatttagagagagtgtgttgggtttggggacccaacaaccacatccctcctcagaagccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccggacaagggcttgagtggatggggatggatcaacgctggcactggttacacagatattcacagaaattccaggacagagtcactatttcgaggacatatcgacgaacacagcctanagtacgaccgtgagctagtttagagtatcgtagacgacgacggtctagtcttatacgtgtcgcggaggacggggacggggggaggtagtagttgacgtaacgtaagtagtattagtacgtgtagtcg

SEQ ID NO: 406583 - DNA, 514 bp, Homo sapiens
  misc_feature: GZ8MTXP02FQDSD.45.53.E09.1.454.CMB.2.raw
  modified_base (292)..(292): a, c, t, g, unknown or other
  modified_base (407)..(407): a, c, t, g, unknown or other
  modified_base (440)..(440): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccgganaagggcttgagtggatgggatggatcaacgctggcacgtggttacacagaatattcacagaaattccaggacagagtcacctatttcagggacatattcgacgaacacagcctanatgacctgagctagtttgagtatctagaccganacggctgtctattactgtgcggagagggacggggggaggagtacgttggacaagtaagtgattatactgtgtcg

SEQ ID NO: 406584 - DNA, 517 bp, Homo sapiens
  misc_feature: GZ8MTXP02ITRV8.45.53.E09.1.454.CMB.2.raw
  modified_base (274)..(274): a, c, t, g, unknown or other
  modified_base (290)..(290): a, c, t, g, unknown or other
tcagacgcgatcgacacgaccggtgctcgatttagagagagtgtgttgggtttggggacccaacaaccacatccctcctcagaagccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtncgccaggcccccgganaagggcttgagtggatgggatggatcaacgctggcactggttacacagatattcacagaaattccaggtacagagtcaccatttacgtagggacatatcgacgaacacagcctacatcgacctgagctagtttgagtatctagacgacgacggctgtctattactgtcgcgtaggacggacggggggaggtagtagtgactaagtaagtgtattatactgtagtacg

SEQ ID NO: 406585 - DNA, 609 bp, Homo sapiens
  misc_feature: GZ8MTXP02F3471.45.53.E09.1.454.CMB.2.raw
  modified_base (274)..(274): a, c, t, g, unknown or other
  modified_base (302)..(302): a, c, t, g, unknown or other
  modified_base (431)..(431): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcaccctggagacgccggcctccatctcctgcagggctagtcagacgcctctgcatagtaatggaatacaactatgtggtattggtccngacagaacgccgaggggcagtctaccanacgtctcctgattctatcgtaggtactcctacgttccggcccgttccggggtccctgacgtgggttcaggttggctaggttcggtacaggtacatagtatttacactagaaatcagacagagtggaggntaggaggtagttgggtttaggggtttattacgtgtactagttacgagtaaggtcgtacgaacgtaaagttcggttaccggttagggttacggttttacgggaacccggtaagggggtaaaccgtaacgggacggtaacgggaacggaaaggaaacggaaaaccggtaacgttacgggg

SEQ ID NO: 406586 - DNA, 495 bp, Homo sapiens
  misc_feature: GZ8MTXP02I0ZMD.45.53.E09.1.454.CMB.2.raw
  modified_base (310)..(310): a, c, t, g, unknown or other
  modified_base (341)..(341): a, c, t, g, unknown or other
tcagacgcgatcgacacgaccggtgctcgatttagagagagtgtgttgggtttgggtgatcaggactcctcagttcaccttctcacaatgaggctccctgctcagctcctgggctgctaatgctctgggtctctggttccagtggggatattgtgatgactcagtctccactctccctgtccgtcacccctggagagccggcctccatctcctgcagggctagtcagagcctcctgcatagtaatggatacaactatgtggattggttcctgcagaagccagggcagtctccacagctcctgatctatcngggatcctatcggccctccggggtcctgacnggttcagtgcagtgtcagcacagatttacactgaaaatcagcagagtggaggctgaggtatggttggggtttattacgtgctatgcaaggtctgacaatgtcctggtagtttggaccgtagggaccaagcgtaggacgagacgaaacgaactgg

SEQ ID NO: 406587 - DNA, 509 bp, Homo sapiens
  misc_feature: GZ8MTXP02JFVWY.45.53.E09.1.454.CMB.2.raw
  modified_base (291)..(291): a, c, t, g, unknown or other
  modified_base (482)..(482): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccgganaggggcttgagtggatgggatggatcaacgctggcactggttacacagaatatcaacagaaattccaggacagagtcacatttcaggacatattcgcgaacacagcctacatgacctgagcagtttgagtatctagacgacacggctgtactattacgtgtgcgagacgggacgggggaggagtagttganaacgtaagtgtattatacttgtgtacg

SEQ ID NO: 406588 - DNA, 506 bp, Homo sapiens
  misc_feature: GZ8MTXP02IQ0XS.45.53.E09.1.454.CMB.2.raw
  modified_base (275)..(275): a, c, t, g, unknown or other
  modified_base (291)..(291): a, c, t, g, unknown or other
  modified_base (322)..(322): a, c, t, g, unknown or other
  modified_base (399)..(399): a, c, t, g, unknown or other
  modified_base (446)..(446): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtncgccaggcccccgganaagggcttgagtggatgggatggatcaacgntggcatggtacacagaatatcacagaaattccaggacagagtcaccatttcaggacatattcgcgaacacagcctanatggacctgagctagttgagatctagacgacacggctgtctattacngtgcgaggaggacggggggagagtagttgacgaacgtaagtagtattatacgtgtgtacg

SEQ ID NO: 406589 - DNA, 512 bp, Homo sapiens
  misc_feature: GZ8MTXP02HPC7T.45.53.E09.1.454.CMB.2.raw
  modified_base (213)..(213): a, c, t, g, unknown or other
  modified_base (291)..(291): a, c, t, g, unknown or other
  modified_base (422)..(422): a, c, t, g, unknown or other
tcagacgcgatcgacacgaccggtgctcgatttagagagagtgtgttgggtttggggacccaacaaccacatccctcctcagaagccccagagcacaactcctcaccatggactggacctggaggatcctctttttggtggcagcagccacaggtgtccactccaggtccagcatgtgcagtctggggctgaggcgaagaagcctggggcctnagtgaaggtttcctgcaaggcttctggatacactttcgctgcccatgccattcattgggtgcgccaggccccccgganaacgggcttgagtggatgggatggatcgaacgctggcacgtggtacacagaatatcaacagaaattccagggacagacgtcaacctatttacgaggacatattcgacgaacacagcctacatcgacctganctagtttgagtatctagacgacacggctgtctatactgtgcgagacggagggggagagtagtgacaagtaatagtatagtactgtagtcg

SEQ ID NO: 406590 - DNA, 526 bp, Homo sapiens
  misc_feature: GZ8MTXP02F6FMA.45.53.E09.1.454.CMB.2.raw
  modified_base (292)..(292): a, c, t, g, unknown or other
  modified_base (411)..(411): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccgganaagggcttgagtggagtgggatggatcgaacgctggcacgtggttacacagaatattacacagaaattccaggacagagtcacctatttcgagggacatattcgacgaacacagcctanatcgacctgagctagtttgagtatcgtgacgacgacggctagtctagttacgtgtcgacgaggacgggacgggggagtagtacgtgacgaagtaatagtattatacgtgtagtcg

SEQ ID NO: 406591 - DNA, 541 bp, Homo sapiens
  misc_feature: GZ8MTXP02JWE9X.45.53.E09.1.454.CMB.2.raw
  modified_base (294)..(294): a, c, t, g, unknown or other
  modified_base (299)..(299): a, c, t, g, unknown or other
tcagacgcgatcgacacgaccggtgctcgatttagagagagtgtgttgggtttgggtgatcaggactcctcagttcaccttctcacaatgaggctccctgctcagctcctggggctgctaatgctctggtctctggttccaggtggggatattgtgatgactcagtctccactctccctgtcccgtcaccctggagcgccggcctcatcctcctgcgagggctagtcagacgccctcctgcatagtaatggatacaactatgtggtattggtcctgcagaagccagggcagtcnccacngctctgatctatcgtggactccgtacgttccggcccgtcccggggtccctaggactgggttcaggttcggctaggtggttacagggcactaagtatttaacactagaaaatcagagagagtggagcgtaggaggtgttaggtttaggggtttattacgtgatagtagacgtaagtctagactaaattcgtcgtggtacgtttcggaccgaggaccgaagcgtagaggagacaaacgacgtgg

SEQ ID NO: 406592 - DNA, 592 bp, Homo sapiens
  misc_feature: GZ8MTXP02H0ABR.45.53.E09.1.454.CMB.2.raw
  modified_base (287)..(287): a, c, t, g, unknown or other
  modified_base (290)..(290): a, c, t, g, unknown or other
  modified_base (343)..(343): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatcctcctgcagggctagtcagagcctctgcatagtatggatacaactatgtggattgtcctgcagagcagggcagtcncanagctctgatctatcgtggatcctagttccggcccgtccggggtccctggaccnggggtttcaggtcgggcctagggttcggttacacggcacgtagtatttacaactagtaaaatacagacgagagtaggaggtcgtaggaggtagttggtttagggtttattacgtgactagtgtacgtaaggtctaggactaaagttcggtaccgttagggttaacggttttcgggacccggtaacggggtaacccgaaaggtaccgttacggggaacgaacggaaccgaaaacggtaaaccgttacggg

SEQ ID NO: 406593 - DNA, 535 bp, Homo sapiens
  misc_feature: GZ8MTXP02HPKTY.45.53.E09.1.454.CMB.2.raw
  modified_base (290)..(290): a, c, t, g, unknown or other
tcagacgcgatcgacacgaccggtgctcgatttagagagagtgtgttgggtttggggacccaacaaccacatccctcctcagaagccccagagcacaactcctcaccatggactggacctggaggatcctctttttggtggcagcagccacaggtgtccactcccaggtccagcatgtgcagtctggggctgaggcgaagagcctggggcctcagtgaaggtttcctgcaaggcttctggatacactttcgctgcccatgccattcattgggtgcgccaggcccccgganaagggcttgagtggatgggatggatcaacgctggcacgtggttacacagaatattcacagaaaacttccaggacagagtccaacctatttcgaagggacatattcgacgaacacagcctacatggacctgagctagtttgagatcgtagacgacacggctggtctattacgtgttcgacggtaggacgggacggggggaaggtacgtagttgacgtaacgtaagtagtattagtactgtacgtcg

SEQ ID NO: 406594 - DNA, 608 bp, Homo sapiens
  misc_feature: GZ8MTXP02JI593.45.53.E09.1.454.CMB.2.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagacgccggcctccatctcctgcagggctagtcagacgcctcctgcatagtaatggatacaactatgtggtattggttcctgcagaagccagggcagtctccacagctcctgactctatcgtggatcctacgttcccggccccgttccggggtccctgacgtagggtttcaggtcggctagggtcggttcaggcacgtagtactttacacttagaaaatcgagacgaggtagtgggaggtcgtaggagggtagttgggtttagggggttttaacttacgttgacgtagttcgacgtaaggttctagtaactaaagttcggttaccgttaggggttacggttttacgggaccgggtaacggggaaccgaaggtacggtaagggaacggaacgaaccgaaaacggtaacgttggg

SEQ ID NO: 406595 - DNA, 523 bp, Homo sapiens
  misc_feature: GZ8MTXP02JLB60.45.53.E09.1.454.CMB.2.raw
  modified_base (296)..(296): a, c, t, g, unknown or other
  modified_base (470)..(470): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctggaggcgaagaagccgtggggcctcagtgaaggtttcctgcaaggcttctggatacactttcgctgcccatgccattcagttgggtgcgccacggcccccgganaagggcttgagtggatgggatggatcaacgctggcacgtggtacacagaatattcacaagaaacttccaggcagacgtacacctatttctagggacatattcgacgaacacacgcctacagtggacctgaagctaagttgagtatcgtagaacgacacggtctgtctattacgngtgcgaggaggacgggggagtagtagttgacaatagtgtattatacgtgtgtg

SEQ ID NO: 406596 - DNA, 515 bp, Homo sapiens
  misc_feature: GZ8MTXP02HDZZB.45.53.E09.1.454.CMB.2.raw
  modified_base (274)..(274): a, c, t, g, unknown or other
  modified_base (290)..(290): a, c, t, g, unknown or other
  modified_base (432)..(432): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctggatacactttcgctgcccatgccattcatgggtncgccaggcccccgganaagagcttgagtggatggatggatcaaacgctggcactggttacaccagaatattcacagaaattccaggacagagtcacctattcgtaggacatattcgacgaaacacagacctacagtcggacctagagtcagtttgagntactgacgacgacggctgtctattactgtcgagaggagggacgggggaggatagttagcgaataatgtaattagtacgtgtgg

SEQ ID NO: 406597 - DNA, 553 bp, Homo sapiens
  misc_feature: GZ8MTXP02GCDX9.45.53.E09.1.454.CMB.2.raw
  modified_base (298)..(298): a, c, t, g, unknown or other
  modified_base (416)..(416): a, c, t, g, unknown or other
  modified_base (421)..(421): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctgaggcgaagaagccgtgggcctcagtgaaggtttcctgcaaggcttctggatacactttcgctcgcccatgccattcagttgggtgcgccgacggcccccgganaaggcttgagtggatgggatggatcgaacgctggcagtggtaacacaagaatatcaacagtaaacttcaggacaggagtaccactatttcgagggactatattacgacgtaacacacncctanagtacggacctgagtctaaggtttgagtatacgtagaaccgacgacggctgttacttattacgtgtcgacggagggaggggacggggggagtagttagtgacgtaagtagtagtattatacgtgtagtacgg

SEQ ID NO: 406598 - DNA, 507 bp, Homo sapiens
  misc_feature: GZ8MTXP02IDGAC.45.53.E09.1.454.CMB.2.raw
  modified_base (279)..(279): a, c, t, g, unknown or other
  modified_base (289)..(289): a, c, t, g, unknown or other
  modified_base (380)..(380): a, c, t, g, unknown or other
  modified_base (400)..(400): a, c, t, g, unknown or other
  modified_base (449)..(449): a, c, t, g, unknown or other
  modified_base (489)..(489): a, c, t, g, unknown or other
tcagacgcgatcgacacgaccggtgctcgatttagagagagtgtgttgggtttgggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcatgggtgcgccncggccccganaaggctgagtggatgggatggatcaacgctggcactggtacacagaatatcacagaaattccaggacagagtcacctatttcaggactatntacgcgaacacacgacctanatgacctgagctagtttgagatctagacgacgacggctgttctattacngtcgcgaggaggacggggggaggagtagttgacaagtaangtattagtactagtgtcg

SEQ ID NO: 406599 - DNA, 535 bp, Homo sapiens
  misc_feature: GZ8MTXP02IXSLD.45.53.E09.1.454.CMB.2.raw
  modified_base (294)..(294): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtctggggctgaggcgaagaagcctggggcctcagtgaaggtttcctgcaaggcttcgtggatacactttcgctgcccatgccattcattggtgcgccacggcccccgganaaggcttgagtggagtgggatggatcgaacgcgtggcacgtggtaacacagaatattcaacagaaacttccaggacaagacgtcacctatttacgaggacatattcgacgaacacagacctacataggacctgagacgtagtttgagtatcgtagacgacgacggctgtcttattacgtgtcgcgaggacgggacgggggagagtagtggactaagtaagtgtaattagtacgtgtagtcg

SEQ ID NO: 406600 - DNA, 575 bp, Homo sapiens
  misc_feature: GZ8MTXP02I4HHY.45.53.E09.1.454.CMB.2.raw
  modified_base (198)..(198): a, c, t, g, unknown or other
  modified_base (276)..(276): a, c, t, g, unknown or other
  modified_base (294)..(294): a, c, t, g, unknown or other
  modified_base (298)..(298): a, c, t, g, unknown or other
  modified_base (303)..(303): a, c, t, g, unknown or other
  modified_base (345)..(345): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagngccggcctccatcctcctgccagggctagtcagacgcctcctgcatagtaatggatacaactatgtggattggttccngcagagccagggcagtcncacngctcngatctatcgtggatcctatccggcccgtccggggtcctgacnggttcagtgcagtgtcaggcacagtactttacactagaaatcagcagagtggaggctaggaggtagttgggtttaggggtttattacgtagtctagtgtacgtaagggtctaggtaactaaacgttcggtccggttagggttaggttttacggggaccggtaacgggggtaacctaacgggtacggttaggggaacggacggaaacgtaaaaccggtaacgtttcggggg

SEQ ID NO: 406601 - DNA, 544 bp, Homo sapiens
  misc_feature: GZ8MTXP02JB3SE.45.53.E09.1.454.CMB.2.raw
  modified_base (340)..(340): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctcctgcatagtaatggatacactatgtgattggtcctgcagaagccagggcagtctccacagctcctgatctatctggatcctatccggccctccggggtcctgacnggttcagtggctagtggttcaggcacagtatttacactagaaaatcagcagagtggagcgtaggaggtagttggttggggtttattacgtgtctagtgacgtaaggtctagtactaaagttcgtaccgttgggttaacggtttcggaccggtaacggggaaccgaaggacgtacgggaagaacgaacgaaaacggtaacgtggg

SEQ ID NO: 406602 - DNA, 514 bp, Homo sapiens
  misc_feature: GZ8MTXP02G5NCF.45.53.E09.1.454.CMB.2.raw
  modified_base (292)..(292): a, c, t, g, unknown or other
tcagacgcgatcgacacgaccggtgctcgatttagagagagtgtgttgggtttggggacccaacaaccacatccctcctcagaagccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccacggcccccgganaagggcttgagtggatggggatggatcaacgctggcactggtacacagaatatcacagaaattccaggacagagtcacctatttcagggacatatcgacgaacacagcctacatggacctgagcagtttgagtatcgtagacgacacggctgtctattactgtgcgaggagggtacggggggaggagtagtgactaagtaatggtattatacgttgtgtacg

SEQ ID NO: 406603 - DNA, 537 bp, Homo sapiens
  misc_feature: GZ8MTXP02JVSIS.45.53.E09.1.454.CMB.2.raw
  modified_base (229)..(229): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttccngcaaggcttctggatacactttcgctgcccatgccctattcagttgggtcgccgcccgacgggccccccggagaaggggccttgaggtggatggggatggatcaacgctggcactggtacacagatattcacagaacttcaggacagatcacctatttccgagggactatattcgacgaacacacgcctaacaagtcggacctgaagctaggtttgatatctagacgacgacggtctgtactattactgtcgacgaggacgggagggggtagagtacgtgactaagtagtgtattatacgtgtagtcg

SEQ ID NO: 406604 - DNA, 554 bp, Homo sapiens
  misc_feature: GZ8MTXP02JEN47.45.53.E09.1.454.CMB.2.raw
  modified_base (274)..(274): a, c, t, g, unknown or other
  modified_base (290)..(290): a, c, t, g, unknown or other
  modified_base (475)..(475): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagtctggggcctcagtgaaggtttcctgcaaggcttctggatacactttcgctgcccatgccattcattgggncgccacggcccccganaaggcttgagtggatgggatggatcaacgctggctacgtggtacacagaatatcacagaaacttccaggacagagtcacctatttctagggactatattcgacgaacacagcctaacatggacctgaagctaggtttagagtactacgtacgacgtacacgggtcttaggtaccttagtttaccnggttaggaccgtaggacggggacggggggaaggtataacggtgaccgaagtaagtacggtaattagtacgtgttagtcg

SEQ ID NO: 406605 - DNA, 498 bp, Homo sapiens
  misc_feature: GZ8MTXP02GBWHR.45.53.E09.1.454.CMB.2.raw
  modified_base (292)..(292): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccgganaagggcttgagtggatgggatggatcaacgctggcactggtacacagaatatcacagaaattcaggacagagtcacatttcagggacatattcgacgaacacagcctacatcggacctgagcagtttgagatctgacgacacggctgtctattactgtgcgaggaggacgggggaggatagtgacaagtaatgattatactgtgtg

SEQ ID NO: 406606 - DNA, 534 bp, Homo sapiens
  misc_feature: GZ8MTXP02HK5AL.45.53.E09.1.454.CMB.2.raw
  modified_base (298)..(298): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagccgtggggcctcagtgaaggtttcctgcaaggcttcgtggatacactttcgctcgcccatcgccattcagttgggtgcgccacggcccccgganaagggcttgagtggagtgggatggatcgaacgctggcacgtggtacacagaatatcaacagtaaacttccgaggacagacgtacacctatttctaagggactatattcgacgaacacacgcctaacatcgacctagacgactaaatttgagtatcgtagacgacacggctgtactattacgtgtcgcgaggacggacgggggagagtagtgacaagtatagtatagtactgtgtcg

SEQ ID NO: 406607 - DNA, 506 bp, Homo sapiens
  misc_feature: GZ8MTXP02F687L.45.53.E09.1.454.CMB.2.raw
  modified_base (274)..(274): a, c, t, g, unknown or other
  modified_base (288)..(288): a, c, t, g, unknown or other
  modified_base (295)..(295): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagagcctggggcctcagtgaaggtttcctgcaaggcttctggatacactttcgctgcccatgccattcattgggncgccaggccccganaggctgngtgatgggatggatcgaacgctggctacgtggtacacagaatatcaacagaaacttcaggacagagtacactatttcgaggactatattcgacgaacacagcctacagtggacctgagctagtttgagtatcgtagacgacacggctgtctatacgtgtgacgaggacggagggggagagtagtgactaataagtgattatacgtgtcgtg

SEQ ID NO: 406608 - DNA, 535 bp, Homo sapiens
  misc_feature: GZ8MTXP02HYA7A.45.53.E09.1.454.CMB.2.raw
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttcgtggatactactttcgctcgcccatgccattcattgggtgccgccacggcccccggagaaagggccttgaggtggagtggggatggatcgaacgctggcacgtggtacacagaatattcacaagaattccaggacagagtacaacctagtttacagggtacatattacgacgaacacagcctacatacgacctgagctagttgagtatctgacgacgacggtctgtactattactgtcgcgaggacggagggggaggagtagttagacgtaagtaatagtattatacgtgtagtcgg

SEQ ID NO: 406609 - DNA, 507 bp, Homo sapiens
  misc_feature: GZ8MTXP02JX09O.45.53.E09.1.454.CMB.2.raw
  modified_base (276)..(276): a, c, t, g, unknown or other
  modified_base (292)..(292): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtncgccaggcccccgganaagggcttgagtggatgggatggatcaacgctggcactggtacacagaatatcacagaaattccaggacagagtcaccatttcagggacatattcgacgaacacagcctacatggacctgagctagtttgagtatcgtagacgacgacggctgtctatactgtgcgagacgggacgggggaggagtagtgcaagtaagtgattatacgtgtgtcg

SEQ ID NO: 406610 - DNA, 529 bp, Homo sapiens
  misc_feature: GZ8MTXP02G4ORA.45.53.E09.1.454.CMB.2.raw
  modified_base (294)..(294): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcagttgggtgcgccacggcccccgganaagggcttgagtggatgggatggatcaacgctggcacgtggtacacagaatattacacagaaaattccaggacagagtacacctatttccgtaagggacattattcgacgaaacacacgcctaacagtacgacctgacgctagtttgagagtctagacgacgacgctgtactattacgtgtcgcgaggaggacggggggaggagtagttgacaagtaatgattatactgtagtcg

SEQ ID NO: 406611 - DNA, 635 bp, Homo sapiens
  misc_feature: GZ8MTXP02GQSR4.45.53.E09.1.454.CMB.2.raw
  modified_base (215)..(215): a, c, t, g, unknown or other
  modified_base (229)..(229): a, c, t, g, unknown or other
  modified_base (283)..(283): a, c, t, g, unknown or other
  modified_base (389)..(389): a, c, t, g, unknown or other
  modified_base (470)..(470): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctgaggcgaagagccgtgggcctnagtgaaggtttccngcaaggcttctggatactactttcgctcgcccatcgccattcagtttggggtcnccgcccgacgggcccccccggaagaacggggtctttggaggtggagtggggatgggatcgaacggcgttggactacgttggtaaccacgaagtaattacttacaanaagtaaaacttccgaggacaggtagtaccaacctagttttcgaagggactattacgttacgacgaaacaacacgccctaanacgtacggacctgacgtactaggtttagagtacttacgtagaaccgacgacggtcgttacgttaccttaaagtttcgtgtacggacggaagggacgggggaaacggggggaggtagtacggttaggacgtaagttaaagtagtaattaagtacgttgtagttacg

SEQ ID NO: 406612 - DNA, 639 bp, Homo sapiens
  misc_feature: GZ8MTXP02G87L1.45.53.E09.1.454.CMB.2.raw
  modified_base (303)..(303): a, c, t, g, unknown or other
  modified_base (361)..(361): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctggaggcgaagaagccgtgggcctcagtgaaggtttcctgcaaggcttcgtggatactactttcgctcgcccatcgccattcagttgggtgcgccgacggccccccgganaagggcttggagtggagtgggatggatcgaacgctggcacgtggtacacagatatcanagaaattccgagacagagtacacctatttacgagggactatattcgcgaacacagacctacagtcggacctagacgacgtagtttagagtatacgtacgaacgacgtacgggtcttacggttaccttaagtttaaccgtggtttacgggaccgggtaaaggggtaacgggggaaaccgggggggggtaaagggttacgttaaaggttcggtaacgtaaaccggttaaaagttacgggttaaaatttaacggttaaccgtttgggttaaggtttaccgg

SEQ ID NO: 406613 - DNA, 509 bp, Homo sapiens
  misc_feature: GZ8MTXP02FNDAR.45.53.E09.1.454.CMB.2.raw
  modified_base (406)..(406): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccggacaagggcttgagtggatgggatggatcaacgctggcactggttacacagaatatcacagaaattccaggacagagtcacctatttctagggacatattcgacgaacacagcctanatggacctgaagcagtttgagtatcgtgacgacgacggctgtctattactgtgcgaggaggacggggggaggagtagttgcaagtaagtgattatactgtgtg

SEQ ID NO: 406614 - DNA, 570 bp, Homo sapiens
  misc_feature: GZ8MTXP02JY3RM.45.53.E09.1.454.CMB.2.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtgtggatattgtgatgactcagtctccactctccctgtccgtcacccctggagagccggcctccatctcctgcagggctagtcagagcctcctgcatagtaatggatacaactatgtggattggttcctgcagaagccgagggcagtctccacagctcctgatctatcgtggactctacgttccggccccgtccggggtccctgacgtagggttcaggtgcaggttcggtcgagcacagtatttacactagaaatcgagcagaggtgggaggcgtggaggtagttgggttttaggggtttaattacgtgacgtagtcggtacgtaaggtctaggaacgtaaagttcggttaccggttgggttacggtttacgggaccggtaacggggaaccgtaaggcgtagggaagacggacgaaaacggtaacg

SEQ ID NO: 406615 - DNA, 530 bp, Homo sapiens
  misc_feature: GZ8MTXP02HXDW1.45.53.E09.1.454.CMB.2.raw
  modified_base (276)..(276): a, c, t, g, unknown or other
  modified_base (293)..(293): a, c, t, g, unknown or other
  modified_base (416)..(416): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtncgccacggcccccgganaaggcttgagtggatgggatggatcgaacgctggcatggtacacagaatatcaacagaaattccaggacaagagtccaacctagtttctaagggactaatattcgacgaaacacagccctaanatcggacctgagctagtttgagtattcagacgacgacggctgtactatactgtgcgaggacgggacggggggagtagtattggacaacgtaatggtaattataacgtgtagtcg

SEQ ID NO: 406616 - DNA, 602 bp, Homo sapiens
  misc_feature: GZ8MTXP02HUYV3.45.53.E09.1.454.CMB.2.raw
  modified_base (231)..(231): a, c, t, g, unknown or other
  modified_base (306)..(306): a, c, t, g, unknown or other
  modified_base (374)..(374): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttcttttggtggcagcagccacaggtgtccactcccaggtccagcatgtgcagtcgtggggctgaggcgaagaagccgtgggcctcagtgtaaggtttccngcaaggtcttcgtggtatactactttcgctcgcccatcgcctattcagttgggtgccgccgacggcccccggaanaaggggcttggaggtggagtgggatggatcgaacgcgtggcaagttggtaacacgaagaatatacaanaagtaaaacttccgaggacaagacgtaccaaccgtatttacgaacgggactagtacttacgacgaaaccacgaacgacctaacaacgtacggaccctgaacgtcgtaaggtttagaagtagtcgtacgaacgaacgacggtcgtacgttacttagttaccgtgtggacggaggacggggacgggggagtagtagtgactaagtaagtagtataatacgtagtagtacg

SEQ ID NO: 406617 - DNA, 524 bp, Homo sapiens
  misc_feature: GZ8MTXP02HGBR5.45.53.E09.1.454.CMB.2.raw
  modified_base (278)..(278): a, c, t, g, unknown or other
  modified_base (295)..(295): a, c, t, g, unknown or other
  modified_base (314)..(314): a, c, t, g, unknown or other
  modified_base (500)..(500): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctgaggcgaagaagcctggggcctcagtgaaggtttcctgcaaggcttctggatacactttcgctgcccatgccattcattgggtncgccacggcccccgganaaggctgagtggatggganggatcaacgctggcacgtggtaacacagaatatcaacaagtaaattccaggacaagacgtaccaacctatttacaagggaacatattcgacgaaacacagcctacatcggacctgagctagtttagagtatcgtagacgacacggctgtctatactgtgcgaggacgggagggggagagtagtganaagtatagtattatactgtgtacg

SEQ ID NO: 406618 - DNA, 604 bp, Homo sapiens
  misc_feature: GZ8MTXP02FT9HY.45.53.E09.1.454.CMB.2.raw
  modified_base (292)..(292): a, c, t, g, unknown or other
  modified_base (416)..(416): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagccgtgggcctcagtgaaggtttcctgcaaggcttctggattacactttcgctgcccatgccattcattgggtgcgccaggcccccgganaaggcttgagtggatgggatggatcaaacggctgggcactggttaacacagaatatcacagaaattccagggacaggatccaactatttacgagggactatagtcgacgaacacacgccctaanagtcggaaccgttgacgtacgttaaggtttacggaatacgtttacgacgaaaccgacgtaacggggtcttacggttactaccgtttaacgtggtacggacggaagggtacgggggaaacggggggtaggtacgtttaaggtcgaacgtaagttaaagtcggtaactttacgtacgtggtcgttaacgg

SEQ ID NO: 406619 - DNA, 593 bp, Homo sapiens
  misc_feature: GZ8MTXP02H5MVQ.45.53.E09.1.454.CMB.2.raw
  modified_base (231)..(231): a, c, t, g, unknown or other
  modified_base (285)..(285): a, c, t, g, unknown or other
tcagacgcgatcgacacgaccggtgctcgatttagagagagtgtgttgggtttgggacccaacaaccacatccctcctcagaagcccccagagcacaactcctcaccatggactggacctggaggatcctctttttggtggcagcagccacaggtgtccactcccaggtccagcatgtgcagtcgtggggctggaggcgaagaagtcgtggggcctcagtgaaggtttccngcaaggtcttcgtggatactactttcgctcgcccatcgccattcagttgggtcnccgccgacggcccccggagaagggcttgaggtggagtgggatggatcgaacgcgtggcacgtggtacacgaagtaatattacaactaagtaaaacttccgagggaaccagaacgtaccaaccttagtttacgtaagggactatagttacgacgtaacacgacgtaccctacagtacgtaccgtagacgacgtagtttagagtatcgtacgaacgacgacggtctcgttactagttacgtggtagacggaggacggggacgggggaaggtagtagtgacgtaagtaagtagtattagtacgtgtagtcg

SEQ ID NO: 406620 - DNA, 584 bp, Homo sapiens
  misc_feature: GZ8MTXP02IRTYF.45.53.E09.1.454.CMB.2.raw
  modified_base (297)..(297): a, c, t, g, unknown or other
  modified_base (364)..(364): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagccgtggggcctcagtgaaggtttcctgcaaggcttcgtggatactactttcgctgcccatgccattcagttgggtgcgccacggcccccgganaagggcttgagtggagtgggatggatcgaacgcgtggcacgtggttaacacaagaatattacaacanaaattccagggacagacgtccaacctatttacgagggactatattacgacgaacacgacgcctaacgactcggacctgagtctagtttcgagtatcgtagacgacgacggctcgttacttattacgtcgttaggcggaagggacggggaaacgggggggaggtaacgttaggttcgacgtaacgttaaagtgtaaacttagtacgttaggttacgttcgg

SEQ ID NO: 406621 - DNA, 549 bp, Homo sapiens
  misc_feature: GZ8MTXP02GDWM9.45.53.E09.1.454.CMB.2.raw
  modified_base (275)..(275): a, c, t, g, unknown or other
  modified_base (290)..(290): a, c, t, g, unknown or other
  modified_base (300)..(300): a, c, t, g, unknown or other
  modified_base (408)..(408): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctgggcctcagtgaaggtttcctgcaaggcttctggatacactttcgctgcccatgccattcattgggtncgcacggcccccganaagggcttgngtgatgggatggatcgacgctggctacgtggttacacgagtaatattcactagaaacttcgaggacagacgtcacctatttcgaggacatatcgacgacacagcctanagtgactgagtctagtttgagtatacgtagacgacgacgggcttacgttacttagttaacgtggttacgacggtaggacgggggaaggggggacggtagtaacgtgacgtaacgtaatggtacttagtacgtgttagtacg

SEQ ID NO: 406622 - DNA, 515 bp, Homo sapiens
  misc_feature: GZ8MTXP02G2INM.45.53.E09.1.454.CMB.2.raw
  modified_base (276)..(276): a, c, t, g, unknown or other
  modified_base (293)..(293): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtctggggctgaggcgaagaagcctggggcctcagtgaaggtttcctgcaaggcttctggatacactttcgctgcccatgcattcattgggtncgccacggcccccgganaagggctttgagtggatgggatggatcaacgctggcactggtacacagaatattcacagaaattccaggaacagagtcacctatttacgagggacagtattcgacgaacacagcctacatgacctgagcaatttagagatactgacgacacggtctcgtatattactgtcgcgaggacgggtacggggggaggagtagtgcgaatagtagatatatgtgtcg

SEQ ID NO: 406623 - DNA, 549 bp, Homo sapiens
  misc_feature: GZ8MTXP02GZZM9.45.53.E09.1.454.CMB.2.raw
  modified_base (230)..(230): a, c, t, g, unknown or other
  modified_base (279)..(279): a, c, t, g, unknown or other
  modified_base (294)..(294): a, c, t, g, unknown or other
  modified_base (322)..(322): a, c, t, g, unknown or other
  modified_base (339)..(339): a, c, t, g, unknown or other
  modified_base (415)..(415): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctgaggcgaagaagcctggggcctgagtgaaggtttccngcaaggcttcgtggatacactttcgctgcccatcgccattcagttgggncgccaggcccccganaggctgagtggatgggatggatcaacgntggctacgtggtaaccnacgtaatactacactagaaacttcgaggacagagtccacctatttcgaagggacatatcgacgaacacgagcctanacgtgacctgagcgtagttgagtatcgtagacgtacgacgctcgtctagttacgtgtcgacgacggaaggggacggggggtaagtacgtaagttggacgtaacgtaagtacgtaattagtacgtggtacgtcgg

SEQ ID NO: 406624 - DNA, 508 bp, Homo sapiens
  misc_feature: GZ8MTXP02J1I0I.45.53.E09.1.454.CMB.2.raw
  modified_base (276)..(276): a, c, t, g, unknown or other
  modified_base (292)..(292): a, c, t, g, unknown or other
  modified_base (399)..(399): a, c, t, g, unknown or other
  modified_base (456)..(456): a, c, t, g, unknown or other
  modified_base (499)..(499): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctgggatacactttcgctgcccatgccattcattgggtncgccaggcccccgganaagggcttgagtggatgggatggatcgaacgctggcactggtacacagaatatcacagaattccaggacagagtcactatttcagggacatacttcgacgtaacacngcctacatcgacctgagcagtttgagtatcgtgacgacgtacggctgtctattacgngtcgcgaggaggacgggggaggatagtgacaataagtgattanactgtgtcg

SEQ ID NO: 406625 - DNA, 551 bp, Homo sapiens
  misc_feature: GZ8MTXP02GXDI8.45.53.E09.1.454.CMB.2.raw
  modified_base (297)..(297): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctgaggcgaagaagcctggggcctcagtgaaggtttcctgcaaggcttctggatacacttttcgctgcccatgccattcagttgggtgcgccgacggcccccgganaagggcttggagtggatgggatggatcaacgctggcacgtggtacacagaatatcaacagtaaattccaggacagacgtacacctatttacgtaagggactattacttacgacgaaacacgagaccctacatcggacctgaagctagtttgatactcgtagacgtaacgcggctgtctagttacgtgtgacggaaggaggggtacggggggaggtagtacgtgactaacgtagtacgtattatacgtgttcgtg

SEQ ID NO: 406626 - DNA, 520 bp, Homo sapiens
  misc_feature: GZ8MTXP02FV4ZN.45.53.E09.1.454.CMB.2.raw
  modified_base (293)..(293): a, c, t, g, unknown or other
  modified_base (406)..(406): a, c, t, g, unknown or other
  modified_base (414)..(414): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccacggcccccgganaagggcttgagtggatggggatggatcgaacgctggcacgtggttaacacagaatattacaacagaaattccaggacagagtcacctatttcagggacatattcgacgaacanacgcctanatggacctgacgctagtttgagatcgtagacgacgacgctgtctattactgtgcgagacgggacggggggaggagtagtgacaagtatgtattagtactgtagtcg

SEQ ID NO: 406627 - DNA, 569 bp, Homo sapiens
  misc_feature: GZ8MTXP02FXWQP.45.53.E09.1.454.CMB.2.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagccgtggggcctcagtgaaggtttcctgcaaggcttctggatacactttcgctgcccatgccattcagttgggtgccgccgacggccccccggaagaacgggctttggaggtggagtggggatggatcgaacgctggcacgtggttacacagtaatatcaacaagtaaattccaggacaggacgtaccacctatttacgaggactagtacttcgacgaacacagacctacatacggacctgacgtacgtaggtttacgagtactacgtagaaccgacgacggtctagtaccttagttacgtgtacgcggaggacggggagggggaggtagtagtgacgaacgtaagtgtattagtacgtgtagtcg

SEQ ID NO: 406628 - DNA, 592 bp, Homo sapiens
  misc_feature: GZ8MTXP02JHHLH.45.53.E09.1.454.CMB.2.raw
  modified_base (277)..(277): a, c, t, g, unknown or other
  modified_base (294)..(294): a, c, t, g, unknown or other
  modified_base (359)..(359): a, c, t, g, unknown or other
  modified_base (411)..(411): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtncgccacggcccccgganaagggcttgagtggagtgggatggatcgaacgcgtggcagtggttaacacagtaatatcaactanaaacttccaggacaggactcactatttcaggacatattcgacgaacacgacncctaacagtacggacctagacgctaaggtttagaagattacgtagaaccgacgaacgggtccttaggtaccttaattacgtggttcgacgggtaagggaagggggaaacggggggggaggtagttacggttagaccgtaagttaaagtacggtactttaagtacgttaggttagttaccgg

SEQ ID NO: 406629 - DNA, 648 bp, Homo sapiens
  misc_feature: GZ8MTXP02JNDCS.45.53.E09.1.454.CMB.2.raw
  modified_base (233)..(233): a, c, t, g, unknown or other
  modified_base (245)..(245): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtcgtggggctggaggcgaagagccgtgggcctgagtgtacggtttccngcaaggtcttcnggatactactttcgctcgcccatcgcctattcgtagttgggcgcccgaccgaccgggacccccggaagaacggtcttggaggtggagtgggagtggtatcgaacggtctggactagtcgtaacaagagtattacgtacaacgttaagtaaccttcgagacaggtacctcaacttagtttcgaaaggtactagttacgtacgaacaacacgacgtaccctaagacgtcgtaccgtagtaccgtagttaggtttacggaagttactcggtaacgaccgtaacgccgttgtacggttaccttagttcgtaggttacggagggtaacgggggtacgggggaagggggtagtaacgttagttacgtaacgtaagttaagtacgtaagttacgttgtacggtagtccgg

SEQ ID NO: 406630 - DNA, 551 bp, Homo sapiens
  misc_feature: GZ8MTXP02FZI9P.45.53.E09.1.454.CMB.2.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccacggcccccggacaagggcttgagtggatgggatggatcaacgctgggcactggttaacacagtaatatcaacagaaacttccaggacagacgtcacctatttacagggacatattcgcgaacacacgcctacatcggacctgagcgtagtttgagatcgtagaccgacgacggcttcggtcttaattcgtggtggtaccgggagggggaacggggggagggagttaacgttggcctaagtaagtgtaactttactagtggtcgttgaccg

SEQ ID NO: 406631 - DNA, 557 bp, Homo sapiens
  misc_feature: GZ8MTXP02F3L3I.45.53.E09.1.454.CMB.2.raw
  modified_base (349)..(349): a, c, t, g, unknown or other
  modified_base (406)..(406): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctcctgcatagtaatggatacaatatgtggtattggttcctgcagaagccagggcagtctccacagctcctgatctatctgggactcctagttccggcccgtccggggtccctgacnggttcagtgcagtggtcagcacagtattacactagaaaatcagacgagagtggaggngtagaggtagttggtttaggggtttattacgtgacgtagtagacgtaaaggtcgtagacgtaaagttcggttccgttagggttacggttttcgggaccgtaacgggggacccgaaaggtcgtagggagaacgaacgtaaaacgacgtacgg

SEQ ID NO: 406632 - DNA, 581 bp, Homo sapiens
  misc_feature: GZ8MTXP02JV6ZS.45.53.E09.1.454.CMB.2.raw
  modified_base (362)..(362): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagccgtggggcctcagtgaaggtttcctgcaaggcttctggatacactttcgctgcccatcgccattcagttgggtgcgcccgacgggccccccggagaacgggccttgaggtggagtggggatggatcgaacgctggcactggtacacagaatatcaanagaaattccagacagatcactatttcgagggactatattcgacgaacacagccctaacacgtggacctgagtactaagtttagagtatcgtagaccgtaacgacggtctgttacttaattacgtggttcggacggaaaggggacgggggaacgggggggtagggtaacttaggttacgaccgtaaagttaagttagtaattagtacgttaggtcgtacg

SEQ ID NO: 406633 - DNA, 560 bp, Homo sapiens
  misc_feature: GZ8MTXP02G84Z8.45.53.E09.1.454.CMB.2.raw
  modified_base (431)..(431): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctggaggcgaagaagccgtggggcctcagtgaaggtttcctgcaaggcttcgtggatacactttcgctcgcccatcgccattcagttgggtgccgccacggcccccggagaacgggcttggagtggatgggatggatcgacgctggcacgtggtacacgagtaatatacaacaagtaaacttccgaggacaggacgtaccacctatttacgagggactatactcgacgaacacagcctanatacgacctgacgtcgtagtttgagtatcgtagacgacgacggtctgtacttagttacgtgtcgacggaggacggggacgggggagtagtagttgactaacgtaagtagtattagtacgttagtgtacg

SEQ ID NO: 406634 - DNA, 640 bp, Homo sapiens
  misc_feature: GZ8MTXP02GE684.45.53.E09.1.454.CMB.2.raw
  modified_base (274)..(274): a, c, t, g, unknown or other
  modified_base (296)..(296): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatcctcctgcagggctagtcagacgcctcctgcatagtaatggatacaactatgtggattggtccngcagagccagggcagtctccanagcctcctgacttctatcgtagggtattcccgttacgttcccggcccccgttcccgggggtcccctaggacgtacggggtttccagggttcggaccgtagggttcggttaccgagggacctaaccgtaaaggttaactttttaaacaaacgttaagtaaaaaactccgaaaggacgaagggtaagggtgggaaagggtcgtagggtaagggttagtttagggttttagggggtttaattacgtggactagtagacgtaaaggtctagactaaagttcgtccgttagggtacgtttcggaccggagggtaccaaggcgtaggacgacgacgaaaacgtacgtagg

SEQ ID NO: 406635 - DNA, 559 bp, Homo sapiens
  misc_feature: GZ8MTXP02JQU39.45.53.E09.1.454.CMB.2.raw
  modified_base (277)..(277): a, c, t, g, unknown or other
  modified_base (294)..(294): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagccgtggggcctcagtgaaggtttcctgcaaggcttctggatacactttcgctgcccatgccattcattgggtncgccacggcccccgganaacgggcttgagtggatgggatggatcgaacgctggcacgtggtacacagtatattcaactagaaacttccgaggacagacgtcactatttcagggacatattcgacgaacactacgcctacagtgacctgacgcgtagtttagagtatacgtacgaacgacacggtctcgtacttatttacgtgttacgacggaggacggggacgggggggaggtacgttagtgtacgaacgttaagtaggtacttagtaactggtacgttcgg

SEQ ID NO: 406636 - DNA, 571 bp, Homo sapiens
  misc_feature: GZ8MTXP02HYI92.45.53.E09.1.454.CMB.2.raw
  modified_base (276)..(276): a, c, t, g, unknown or other
  modified_base (294)..(294): a, c, t, g, unknown or other
  modified_base (298)..(298): a, c, t, g, unknown or other
  modified_base (416)..(416): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtcccgtcaccccgtggagacgccggcctccatcctcctgcagggctagtcagcgcctcctgcatagtaatggatacaactatgtgtattgttccngcagagccagggcagtcnccancgctctgatctatcgtggtatcctacgttccggcccgtccggggtcctgactggttcaggtgctaggtgtcaggcatagtattacactaagtaaaactcgaagacgaggagtgggagngtaggaggttaagtttgggtttaggggtttacttagtgacgtagtcgacgtaaggtcgtacgtacgtaagttcggtaccgttagggttacggtttcgggaaccggaacggggaaccgtaaggcggtaggaggaacgaacgaaacggtaacgtcgg

SEQ ID NO: 406637 - DNA, 544 bp, Homo sapiens
  misc_feature: GZ8MTXP02H9984.45.53.E09.1.454.CMB.2.raw
  modified_base (272)..(272): a, c, t, g, unknown or other
  modified_base (294)..(294): a, c, t, g, unknown or other
  modified_base (300)..(300): a, c, t, g, unknown or other
  modified_base (339)..(339): a, c, t, g, unknown or other
tcagacgcgatcgacacgaccggtgctcgatttagagagagtgtgttgggtttgggtgatcaggactcctcagttcaccttctcacaatgaggctccctgctcagctcctggggctgctaatgctctgggtctctggttccagtggggatattgtgatgactcagtctccactctccctgtccgtcacccctggagacgccggcctccatcctcctgcagggctagtcagacgcctctgcatagtaatggatacaactatgtgattggtccngcagagccagggcagtctccanagctcngatctatcgtggctctagttccggcccgtccggggtccnggactggttcagtggctaggtcggtacagcacagtatttacactagaaactcagtacgagtagaggagctaggagtagttggttaggggtttatgtagacgtagtgtacgtaggtctagtactaaagtcggttacgtaggttagtttcgggacggtacgggtaaccgaaggtacgtaggaacgacgtacgaaaacgtacgtacgg

SEQ ID NO: 406638 - DNA, 611 bp, Homo sapiens
  misc_feature: GZ8MTXP02GTMFS.45.53.E09.1.454.CMB.2.raw
  modified_base (215)..(215): a, c, t, g, unknown or other
  modified_base (293)..(293): a, c, t, g, unknown or other
  modified_base (354)..(354): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctnagtgaaggtttcctgcaaggcttctggatacactttcgctgcccatgccattcattgggtgcgccacggcccccgganaagggcttgaggtggagtgggatggatcaacgctggcacgtggtacacagtaatattcaanagaaacttccgaggacagacgtcacctagtttcgtaagggacattattcgacgtaaacacacgacccttacgaagttcgggaaccttaggacgtcgtaaggttttcgaagtacttcgttagaaccgaaccgtacgggtccttaggttccttaagtttacgtggttacggacggtaagggacgggggtaacgggggggagggtaagttacggttacgacgtaaacgttaagttagtaatttacgtacttggttgtacg

SEQ ID NO: 406639 - DNA, 537 bp, Homo sapiens
  misc_feature: GZ8MTXP02IYJN2.45.53.E09.1.454.CMB.2.raw
  modified_base (422)..(422): a, c, t, g, unknown or other
  modified_base (432)..(432): a, c, t, g, unknown or other
tcagacgcgatcgacacgaccggtgctcgatttagagagagtgtgttgggtttggggacccaacaaccacatccctcctcagaagccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccacggcccccggacaagggcttggagtggagtggggatggatcaacgctggcacgtggttacacagtaatattcaacaataaacttccagggacagacgtcaaccgtatttcgtaagggacagtattcgacgaacacagcctanatcgactgancgagtttacgagatcgtagacgacacgctgtctatctgtgcgaggacgggtacgggggaggtagtaagttgacgtaactaagtagtacttagtacttgttgtacg

SEQ ID NO: 406640 - DNA, 559 bp, Homo sapiens
  misc_feature: GZ8MTXP02F5IR2.45.53.E09.1.454.CMB.2.raw
  modified_base (217)..(217): a, c, t, g, unknown or other
  modified_base (294)..(294): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctgaggcgaagaagccgtggggcctnagtgaaggtttcctgcaaggcttctggatacactttcgctgcccatcgccattcattgggtgcgccaggcccccganaagggcttgagtgatgggatggatcaacgctggctacgtggttacacagaaatgtacaacagtaaaacttccagggacagagtccacctaattttcgaagggactatacttacgacgaacaacacgcccttaacaacgtcggaaacccgtggaaacgtctaaggtttagagtatacgtagaacgacgacggctgtactatactgcgtcgaggacgggacgggggagagtagtagataacgtaagtgaagttatacgtagtgtacg

SEQ ID NO: 406641 - DNA, 731 bp, Homo sapiens
  misc_feature: GZ8MTXP02GDY19.45.53.E09.1.454.CMB.2.raw
  modified_base (231)..(231): a, c, t, g, unknown or other
tcagacgcgatcgacacgaccggtgctcgatttagagagagtgtgttgggtttgggacccaacaaccacatccctcctcagaacgcccccagagcacaactcctcaccatggactggacctggaggatccttctttttggtggcagcagccacaggtgtccactcccaggtccagcatgtgcagtcgtggggctggaggcgaagagccgtgggcctcagtgaaggtttccngacaaggtcttctggatacactttcgctcgcccatcgccattcagttgggtcgccgccgacggccccccggaagaacgggtcttggaggtggagtgggatggatcgaacgtcgtggactacgtggtaacacagaatattcaactaagaaacttaccgagggacaggtaacgtcctaaaccgttagtttaccgaaggggtacctaagtttacgttaccggaaccgaaaccgaaccgtacggtaccccttaaacgtaacggttacgggaacccgtagggtaaacgtccggtttaaaggttttacggggaattaacgtttaccggtaaggaaaccccggaacggtaacccgggttcgttacggttaccttaagttttaaccgtcgggttacggtaccggggaaagggggtaaccggggggtaaacggggggaacgggtacgttaacggttacggacctaaagttaaagtaggttaatttaacgttacgttggttacgttacgg

SEQ ID NO: 406642 - DNA, 618 bp, Homo sapiens
  misc_feature: GZ8MTXP02JL4TU.45.53.E09.1.454.CMB.2.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctgaggcgaagaagccgtggggcctcagtgtaaggtttcctgcgaaggcttcgtggatacactttcgctcgcccatcgccattcagttgggtcgcgccgacggccccccggagaacgggcttggagtggagtgggatggatcgaacgctggctacgtggttaacacgaagtaatacttacaacaagtaaacttccgaggaacaagacgtaccaacctagtttacgaagggactattacgttcgacgaaacacacgcctacagtcggacctgagcgtaagttgagtatacgtagaaccgacacgggtacttacgtaccttaagtttacgtggttaggacggtaaagggaagggggtacggggggaaggtaacgttagtggtaacgtaacgttaaagtacgttaaattaagtacgttggtacgtacggg

SEQ ID NO: 406643 - DNA, 559 bp, Homo sapiens
  misc_feature: GZ8MTXP02G1KQZ.45.53.E09.1.454.CMB.2.raw
  modified_base (361)..(361): a, c, t, g, unknown or other
  modified_base (417)..(417): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctgaggcgaagaagccgtggggcctcagtgaaggtttcctgcaaggcttctggatactactttcgctgcccatcgccattcagttgggtgccgccgacggcccccggagaacgggcttgaggtggagtgggatggatcgaacgctggcacgtggtacacagaatatcanaagaaattcaggacagagtacactattcgaggacattatcgacgaacacagcctanatcggacctgagctagttgagtatcgtagacgacgacggtctgtacttattacgtgtcgacggtaagggacggggacggggggtaaggtacgtagttggacgtaacgtaagttacgtaacttagtacgttaggttagtacgg

SEQ ID NO: 406644 - DNA, 586 bp, Homo sapiens
  misc_feature: GZ8MTXP02GXHRC.45.53.E09.1.454.CMB.2.raw
  modified_base (277)..(277): a, c, t, g, unknown or other
  modified_base (293)..(293): a, c, t, g, unknown or other
  modified_base (338)..(338): a, c, t, g, unknown or other
  modified_base (413)..(413): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatcgccattcattgggtncgccacggcccccganaaggcttgagtggatgggatggatcaacgctggcacgtggtacanagatattcacagaaacttccaggacagacgtacacctatttcgagggtacattatcgacgaacacgacgacctanacgtcgggacctgacgtctaggtttgagtactcgtagaccgacacgggtctacggttacttacgttacgtggtagtacggaagggtacgggggaaacggggggtaggtacgttaaagttcggaaccgtaagttaaacgtaggtaacttaacgtaacgttcggttgttaaccgg

SEQ ID NO: 406645 - DNA, 554 bp, Homo sapiens
  misc_feature: GZ8MTXP02IAKIT.45.53.E09.1.454.CMB.2.raw
  modified_base (438)..(438): a, c, t, g, unknown or other
tcagacgcgatcgacacgaccggtgctcgatttagagagagtgtgttgggtttggggtgatcaggactcctcagttcaccttctcacaatgaggctccctgctcagctccttgggctgctaatgctctgggtctctggttccagtggggatattgtgatgactcagtctccactctccctgtccgtcaccctggagagccggcctccatctcctgcagggctagtcagagcctcctgcatagtaatggatacaactatggtggattggttcctgcagaagccagggcagtctccacagcctctgatctatcgtggactctagttcccggccctccggggtccctgactggttcagtggcagtggtcaggcacagtattacactagaaatcagcagagtggagcgtggaggtagttggttaggggtttattacgtaggntagtgtacgaaggtctacggactaaagtcgttccggttagggttagggttttacggaccggtaacggggaaccgaaggacggttacggaggacgaaccgaaaacgtaaccgtcggg

SEQ ID NO: 406646 - DNA, 605 bp, Homo sapiens
  misc_feature: GZ8MTXP02H021Z.45.53.E09.1.454.CMB.2.raw
  modified_base (215)..(215): a, c, t, g, unknown or other
  modified_base (229)..(229): a, c, t, g, unknown or other
  modified_base (240)..(240): a, c, t, g, unknown or other
  modified_base (277)..(277): a, c, t, g, unknown or other
  modified_base (294)..(294): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctnagtgaaggtttccngcaaggcttcnggatactactttcgctgcccatcgccattcattgggngcgccacggcccccganaggctgagtggatgggatggatcgaacgctggcacgtggtacacagaatacttcaacagtaaattccagggacagacgtccaacctatttcgagggactatacttacgacgaaacacacgacctaacagtcgggaccttggaacgtcgtaagtttaggagtattacgtacggaaccgacgaacgggtccttaggttaccttaagttacgttggtaggacggtaaaggggacggggaacgggggggaaggtagttacggttacggaccgtaacgttaagtacggtaactttagttaacgttggttacgtcgg

SEQ ID NO: 406647 - DNA, 635 bp, Homo sapiens
  misc_feature: GZ8MTXP02GLPH9.45.53.E09.1.454.CMB.2.raw
  modified_base (244)..(244): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtgggatattgtgatgactcagtctccactcctccctgtcccgtcaccccgtggagacgcccggcctccatcctcctgcgagggctagtcagacgtcctcngacatagtaatggaatacgaatgtgtgtattcggtctgacaagaacgccgagggcctagtcctaccacgtcgaccttccgtagtacttactagttcggtagggacttcccgtaccgttcccgggccccggttccggggtacccctagtacgtggttccgaggtcggacgtaggttcggtacgacggtacaacgttaagttactttaacgaacttaagaaactgacgagaagaggtaggagacgtaggaggttagttagggtttagggtttatacgtagtagtagtacggagtaggtacgtacgtaacgtaagtcggttacggttacgggttacggtttacgggacggtaacgggaacgtaaggacgtaggaagaacgaacgaagtacgtgg

SEQ ID NO: 406648 - DNA, 599 bp, Homo sapiens
  misc_feature: GZ8MTXP02JFPOF.45.53.E09.1.454.CMB.2.raw
  modified_base (293)..(293): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagcctggggcctcagtgaaggtttcctgcaaggcttctggatactactttcgctgcccatgccattcattgggtgcgccacggcccccgganagggcttgagtggagtgggatggatcgaacgcgtggcacgtggtaacacagaatatcaactagaaacttcaggacagagtaccacctatttacgagggacatattcgacgaacacagacctacacgtacggacctgagtctaggtttgagtatacgtagtacggaccacgggtcttggttacttaacgttacgtggtacggtacggaagggtaacgggggaaacgggggggaaggtaacggttaagttcggtacgtaacgttaaagttacggtaaacgtttaagtaacgttaggttacgttaccgg

SEQ ID NO: 406649 - DNA, 540 bp, Homo sapiens
  misc_feature: GZ8MTXP02GIQ4J.45.53.E09.1.454.CMB.2.raw
  modified_base (229)..(229): a, c, t, g, unknown or other
  modified_base (296)..(296): a, c, t, g, unknown or other
  modified_base (464)..(464): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagccgtgggcctcagtgaaggtttccngcaaggtcttctggatacactttcgctgcccatcgccattcagttgggtgcgccacggcccccgganaagggcttgagtggatgggatggatcgaacgctggcacgtggtacacgaagtaatattcaacagtaaacttccgaggacaggactccactatttacgaggactatacttcgacgaacacacgacctacagtcgacctgagctagtttagagatcgtagacgacgacgntcgtctattacgtgtcgacgaggacggggtagggggagtagtagtgactaacgtaatagtattagtactgtgtacg

SEQ ID NO: 406650 - DNA, 610 bp, Homo sapiens
  misc_feature: GZ8MTXP02G00YG.45.53.E09.1.454.CMB.2.raw
  modified_base (241)..(241): a, c, t, g, unknown or other
tcagacgcgatcgacacgaccggtgctcgatttagagagagtgtgttggggtttggggtgatcaggactcctcagttcaccttctcacaatgaggctccctgctcagctcctggggctgctaatgctctgggtctctggttccaggtggggatattgtgatgactcagtctccactctccctgtccgtcacccctggagagccggcctccatcctcctgcagggctagtcagacgcctccngcatagtaatggatacaactatgtaggtattcggttcctgacagaagccagggcagtctccacagctcctgactctatcgtaggatcctacgtccggcccgtccggggtcctagacgtggtcaggtggcctaggttggttacaggctacgtagttactttaacactaagaaaatcagacgtaggagtggaggtctaggaggtagttggtttagggtttatacgtgactagtgacgtaagtcgtacgtacgtaaagttcggtaccggttaggttacggttttaccgggaccggtaacgggggtaacccaagggtaccgttaagggggaaaccggaacggtaaaccgaaaacggttaaaccggtttcgggg

SEQ ID NO: 406651 - DNA, 583 bp, Homo sapiens
  misc_feature: GZ8MTXP02IP5XB.45.53.E09.1.454.CMB.2.raw
  modified_base (290)..(290): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtcgtggggctggaggcgaagaagccgtggggcctcagtgtaaggtttcctgacaaggtcttcgtggatactactttcgctcgcccatcgcctattcagttgggtnccgccgacggcccccggaagagggcttgagtggagtgggatggactacgaacgtcgtggacctacgttggtaacacgtaagtaatacttacaacgtaagtaaacttccgaggtacagacgtaccactagtttacgaggactatatacgacaacacagtacctacagtcgactagagtactagttgaagtatcgtacgacgacgacggtctagttactattacgtgtcgacggtagggacggggaagggggagtagtagttcgacgtaagtagtagtactatacgtggtagtcg

SEQ ID NO: 406652 - DNA, 530 bp, Homo sapiens
  misc_feature: GZ8MTXP02FV0ED.45.53.E09.1.454.CMB.2.raw
  modified_base (270)..(270): a, c, t, g, unknown or other
  modified_base (288)..(288): a, c, t, g, unknown or other
  modified_base (291)..(291): a, c, t, g, unknown or other
  modified_base (297)..(297): a, c, t, g, unknown or other
  modified_base (361)..(361): a, c, t, g, unknown or other
  modified_base (394)..(394): a, c, t, g, unknown or other
  modified_base (425)..(425): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcgagggctagtcagagcctctgcatagtaatggatacaatatgtgattggtccngcagaagcagggcagtcncanagctcngatctatcgtggatcctagttccggcccgtccggggtcctgactggtcagtgcagtgtcagcanagtatttacactagaaaatcagcgagagtgagntaggagtagttggttagggtttatacgtganagtgtagtagtagtagtacgtaagtacgttacggtaggttacggttacggtacggtacgggaacgaacgacggtacggacggaacgaacgtaaacgtaacgtacg

SEQ ID NO: 406653 - DNA, 591 bp, Homo sapiens
  misc_feature: GZ8MTXP02IREU7.45.53.E09.1.454.CMB.2.raw
tcagacgcgatcgacacgaccggtgctcgatttagagagagtgtgttgggtttgggggaccaacaaccacatccctcctcagaagccccagagcacaactcctcaccatggactggacctggaggatcctcttttggtggcagcagccacaggtgtccactcccaggtccagcatgtgcagtctggggctgaggcgaagaagcctgggcctcagtgaaggttcctgcaaggcttctggatacacttttcgctcgcccatcgccattcattgggtgcgccacggcccccggacaacggggcttggaggtggagtggggatggatcgaacggctggctactggttacacagaatattacacagaaattccagggtacagagtccacctatttctagggactatattcgacgaactacagccctaacatcggactgagctagtttagacgtatcgtacggaaccgacgaacggggtcttaggtacctttaagttacgtggttaggacgggaggtacgggggaaacggggggggaggtacgttaagtttcggacgtaacgttaagtagtaacgttaattaacgtggttacgtcgg

SEQ ID NO: 406654 - DNA, 621 bp, Homo sapiens
  misc_feature: GZ8MTXP02I2V2P.45.53.E09.1.454.CMB.2.raw
  modified_base (282)..(282): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtcgtggggctgaggcgaagaagcctggggcctcagtgaaggtttcctgcaaggcttctggatactactttcgcttcgcccatcgcctattcagttgggtncgccgacggcccccggacaagggcttgagtggagtgggatggatcgaacgctggcacgtggtacacgagtaatattcaacagtaaaacttccagggtacaaggtacgtaccaacctatttacgagggtaactattacgttacgacgtaaacaccacgaccctaacagtacgggaacctggacgaccgtaggtttagagtactacgtagaaccgacgaccggtctacggttacttaacgttacgttcgtaggtacggagggagggggtaaacggggggtaaggtacgttacgttcgaaccgtaagttaaagtgttaaacttagtacgttggttacgtacg

SEQ ID NO: 406655 - DNA, 614 bp, Homo sapiens
  misc_feature: GZ8MTXP02HFITS.45.53.E09.1.454.CMB.2.raw
  modified_base (217)..(217): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctgaggcgaagaagccgtgggcctnagtgaaggtttcctgcaaggcttcgtaggatactctttcgctcgcccatcgccattcgagttggggtcgccgcccgacgggccccccggagaacggggtctttaggaggtggagtgggatggatcgaacgctggcacgtggtaacacgagaattatcaacaagtaaacttcgaggacaagacgtacctaacctagttttacgaagggtaacagttacgttacgaacgaaacaacgtacgacctaacgagtacggacctagacgtcgtaagtttgagattcgagacgaacgacggtacgtgttactagttacgtggtacgacggagggacggggacgggggaaggtagtacgttagacgtaagttaaagtacggtaacttagtacgtcgttagtccgg

SEQ ID NO: 406656 - DNA, 665 bp, Homo sapiens
  misc_feature: GZ8MTXP02GA5UK.45.53.E09.1.454.CMB.2.raw
  modified_base (218)..(218): a, c, t, g, unknown or other
  modified_base (232)..(232): a, c, t, g, unknown or other
  modified_base (244)..(244): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctggaggcgaagaagccgtgggcctnagtgaaggtttccngcaaggtcttcnggatacactttcgctcgcccatcgcctattcagttggggtcgccgcccgaaccggcccccccggaagaacggggcctttggacggtggagtggggatggataccgaacggctgggcctacgtggttaaccacgtaagtaaattacttacaactaagtaaaacttccgagggaacagtacgtacaacccttaagtttcgtaaagggactattaacgttacgaacgaaacaaccgacgaccctaacgacgtacggtaccctagtacgactaggtttagaacgtacttacgtacgaaccgacggtaaccggtcttacggttacttaacgtttacgtcgttaggacggagggacgggggaacggggggtaggtaacgttagtcgaacgtaattaagtagttaacgttagtacgttagtcggtacg

SEQ ID NO: 406657 - DNA, 610 bp, Homo sapiens
  misc_feature: GZ8MTXP02IKFTE.45.53.E09.1.454.CMB.2.raw
  modified_base (289)..(289): a, c, t, g, unknown or other
tcagacgcgatcgacacgaccggtgctcgatttagagagagtgtgttgggtttggggacccaacaaccacatccctcctcagaagccccagagcacaactcctcaccatggactggacctggaggatcctcttttggtggcagcagccacaggtgtccactcccaggtccagcatgtgcagtcgtggggctgaggcgaagaagcctggggcctcagtgaaggtttcctgcaaggtcttctggatactactttcgctgcccatgccattcattggtgcgcaggccccganagggctgagtggatgggatggatcaagctgcactggtacacagaatatcacagaaacttcaggactagacgtacaccgtatttacagggactatacgttcgacgtaaacgcaacggcctaacagtacgggacctgagtaccgtagtttagagtaacttccgaaggaccgacgaccgggtcttaggttaccgttatttaccgtggttacggtaaccggaggaacgggggttaccgggggggaaaggtaccgttaaggtttcggaaccctaaacgttaaacgtacgggttaactttaaaactacggttcggtaagtttccggg

SEQ ID NO: 406658 - DNA, 726 bp, Homo sapiens
  misc_feature: GZ8MTXP02GAW14.45.53.E09.1.454.CMB.2.raw
  modified_base (276)..(276): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtcccgtccacccctggagagccggcctccatcctcctgcagggctagtcagacgccctctgcatagtaatggatacaactatgtggattggttcngcagagccgagggcagtctccacagcctctgattctatcgtgggtactcccgttacgttcccggccccgtccggggtccctaggtaaccgtggggttccagggtcgggtccgtagggttcggtttacgacgggactaccgtaagttaacttttaaacgaccgttaagtaaaaacgtcgaacggtacgaagggtaaggttacggggaaacgggtcggttaagggtaaggggttaaggtttagggggttttaagggggttttaactttaacggttgtacgtaagttacggtacgtaacgggtcgttaacggtaacgtaaaaggtttcggttaccggtttagggggttacgggttttaccggggaaccgggtaacgggggtaacccgaaaagggttccggttaaggggaaacggaacggtaaaaccggaaaaccggtaaacggtttacggggg

SEQ ID NO: 406659 - DNA, 667 bp, Homo sapiens
  misc_feature: GZ8MTXP02I24M0.45.53.E09.1.454.CMB.2.raw
  modified_base (228)..(228): a, c, t, g, unknown or other
  modified_base (240)..(240): a, c, t, g, unknown or other
  modified_base (279)..(279): a, c, t, g, unknown or other
  modified_base (295)..(295): a, c, t, g, unknown or other
  modified_base (326)..(326): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctgaggcgaagaagcctgggcctcagtgaagtttccngccaaggcttgnggatacgactttcgctcgcccatcgcctattcagtggcncgccaggcccccgaanacggcttgagtgagtggatggactcgaacgntcggctacgtggtacagacgtatagtcacgtagtaaacttcccgagtaaccgaggtaacgtccgaaccttacgtttacgacgggtaactacgttacttaccgacgtaacctacgtacgtaccgtaacgtacgttaccgggtaaccttcggtaacgtcgttaaacgtttcggaacgttacgttaccgtacgtaaccgtaccgtacgggtaccgttcgtaccgtttaacgttaccgtacggttacggacggttaacggacgggtaaccgggggtagtacgttacgtcggtacgtaacgttacgtacgtaaacgttacgttaaccgttacggttcgttaaccgg

SEQ ID NO: 406660 - DNA, 575 bp, Homo sapiens
  misc_feature: GZ8MTXP02F3WC9.45.53.E09.1.454.CMB.2.raw
  modified_base (212)..(212): a, c, t, g, unknown or other
  modified_base (226)..(226): a, c, t, g, unknown or other
  modified_base (278)..(278): a, c, t, g, unknown or other
  modified_base (295)..(295): a, c, t, g, unknown or other
  modified_base (345)..(345): a, c, t, g, unknown or other
  modified_base (350)..(350): a, c, t, g, unknown or other
tcagacgcgatcgacacgaccggtgctcgatttagagagagtgtgttgggtttggggacccaacaaccacatccctcctcagaagccccagagcacaactcctcaccatggactggacctggaggatcctcttttggtggcagcagccacaggtgtccactcccaggtccagcatgtgcagtctggggctgaggcgaagagccgtgggcctnagtgaaggtttccngcaaggcttcgtggatactactttcgcttgcccatcgccattcagttgggcncgccacggcccccgganaggcttgagtggatgggatggatcacgctggcacgtggtaacacagtatntacanaagtaaacttcaggacaggattccactagtttaccgaggactagtatcgacgaacacacgacctaagcgtaacggacctgacgtacgttagtttagagtagttacgacgaaccgacgacggtcttacggtacttaagttacgtgtacggagggtaggtaacgggggacggggggtaacgtagtacgtgtaccgtaagtaagtacgtacttagtacgtgtagtcgg

SEQ ID NO: 406661 - DNA, 591 bp, Homo sapiens
  misc_feature: GZ8MTXP02HM6G4.45.53.E09.1.454.CMB.2.raw
  modified_base (216)..(216): a, c, t, g, unknown or other
  modified_base (282)..(282): a, c, t, g, unknown or other
  modified_base (298)..(298): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagccgtggggcctnagtgaaggtttcctgcaaggcttcgtggatactacttttcgctcgcccatgccattcagttgggtncgccacggcccccganaaggcttgagtggatgggatggatacgaacgctggcacgtggtaacacaagaaatagttcaaacgaataaaacttccgaggtaacaaggaactaccaacctatttacgaagggaactagtaacttacgacgaaacgacacgtaccctacaacgtcgggaccctagaacgtacgtaagttttgaaggtattcgtagaccgaaccacgggtctgttacttattactggttagcggtaggacgggaaggggggagagtagttgactaagtataggtacttagtacgtgtagtacgg

SEQ ID NO: 406662 - DNA, 641 bp, Homo sapiens
  misc_feature: GZ8MTXP02FWBKV.45.53.E09.1.454.CMB.2.raw
  modified_base (217)..(217): a, c, t, g, unknown or other
  modified_base (231)..(231): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctggaggcgaagagcgtggggcctnagtgaaggtttccngcaaggtcttcgtggattactactttcgctcgcccatcgcctattcagttgggtgccgccgacggccccccggagaagggtcttgaggtggagtgggatggatcgaacgcgtggctacgtggtacacaagtaatattacaactagtaaacttccgaggaccagtacgttaccaccttagtttacgaagggtactaattacttacgacgtaaaccaacgtacgacccttaagaacgtcggaacccgttgaacgtacgttaggtttaggagtactcgtaggaccgtaacggacggtaccttagtacctttaagttacgtcggttcgtagggaaggggacgggggaacggggggtaaaggtacgttagttacggacgtaattaaggtatacgtttattacgtagttacgtcgg

SEQ ID NO: 406663 - DNA, 643 bp, Homo sapiens
  misc_feature: GZ8MTXP02IE31E.45.53.E09.1.454.CMB.2.raw
  modified_base (242)..(242): a, c, t, g, unknown or other
  modified_base (279)..(279): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttcagtgggatattgtgatgactcagtctccactctccctgtcccgtcaccccgtggagacgccggcctccatcctcctgcgagggctagtcagacgccttccngcatagtaatggatacaactatgtggtattcggtccngcaagagcccgaggggctagtcctaccacacgtcctcctagtactcgtaatcgtaggtacttccgttacgtccccgggtccccgtccggggtccctaggactcgggttcaggtcggctagggtcgttacgacgactacgagttactttacgaacttaagtaaatacgaagacgaaggagtaggacggtagtaggtagggttagtttcgggtttaggggtttattaccgtagtacgtagtcggtacgtaaggtccgtagtacgtaaagttcggttacgttagggttacggttttacggaccgggtaacggaacccgtaaggtaccggttaacggaggtaacgaaccggtaaacgtaacggtcggg

SEQ ID NO: 406664 - DNA, 610 bp, Homo sapiens
  misc_feature: GZ8MTXP02GDFJ5.45.53.E09.1.454.CMB.2.raw
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctcctgcatagtaatggatacaactatgtggattggttcctgcagaagccagggcagtctccacagctcctgatctatcgtggactcctagttccggcccgtccggggtccctgacgtggttcaggtgctaggtgtcagcactagtatttacactagaaaactcaagcagagtggaggcgtaggaggtagttgggtttaggggtttattaacgtgacgtagtacgacgtaaagggttcgtacggtaactaaaagttcggttaccgttaggggttacggtttttacggggacccggtaaacgggggttaaacccaaaggggtaccggttagggggaaacggtaacggaaaccggtaaaaacggtaaccggtttaagggg

SEQ ID NO: 406665 - DNA, 645 bp, Homo sapiens
  misc_feature: GZ8MTXP02FTXF0.45.53.E09.1.454.CMB.2.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctggaggcgaagaagccgtggggcctcgagtggaacggtttcctgcgaaggtcttcgtggatactactttcgctgcccatcgcctattcagttggggtcgccgccgacgggaccccccggagaacgggtctttggagtggagtgggatggatacgaacgctaggctacgtaggtaacactaagtaatactacaacgtaagaaacttccgaggtaaccagtacgtaccaactagtttacgtaaggactatacgttacgacgtaacacgacgtacctactacgtacggacctgagctagtttacgagtactacgtacgaccgacgacggtacgttacgtacttacgttacgttggtcggacggtaacgggacgggggaaaggggggtaacggtagttaacggtacgtaaccgtaagttaagtaacgttaagttacgttacgttagttacggtacgg

SEQ ID NO: 406666 - DNA, 605 bp, Homo sapiens
  misc_feature: GZ8MTXP02FUQM8.45.53.E09.1.454.CMB.2.raw
  modified_base (219)..(219): a, c, t, g, unknown or other
  modified_base (458)..(458): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctggaggcgaagaagccgtggggcctnagtgaaggtttcctgcaaggcttcgtggatactactttcgctgcccatcgcctattcagttggggtcgccgccgacgggcccccccggaagaacggggtcctttggaggtggagtggggatggatcgaacgcgtggcacgtggtacacagtaatatacaactaagtaaacttccgaggacaggacgtaccaaccttatttaccgaagggactagttacgttcgacgaacacacgcctanagtgacctgacgtcgtagtttgagtacttacgtagaaccgtacgacggtcttcggttacttagttacgtggtacggcggaagggacggggaaggggggaggtacgttagtcggacgaagtagtagtaagttagtacgttggtagtcg

SEQ ID NO: 406667 - DNA, 656 bp, Homo sapiens
  misc_feature: GZ8MTXP02G3OUD.45.53.E09.1.454.CMB.2.raw
  modified_base (282)..(282): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttcttttggtggcagcagccacaggtgtccactcccaggtccagcatgtgcagtcgtggggctggaggcgaagaagccgtggggcctcagtgaaggtttcctgcaaggcttcgtggatactactttcgctcgcccatcgccattcatgggtncgccacggcccccgagaacgggctgaggtggagtgggatggatacgaacgctggctacgtggttaacacgaagtaaattattacaacaagtaaaacttcccgaggtaccaaggtaacgtacctaacctaagtttacgaacggggtaactagttaacgttaccgacgaaaccaacgtacgtacccgtaacacgttacggaacccgttaggaacgtaccttaaggtttacgaagtacttacggtacgaaccgaaccgtaacgggtccttaggttaccttaaagtttaccgtggttacgcgggtaaaggacgggggtaaggggggaagtacgtagttcgacgtaagttagtagtaatttagtaagttggtacgtcgg

SEQ ID NO: 406668 - DNA, 536 bp, Homo sapiens
  misc_feature: GZ8MTXP02FKJW2.45.53.E09.1.454.CMB.2.raw
  modified_base (294)..(294): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagccgtggggcctcagtgaaggtttcctgcaaggcttctggatactactttcgctgcccatgccattcattgggtgcgccaggcccccgganaagggcttgagtggatgggatggatcaacgctggcacgtggttacacagtaatatcaacagaaacttccaggacagagtcactatttcaagggacatattcgacgaacacagcctacagtcgacctgacgactaggtttgacgtatctagaaccgacgaacggtctcgtctaagttacgtgtgcgaggacggggaggggggaggagtagttgacgaagtaagtgtaatatacgtgtagtcgg

SEQ ID NO: 406669 - DNA, 567 bp, Homo sapiens
  misc_feature: GZ8MTXP02GS3ZN.45.53.E09.1.454.CMB.2.raw
  modified_base (329)..(329): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttcgtggatacactttcgctgcccatcgccattcattgggtgcgccacggcccccggagaacgggcttgagtggatggggatggatcgaacgntggctacgtggtacacagaatattcaacagtaaacttccgaggtacagacgtcaacctatttcgagggactagttaattccgacgtaaacacacgcctacagtacggacctgaacgcgtaagtttgagtatcgtagaccgtacgacggcttagtaccttaagttactgtacgacggagggaggggaacggggggaggacgtaagtgactaacgtaatacgtattagtacgtgtagtcg

SEQ ID NO: 406670 - DNA, 539 bp, Homo sapiens
  misc_feature: GZ8MTXP02JI47C.45.53.E09.1.454.CMB.2.raw
  modified_base (381)..(381): a, c, t, g, unknown or other
  modified_base (389)..(389): a, c, t, g, unknown or other
  modified_base (399)..(399): a, c, t, g, unknown or other
  modified_base (435)..(435): a, c, t, g, unknown or other
tcagacgcgatcgacacgaccggtgctcgatttagagagagtgtgttgggtttggggacccaacaaccacatccctcctcagaagcccccagatcacaactcctcaccatggactggacctggaggatcctctttttggtggcagcagccacaggtgtccactcccaggtccagcatgtgcagtctggggctgaggcgaagaagcctggggcctcagtgaaggtttcctgcaagggcttctggatacactttcgctgcccatgccattcagttgggtgcgccacggcccccggagaaggcttgagtggatgggatggatcaacgctggcactggttacacagtaatattacacagtaattcaggacagagtcactatttcnggggtacntatcgcaacncagcctacagtcggacctgacgcgtagtttcgagtntacgtgacgacacggctgtacttatactgtacgcggtaggacggacggggggaggtacgtacgttgacgtaacgttaatacggtattagtacgtgtagttacgg

SEQ ID NO: 406671 - DNA, 620 bp, Homo sapiens
  misc_feature: GZ8MTXP02JTDS2.45.53.E09.1.454.CMB.2.raw
  modified_base (289)..(289): a, c, t, g, unknown or other
  modified_base (344)..(344): a, c, t, g, unknown or other
  modified_base (450)..(450): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctggaggcgaagaagccgtggggcctcagtgaaggtttcctgcaaggtcttctggattactacttttcgctcgccccatcgcctattcagtttggggngccgccacggccccccggagaacgggcttggagtggatgggagtggatcgaacgngtggcacgtggtacacagtaatagttcaacagtaaacttccgagggaacagagtaccaacctagtttacgtaaggactagtacttacgacgaaacacagaccctanactacggacctgacgctaggtttagagtacttacgaggaaccgacgaccggtacttacggttaccttagttacgtggtaggaccgggaaggggacgggggtaaacgggggggacgtaacgtagttacggactaagttaagtaggtaattacgttacgtggtacgttacgg

SEQ ID NO: 406672 - DNA, 606 bp, Homo sapiens
  misc_feature: GZ8MTXP02IKI2O.45.53.E09.1.454.CMB.2.raw
  modified_base (197)..(197): a, c, t, g, unknown or other
  modified_base (234)..(234): a, c, t, g, unknown or other
  modified_base (270)..(270): a, c, t, g, unknown or other
  modified_base (275)..(275): a, c, t, g, unknown or other
  modified_base (285)..(285): a, c, t, g, unknown or other
  modified_base (292)..(292): a, c, t, g, unknown or other
  modified_base (336)..(336): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtgggctgaggngaagagcgtgggcctcagtgaggttcctgcagcttcngatactacttcgctcgcccatcgccattcattgggncgccncggccccganaggctgngtggagtggatggatcaacgctgcacgtggtacacagatatcanataattcaggacagactcacctatttacacggactatacgttacgacgtaacacgtacgacctactagacggacctagacgtacgtagttttagaagtatttccggaagaccggaaccgtacgggtacgtttggtaaccttacgtttaaccgtggttaacgggacgggttaaaggggaacgggggtaacggggggaagggttacgttaagtttacggacctaaacgttaacgtagttaacgtttaagttaccggttaggttacgttcggg

SEQ ID NO: 406673 - DNA, 528 bp, Homo sapiens
  misc_feature: GZ8MTXP02FIM0Z.45.53.E09.1.454.CMB.2.raw
  modified_base (216)..(216): a, c, t, g, unknown or other
  modified_base (230)..(230): a, c, t, g, unknown or other
  modified_base (240)..(240): a, c, t, g, unknown or other
  modified_base (294)..(294): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaaagaagcctggggcctnagtgaaggtttccngcaaggcttntggatacactttcgctgcccatgccattcattgggtgcgccacggcccccgganaaggggcttgaggtggagtgggatggatcaagctggcagtggttacacagaatatcacagaaacttcaggacagagtacactatttcagggactatattcgacgacacagcctacatcggacctgagctagttgagattacgtgacgaacacggtctcgtactattacgtagtcgaggaggacgggacggggggaggacgtagttgacaagtaatagtatagtactggtgtcgg

SEQ ID NO: 406674 - DNA, 684 bp, Homo sapiens
  misc_feature: GZ8MTXP02G9XXN.45.53.E09.1.454.CMB.2.raw
  modified_base (289)..(289): a, c, t, g, unknown or other
  modified_base (477)..(477): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctgaggcgaagaagccgtggggcctcgagtgtaaggtttcctgacaaggtcttcgaggtatactactttcgctcgcccatcgcctattcagttgggcnccgccgaccggacccccgagtagggcttggaggtggagtgggagtggatacgacgcgtggacctacgttacggtacacgaagtaacttatacaacgtaataaacttaccgaggacgtaaggtacgtaccaaccttagtttaccgagggtaactaattacgttaccgaacggaaacacagtaccctaanacgtaccgtactacgagtcgttaagttgaagtactacgtaggaccgtacgacggtcttacgttacttacgtaccgtaggtacggagggtaacgggggacgggggtaacgggggggaacgttacggttaggttaaccggtaaccttaaacggttaagttaacggtttaacgttaaagtttccggtttaacggttccgggtttaaacgg

SEQ ID NO: 406675 - DNA, 597 bp, Homo sapiens
  misc_feature: GZ8MTXP02GUUEP.45.53.E09.1.454.CMB.2.raw
  modified_base (217)..(217): a, c, t, g, unknown or other
  modified_base (231)..(231): a, c, t, g, unknown or other
  modified_base (287)..(287): a, c, t, g, unknown or other
  modified_base (514)..(514): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctgaggcgaagaagccgtgggcctnagtgaaggtttccngcaaggtcttcgtggactactactttcgctcgcccatcgcctattcagttgggtcnccgccgacgggccccccggaagaacgggcttggaggtggagtgggatggatcgaacgcgtggactacgtggtaaaccagaacgtaacttacttacaaacgtaagtaaaacttccgagggtacaaggacgtactacctagtttccgaagggactattatcgacgaacacacgacctacagtcggacctgagtacgtagttagagtagtacgtacgaacgtacgacgtntcggttattagttcgtgtcgacggaggacggggagggggaagtagtacgtgactaagtaagtagtacttagtacgtgtgtacg

SEQ ID NO: 406676 - DNA, 640 bp, Homo sapiens
  misc_feature: GZ8MTXP02I84M8.45.53.E09.1.454.CMB.2.raw
  modified_base (412)..(412): a, c, t, g, unknown or other
  modified_base (615)..(615): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtcccgtcaccccgtggacgacgcccggcctccatcctcctgcgagggcttagcaagacgtccctcctgctaataagtaatggaataacaacttatggtaggtatttcggtacctgacaagaacgccgagggcagtcctaccactatcctccgtatacttccgtatcgtagggacttccgtacgttcccggcccccgttcccggggtaccctgggtaacctcggggttaacncggttggaccgtaggttggtacgaagggtacacgtagttaactttaacgaactaagtaaaactccaagtacgaaggtaggtagagggtagtaggtaaaggtcgttttagggggttagggttttaaaccgtcgtaagtcgttagacgtagggtaatccgtaggtaactaagtcgtcggttaagttggttacggacgacggtaanaagtgagagagacgaacgacgtagg

SEQ ID NO: 406677 - DNA, 604 bp, Homo sapiens
  misc_feature: GZ8MTXP02F4AKD.45.53.E09.1.454.CMB.2.raw
  modified_base (216)..(216): a, c, t, g, unknown or other
  modified_base (228)..(228): a, c, t, g, unknown or other
  modified_base (237)..(237): a, c, t, g, unknown or other
  modified_base (272)..(272): a, c, t, g, unknown or other
  modified_base (434)..(434): a, c, t, g, unknown or other
tcagacgcgatcgacacgaccggtgctcgatttagagagagtgtgttgggtttggggacccaacaaccacatccctcctcagaagccccagagcacaactcctcaccatggactggacctggaggatccttctttttggtggcagcagccacaggtgtccactcccaggtccagcatgtgcagtcgtggggctgaggcgaagaagccgtgggcctnagtgaaggttcngcaggcttngatacacttcgctgcccatcgccattcagttgggncgcgacggcccccgaagaggcttagagtggatgggatggactacgaacgctcggactaacgtggttaaccagagtaatatacaactagtaaaacttccgaggacagacgttaccacctagtttacgaaggactattactacgacgaaacacacgaccttaanagtacgacgtagacgtacgtagttacgagtactacgacgaaccgacgacgtcgttacgtacttacgtacgtacggtcggacggaagggtaacgggggtaacgggggtaaggtacgttacgtacggtaactaacgtaattaacgtaacgttacgtacgtacggttagtacg

SEQ ID NO: 406678 - DNA, 584 bp, Homo sapiens
  misc_feature: GZ8MTXP02H277A.45.53.E09.1.454.CMB.2.raw
  modified_base (244)..(244): a, c, t, g, unknown or other
  modified_base (516)..(516): a, c, t, g, unknown or other
tcagacgcgatcgacacgaccggtgctcgatttagagagagtgtgttgggtttggggacccaacaaccacatccctcctcagaagccccagagcacaactcctcaccatggactggacctggaggatcctcttttggtggcagcagccacaggtgtccactcccaggtccagcatgtgcagtcgtggggctgaggcgaaagaagcctggggcctcgagtgaaggtttcctgacaaggtcttcgnggatacacttttcgctcgcccatcgccattcagttgggcgcgccgacggccccccggaagaacgggctttggaaggtggaagtggggaatggactcgaaacgcgtggcacgtggtaacacaagattatcaacagtaaattccaggaacagacgtaccaacagtttacaaggacctaagtattaccgacgaaacacagaccctaagacgtagggtaccagaaacgtcgtaagtttagacgtatccgagacgaacgcggtctgtactattacgngtgagagggacgggacgggggagtactagtacgaactaagtaatacgtattacgtacgtggttacgcg

SEQ ID NO: 406679 - DNA, 656 bp, Homo sapiens
  misc_feature: GZ8MTXP02GDIG2.45.53.E09.1.454.CMB.2.raw
  modified_base (220)..(220): a, c, t, g, unknown or other
  modified_base (234)..(234): a, c, t, g, unknown or other
  modified_base (485)..(485): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttcttttttggtggcagcagccacaggtgtccactcccaggtccagcatgtgcagtcgtggggctggaggcgaagaagccgtggggcctnagtgaaggtttccngacaaggtcttcgtggactactactttcgctgcccatcgcctattcagttggggtcgccgccgacgggccccccggaagaacggggctttaggaggtggagtggggatggactacgaacgtcgtggacctacgtaggttaacaacgaagtaattactacaaacgtaagtaaaacttccgagggacaggtacgtaccacctatttacgaacgggactaattacgttcgaacgtaaacaacgacgaccctaanacgtcggacctggacgtacgtaaggtttagagtaacttcgacgaaccgacgacgggtacttacgttcttacgtttaacgtggttacggacggaaggggaacgggggtaacggggggaaggtagttagtcggataacgtaagtacgttaacttagtacgttacggtagtcgg

SEQ ID NO: 406680 - DNA, 520 bp, Homo sapiens
  misc_feature: GZ8MTXP02IGD3Z.45.53.E09.1.454.CMB.2.raw
  modified_base (215)..(215): a, c, t, g, unknown or other
  modified_base (229)..(229): a, c, t, g, unknown or other
  modified_base (277)..(277): a, c, t, g, unknown or other
  modified_base (294)..(294): a, c, t, g, unknown or other
  modified_base (421)..(421): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctnagtgaaggtttccngcaaggcttctggatactactttcgctgcccatgccattcagttgggngcgccaggcccccgganaaggcttgagtggatgggatggatcaacgctggcacgtggtacacagaatatcacagaaacttcagacagagtcacctatttacgtaaggacatattcgacgaacacagacctacatcggacctgancgtagttgagtatcgtagaacgacacggctgtactattacgtgtgcggaggagggacgggggagagtagtgacgaagtaatgtattatacgtgttgacg

SEQ ID NO: 406681 - DNA, 692 bp, Homo sapiens
  misc_feature: GZ8MTXP02HR47U.45.53.E09.1.454.CMB.2.raw
  modified_base (278)..(278): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagagcctggggcctcagtgtaaggttcctgcaaggcttcgtggatacactttcgctgcccatcgcctattcagttgggtnccggcccgacgggccccccggagaacggggtcttggaaggtcggagtgggatggactacgaacgcgtggacacgtaggttacacgaagtaatactacaacgaagtaaaccttacgagggaactaacggtacgtacctaaccttaacgtttacgtacggggtaactattaacgttcgaaccgaaacaacgtacgacccttaacacgtacgggtaccctaggacgacgttaaggttttgaagggtactttacggacgaaccgaaacggtccggtccgttaggttaccctaagtttaaccgtgttggaaccgggttaaggggaaacgggggacggggggggtaaggtaacgttaggttaacgggcctaaaaggttaagtacggttaaaacttatttaaccggttggttaagttccgg

SEQ ID NO: 406682 - DNA, 602 bp, Homo sapiens
  misc_feature: GZ8MTXP02I45AR.45.53.E09.1.454.CMB.2.raw
  modified_base (231)..(231): a, c, t, g, unknown or other
  modified_base (382)..(382): a, c, t, g, unknown or other
  modified_base (478)..(478): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtcgtggggctgaggcgaagagccgtgggcctcagtgaaggtttccngacaggtcttgtggatactactttcgctcgcccatcgcctattctagttcgggtcgccgcccgaccgggaccccccggaagtaaggggtctttggacggtggagtggggatggactacgaacgtcgtggctacgtggtaacacaagtaatntacaataagtaaacttcgagtacaggtaactaccacgttatttacgaagggtaactagtactacgacaacacacgacctagacgcgaccgtgacgngttagttgagtatacgtagacgacgacgtcttcgtacttacgtagtcggtcggacgggagggagggggacgggggtagtacgttagtgaacgtaagtagtagttactagtacgtggtactacgg

SEQ ID NO: 406683 - DNA, 628 bp, Homo sapiens
  misc_feature: GZ8MTXP02JCBXP.45.53.E09.1.454.CMB.2.raw
  modified_base (215)..(215): a, c, t, g, unknown or other
  modified_base (229)..(229): a, c, t, g, unknown or other
  modified_base (247)..(247): a, c, t, g, unknown or other
  modified_base (302)..(302): a, c, t, g, unknown or other
  modified_base (435)..(435): a, c, t, g, unknown or other
  modified_base (442)..(442): a, c, t, g, unknown or other
tcagacgcgatcgacacgaccggtgctcgatttagagagagtgtgttgggtttggggacccaacaaccacatccctcctcagaagccccagagcacaactcctcaccatggactggacctggaggatcctctttttggcggcagcagccacaggtgtccactcccaggtccagcatgtgcagtctggggctggaggcgaagagccgtggggcctnagtgaaggtttccngcaaggcttctggatacnctttcgctgcccatcgcctattcatttggggtgccgccgacggcccccccggaanaacggggctttggaggtggagtggggatggatcgaacgctggctacgtggtacacagaatatcaacagtaaacttccaggacagacgtcacctaatttcgaagggactaagttacttcgacgtaaacacgacnccctaanagtacgggaccttggacgtcgtagtttagagtacttcgtacggaccgacgacgggtacttcggttacttaacgtttacgtgtacggacgggagggtaacgggggaacgggggggtaacgggtacgttaggttacggacgtaaacgttaaaggtagttaagtttacgtacgttagggttcgttaccg

SEQ ID NO: 406684 - DNA, 620 bp, Homo sapiens
  misc_feature: GZ8MTXP02GLSSC.45.53.E09.1.454.CMB.2.raw
  modified_base (235)..(235): a, c, t, g, unknown or other
  modified_base (283)..(283): a, c, t, g, unknown or other
  modified_base (308)..(308): a, c, t, g, unknown or other
  modified_base (327)..(327): a, c, t, g, unknown or other
tcagacgcgatcgacacgaccggtgctcgatttagagagagtgtgttgggtttggggtgatcaggactcctcagttcaccttctcacaatgaggctccctgctcagctccttgggctgctaatgctctgggtctctggttccagtggggatattgtgatgactcagtctccactctccctgtccgtcaccccgtggacgacgcccggcctccatcctcctgcagggctagtcagngccctctgctatagtaagtggatacaacgtatgtggtattcggttccngcagaacgccagggtcagtctccanagctcctgattctagtcgnggtatcctacgtccggcccgtcggggtacctgaccgtggttcacgttgggcctaagggttcgtcaacggcacgtagtatttacacttaacgaaactcgaagacaagtacgtggaaaggtgttaggaggtacgttggtttaccgggggttaaatttaccggtgtacgtacgtacgtacgtacgtacgtacgtacgtaacgttacggtacggttacgggttacggttacggtacggtaacgggtaaccggtaacggtacggtacggtacggaacggaacgtaacgtaacgtacgg

SEQ ID NO: 406685 - DNA, 569 bp, Homo sapiens
  misc_feature: GZ8MTXP02I7WN6.45.53.E09.1.454.CMB.2.raw
tcagacgcgatcgacacgaccggtgctcgatttagagagagtgtgttgggtttggggacccaacaaccacatccctcctcagaagcccccagagcacaactcctcaccatgcactggacctggaggatcctctttttggtggcagcagccacaggtgtccactcccaggtccagcatgtgcagtctggggctgaggcgaagaagccgtggggcctcagtgaaggtttcctgcaaggcttctggatacactttcgctgcccatcgccattcattgggtgcgccgacggccccccggagaagggcttgaggtggagtgggatggatcgaacgctggctacgtcggttacaccaagaatacttacactaagaaacttccgaaggtaacaggtacgtacaacctagtttcgtaaggactatagttacgacgaacacgtacgacctaacacgtacggacctagagtaccgtagttttagagtatcgtagacgacacggtctgtactattactgtagcgaggagggacgggggagtagtagtgaacgtacgtagtagtattactacgttgtacgg

SEQ ID NO: 406686 - DNA, 572 bp, Homo sapiens
  misc_feature: GZ8MTXP02I8CIW.45.53.E09.1.454.CMB.2.raw
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctgaggcgaagaagccgtggggcctcgagtgaaggtttcctgcaaggcttcgtggatactactttcgctgcccatcgcctattcagttgggtcgccgaccgacgggccccccggaagaacggggctttggaggtggagtgggatggatcgaacgcgtggcacgtggtacacgagtaatactacaactagtaaacttccgaggacaggacgtacacctatttcgaggactatactcgacgaacacgacgcctacagtcgactgagctagttgagtatcgtagaccgacgacggtcttacgtacttagttacgtgtgacggagggtaggggacgggggagtacgtagttgacgtaacgtaagtacgtagtatacgtgtagtcg

SEQ ID NO: 406687 - DNA, 649 bp, Homo sapiens
  misc_feature: GZ8MTXP02H0N05.45.53.E09.1.454.CMB.2.raw
  modified_base (534)..(534): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctggaggcgaagagccgtggggcctgagtgtaaggtttcctgacaagggtcttcgtggtactactactttcgcttcgccctagtcgcctatttcagttggggcgaccgcccgaacgggccccccggaagaacggggtctttggaggttgggagtcggggatgggactacgaacgtcgtggacctacgttacggtaacataggtaaactattacaaactaagtaaaacgttcgagggaaccagtacgtccaacccgttatttacggaacgggactattacgttacgacgaacacgtacgacctactaacgtacggacctaggacgtacgtaggtttagacgtnttacgtcgaaaccgacgtacggtcttacggtattacgtacgtggtcggaggaggggtaagggacggggggtagtagtagttacgagtaagttagtagtactagtactgtacgtcg

SEQ ID NO: 406688 - DNA, 792 bp, Homo sapiens
  misc_feature: GZ8MTXP02IQXRF.45.53.E09.1.454.CMB.2.raw
tcagacgcgatcgacacgaccggtgctcgatttagagagagtgtgttgggtttgggacccaacaaccacatccctcctcagaacgcccccagagcacaactcctcaccatggactggacctggaggatccttctttttggtggcagcagccacaggtgtccactcccaggtccagcatgtgcagtcgtggggctgaggcgaagaagccgtggggcctcgagtgtaaggtttcctgcaaggtcttcgtggatactactttcgctcgccctatcgcctattcgtagttgggtcgaccgcccgacgggccccccggataacggggtcttggaggttaggagttggggaatcggggaactacgaaaccgtcgtacggtacctacgttacggtaacactaaaggtaaacttacgttaccgaaacgtaaggtaaaaacctttccgaacggggtaaccaaagggtaaccgttaaccctaacccgtaagttttaccgaaacggggtaaacctaacgttaacgtttaccggaccgaaaacctaacccgaacgtaccttaaccgacgtaccggtaacccgttaggaaacggtaccgttaaggttaggttaacggtattaccgttacgaaaccggaccgtaacgggtacttacgggttaacctttaagtttaacgttcggttacgggtaccggagggggtaaacgggggaaccgggggggtaaacggttaacggttaacgtttacggaacgttaaccgtaagttaacggttaacttagtaccgtttacggtttaggttaccgg

SEQ ID NO: 406689 - DNA, 588 bp, Homo sapiens
  misc_feature: GZ8MTXP02G1GPF.45.53.E09.1.454.CMB.2.raw
  modified_base (216)..(216): a, c, t, g, unknown or other
  modified_base (230)..(230): a, c, t, g, unknown or other
  modified_base (361)..(361): a, c, t, g, unknown or other
  modified_base (421)..(421): a, c, t, g, unknown or other
  modified_base (433)..(433): a, c, t, g, unknown or other
  modified_base (439)..(439): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactcccaggtccagcatgtgcagtctggggctgaggcgaagagtcgtgggcctnagtgaaggtttccngcaaggtcttctggatactactttcgctgccctatcgccattcagttgggtcgccgccgaccgggccccccggagaacggggcttggaggtggagtggggatggactcgaacgctggctacgttggtaacncaagtaatcttacaacaagtaaattccagggacaggacgtacacctattcgaggactatntcgacaacacanccctangttcgactgagtctagttcgagtatcgtagaacgacgaccgtcgtgttcctaaagttgtgtaggccggaaagggacgggggtaaacgggggaggtacgttaagttcggaacttaacgtaagtacgtagtttagtacgtgttcgtaacgg

SEQ ID NO: 406690 - DNA, 654 bp, Homo sapiens
  misc_feature: GZ8MTXP02J0XMY.45.53.E09.1.454.CMB.2.raw
  modified_base (284)..(284): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtcgtggggctgaggcgaagagccgtggggcctcagtgtaaggtttcctgcaaggcttcgtggattactactttcgcttcgcccatcgcctattcagttgggngccgcccgacgggccccccggagaacgggtcttgaggtggagtgggatggactccgaacgtcgtggacctacgttacggtacaacgtaagtaaacttacttacaaaccgtaaggtaaaactttacccgagggactaaacgggtactaccaaacccgttagttttaccggaagggtaactaacttacgttaccgaacgtaaccacgtacgtaccctaacgtacgttacgaccttagacgtacgttaggttagatatacgtagaaccgcgacggtcgtacttattacgttacgtggtcggacggtaagggacgggggtagggggtagtacgtagttcgacgtaagtagtacgtattagtacgttgtacgtcg

SEQ ID NO: 406691 - DNA, 579 bp, Homo sapiens
  misc_feature: GZ8MTXP02JSEV5.45.53.E09.1.454.CMB.2.raw
  modified_base (298)..(298): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccaacatgtgcagtcgtggggctggaggcgaagaagcgtggggctcagtgaaggtttcctgcaaggcttcgtggatactactttcgctgcccatgccattcagttggtgccgccgacggcccccgganaagggcttggagtggatggggatggatcgaacgtcgtgctacgtggttacagagaaactattacaacaaagtaaacttccgaaggacaggaacgtccaactatttacgagggactatattacgacgaacacagacacagtcgacgtgagacgtagtttagagtatcgaggtacgacgacggtctacgttactattacgtagtacgacggagggtagggggaacggggggaggtagtagttacgacgtaactaagtagtaattagtactggtacgtgtacgg

SEQ ID NO: 406692 - DNA, 594 bp, Homo sapiens
  misc_feature: GZ8MTXP02FF236.45.53.E09.1.454.CMB.2.raw
  modified_base (215)..(215): a, c, t, g, unknown or other
  modified_base (276)..(276): a, c, t, g, unknown or other
  modified_base (291)..(291): a, c, t, g, unknown or other
  modified_base (299)..(299): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctnagtgaaggtttcctgcaaggcttctggatacactttcgctgcccatgccattcattgggtncgccaggcccccganaaggctgngtggatggatggatcaagctggcacgtggtacacagaatactcacaagaacttccagaccaagacgtccaacctatttcgaagggactaattagttaccgacgtaacaacgtacgacctaactacgtggaaccctgtaagccgtaagtttcggaagtacgttacgtacgaaccgtaccgtacggtacgtcgtaccgttaatacgtaagttcgacggaggagggtaacggggggtaggtacggttaattcggactaaacgtaagtacgtaagttacgttaaacgtgttacgtacgg

SEQ ID NO: 406693 - DNA, 533 bp, Homo sapiens
  misc_feature: GZ8MTXP02JU5DN.45.53.E09.1.454.CMB.2.raw
  modified_base (299)..(299): a, c, t, g, unknown or other
  modified_base (417)..(417): a, c, t, g, unknown or other
tcagacgcgatcgacacgaccggtgctcgatttagagagagtgtgttgggtttgggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttcgtggatactacttttcgctgcccatcgccattcagttgggtgccgccgacggcccccgganaagggcttgaggtggagtgggatggatcaagctgcactggtacactagatatcaacagaaacttcgaggacagacgtcactattcgaagggctatattcgacgaaacacacgcctaanagtgactgagctagttgagatctagacgtacacggtctcgtacttattactgtcggcggaggaggggacgggggagtagtacgtgacgaagtaagtacgtattagtactagtgtcg

SEQ ID NO: 406694 - DNA, 651 bp, Homo sapiens
  misc_feature: GZ8MTXP02ICJFV.45.53.E09.1.454.CMB.2.raw
  modified_base (249)..(249): a, c, t, g, unknown or other
  modified_base (291)..(291): a, c, t, g, unknown or other
  modified_base (313)..(313): a, c, t, g, unknown or other
  modified_base (592)..(592): a, c, t, g, unknown or other
tcagacgcgatcgacacgaccggtgctcgatttagagagagtgtgttgggtttggggacccaacaaccacatccctcctcagaacgcccccagagcacaactcctcaccatggactggacctggaggatccttctttttggtggcagcagccacaggtgtccactccaggtccagcatgtgcagtcgtggggctgaggcgaagaacgccgtggggcctcaggtgtaaggtttcctgcgaaggtcttcgnggactactactttcgctcgcccatcgcctattcagttgggcnccggccacgggccccccggaanaacggggtcttggaggttggagtgggatggactacgaacgcgtaggactacgttacggtaacacgaagtaaactacttacgaactaaaggtaaacttccgaggacctaagaccgttacaacctttagttacgtagggaacttacgtaacgttccgaacgaaacaccgtaacgtaccctaatacggtacgaccgtagaccgtatagttagagtaacttcgacgacgacgacggtctcgttactagtacgtgtcgacggagggacggggacggggggtaanacgttaggtacgtaacgtaacgttaagtagttaacggttacttacggtagtttacgcgg

SEQ ID NO: 406695 - DNA, 575 bp, Homo sapiens
  misc_feature: GZ8MTXP02F95S3.45.53.E09.1.454.CMB.2.raw
  modified_base (299)..(299): a, c, t, g, unknown or other
  modified_base (340)..(340): a, c, t, g, unknown or other
tcagacgcgatcgacacgaccggtgctcgatttagagagagtgtgttgggtttggggtgatcaggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagagcctctgcatagtaatggatacaactatgtggattggttcctgcagaagcagggcagtctcacagctcngatctatctggatcctattccgcccgtcggggtccctgacnggttcaggtgcgagtggtcagtcactagtatttaacactagaaaatcagacagagtggaggcagtaggagttggtttaggggtttaattacgtgacagttgacgtaaggtctaggtactaaaagttcgttaccggttgggttagggtttttacgggacccggtaacgggggtaaacccgtaaggtacggtaacggggaaaggaacggaaaccgaaaaaccggtaacgtttacggg

SEQ ID NO: 406696 - DNA, 621 bp, Homo sapiens
  misc_feature: GZ8MTXP02IEJFH.45.53.E09.1.454.CMB.2.raw
  modified_base (231)..(231): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagccgtggggcctcagtgaaggttttccngcaaggcttcgtggatactactttcgctgcccatcgcctattcagttgggtgccgccgacggcccccggagaacgggctttgagtggagtgggatggatcgaacgtctggctacgtggtaacacaagtaatatcaacaagtaaattccgaggacagacgtaccacctagtttccgaagggactattacgttacgacgaaacaccacgaccctaacgtaacgttacgggacccgttggaaacgtaccgtaggttttagagtaattcgtaagaaccgcgacgggtctacggttccttagttacgtggttaggacggaggacgggggtaacgggggaaggtacgttagttacggacgtaacgttaagtagttattaagtcgttaggtgtacgg

SEQ ID NO: 406697 - DNA, 676 bp, Homo sapiens
  misc_feature: GZ8MTXP02ISSER.45.53.E09.1.454.CMB.2.raw
  modified_base (216)..(216): a, c, t, g, unknown or other
  modified_base (230)..(230): a, c, t, g, unknown or other
  modified_base (244)..(244): a, c, t, g, unknown or other
  modified_base (314)..(314): a, c, t, g, unknown or other
  modified_base (353)..(353): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtcgtggggctggaggcgaagagccgtgggcctnagtgaaggtttccngcgaaggtcttcgnggatactactttcggactcgcccatcgcctattcagttggggtcgccgtacccgacgggccccccggaanaaggggtcttggaggtggagtgggaatggactacggacncggtaggcctaacgttgggtaaacacgtagtaaactagttacaaactaagtaaaaccttcgaggggtaacaaggtacgttaccaacgttagtttccgaaagggactaacgtagttaccggactaaacacgacgtacctaacaggttacgacctagaactcggtaggtttagagtactacgtaggaaccgtaacgacgggtcttcggttacctttaagtacgttcggtacggaccggggtaggggaaaccgggggtaaggggggacggtaacgttaggttcgaaacgttaacgtaatacgtattaagtcgttaggtttcgaagg

SEQ ID NO: 406698 - DNA, 758 bp, Homo sapiens
  misc_feature: GZ8MTXP02GVNND.45.53.E09.1.454.CMB.2.raw
  modified_base (221)..(221): a, c, t, g, unknown or other
  modified_base (236)..(236): a, c, t, g, unknown or other
tcagacgcgatcgacacgaccggtgctcgatttagagagagtgtgttgggtttggggacccaacaaccacatcccctcctcagaagcccccagagcacaactcctcaccatggactggacctggaggatccttcttttttggtggcagcagccacaggtgtccactcccaggtccagcatgtgcagtcgtggggctggaggcgaagaagccgtggggcctnagtgtaaggtttccngacaaggtcttcgtaggatactacgtttcgctcgcccatcgcctattcgagttggggtcgccgcccgaccgggtccccccggagaaacgggtctttaggaggtggagtgggatgggatacgaacggtcgtggacctacgttggtaacacgaagtaaatacttacaaacgtaagtaaaacttccgaagggtacaaggtacgtaccgtaaccttaagtttaccgagggtaactaagttacgttaccgaacgtaaaccgaaccgtaacggtaccctaacgacgttaccggaccgttaggaagtaccgttaggtttacgtaggtacgttaccgtaggtaacccgacggtaccggtcgttttaacgtaccgtttaacgtttacgttacggggtaggtaccggggaaagggggtaacgggggaaaccgggggggtagggttaaacgttacggttaaggtaacccgttaaaagttaaacggttaacggttaaactttaacggtttaacggttgggttacggtttaccgg

SEQ ID NO: 406699 - DNA, 754 bp, Homo sapiens
  misc_feature: GZ8MTXP02I1198.45.53.E09.1.454.CMB.2.raw
  modified_base (218)..(218): a, c, t, g, unknown or other
  modified_base (230)..(230): a, c, t, g, unknown or other
  modified_base (468)..(468): a, c, t, g, unknown or other
  modified_base (485)..(485): a, c, t, g, unknown or other
  modified_base (497)..(497): a, c, t, g, unknown or other
tcagacgcgatcgacacgaccggtgctcgatttagagagagtgtgttgggtttggggacccaacaaccacatcccctcctcagaacgcccccagagcacaactcctcaccatggactggacctggaggatccttctttttggtggcagcagccacaggtgtccactcccaggtccagcatgtgcagtcgtggggctgaggcgaagagccgtgggcctnagtgagtttccngcaaggtcttgtgatactactttcgctcgccctagtcgacctattcgtaggttggggtcgccgaccgaccccgggacccccgggaagaacggggtctttaggaggttagggacggttggggagtcggaacttaccgaaccggtcgtacggactacgttagttaacacgtaacgtattacttacaacgtaagtaaccttccaggactacgtacgtaccacgttagttacgagggaactnttaacgtccgaacaacncgacgtacctanacgttcgggacctaggacgaccgtttaaggtttcgaagtccgtttacggacgaaacccggtaccgtacggttacccgttaggtttaccttaaaacggttttcgtgggacccggggttaaagggaaacgggggttaaccggggggtaaaggggggttaaccggttaatttaccggtacgggttaaaccctttaaaacgtaagggtttaaccgttaaaggtttttaccgaacggtttttggggacccgtttaaacgggg

SEQ ID NO: 406700 - DNA, 685 bp, Homo sapiens
  misc_feature: GZ8MTXP02FFDD8.45.53.E09.1.454.CMB.2.raw
  modified_base (370)..(370): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttcttttttggtggcagcagccacaggtgtccactcccaggtccagcatgtgcagtctggggctgaggcaagaagcctggggcctcgagtgaagggtttcctgcaaggcttcgtggatacactttcgctgcccatgcattcagttgggtgacgccacgggcccccccggaagaaggggcctttgacggtgggatggggatggatcgaacgctaggcacgtggttacacagaattatacanaagaaattcgagacagagtacactatttcgaagggacatattcgacgtaaacacgacgacctaacacgttacggaaccttggagtaccgtaaggttttggaaagtagttaccgttacggaaccgttaaccgacgggtaccgttggttaacccttaagttttaaccgtgggttacggtaccgggaaaggggaaacgggggtaaccggggggggggtaaaacgggtaacggttaacggttacggtaacccgtaaaacgtttaaacgttaacgggttaaatttaacggttaaaccgtttagggttacgtttacccggg

SEQ ID NO: 406701 - DNA, 608 bp, Homo sapiens
  misc_feature: GZ8MTXP02FMIIP.45.53.E09.1.454.CMB.2.raw
  modified_base (277)..(277): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctcttttggtggcagcagccacaggtgtccactcccaggtccagcatgtgcagtctggggctgaggcgaagaagcctggggcctcgagtgtaaggtttcctgcgaaggtcttcgtggatacactttcgctgcccatgcattcattggncgccaggccccggacgaggcttgagtggatgggatggactcgaacgtcgtggtcacgtggttacacgtagtaaatattcaacgtagaaacttccgaggaccaaggaatccgaactatttacgtaagggaactattacgttcgaccgaaacaacgtacgaccctactacgtcgtaaccctgaaacgtccgtagtttgagtactcgtagaccgaaagtccgggtcttaggtactactttacgtgtacggcggaggggtacgggacggggggaaggtacgtagttcgacgtaacgttaagacggttaaattagtaaccgttggtcggttaacgg

SEQ ID NO: 406702 - DNA, 605 bp, Homo sapiens
  misc_feature: GZ8MTXP02G6KNT.45.53.E09.1.454.CMB.2.raw
  modified_base (216)..(216): a, c, t, g, unknown or other
  modified_base (229)..(229): a, c, t, g, unknown or other
  modified_base (231)..(231): a, c, t, g, unknown or other
  modified_base (278)..(278): a, c, t, g, unknown or other
  modified_base (430)..(430): a, c, t, g, unknown or other
  modified_base (441)..(441): a, c, t, g, unknown or other
  modified_base (458)..(458): a, c, t, g, unknown or other
  modified_base (503)..(503): a, c, t, g, unknown or other
  modified_base (565)..(565): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatccttctttttggtggcagcagccacaggtgtccactcccaggtccagcatgtgcagtcgtggggctgaggcgaagaagcgtgggcctnagtgaagtttccngnaagcttctggatacactttcgctcgcccatcgcctattcattgggtncgccgacggcccccgagaacggtcttggaggttggagtggggatggactacgaacggtcgtggcaaccgttaggttaccaacaacggtaaatacttacaacgtaagtaaaacttcgaggtacaagacgttacactacttttacgacgggtanaatattacganaaaccgacagccctaanagtggacctgaacgctaagtttcagtatcgacgacgacaccggtntacgtacttagtacgtgtacggaggaagggtacggggaacgggggaaggtacgtacggttanacgtaacgtaactagttaaatacgtacgtacgttacgtcg

SEQ ID NO: 406703 - DNA, 546 bp, Homo sapiens
  misc_feature: GZ8MTXP02GEULJ.45.53.E09.1.454.CMB.2.raw
  modified_base (215)..(215): a, c, t, g, unknown or other
  modified_base (277)..(277): a, c, t, g, unknown or other
  modified_base (295)..(295): a, c, t, g, unknown or other
  modified_base (342)..(342): a, c, t, g, unknown or other
  modified_base (348)..(348): a, c, t, g, unknown or other
  modified_base (406)..(406): a, c, t, g, unknown or other
tcagacgcgatcgacacgaccggtgctcgatttagagagagtgtgttgggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagcctggggcctnagtgaaggtttcctgcaaggcttctggatacactttcgctgcccatcgccattcagttgggncgccacggcccccggaanaagggcttgagtggagtgggatggatcgaagctggctactggtacanagaatntacacagaaacttcgaggtacagacgtcacctagtttcgaggtacatactcgacgaanaccagacctacagtcgactgagcgtagttgagtatacgtagaccgacgacgtcttgtacttattcgtgtgacggagggtacggggaaggggggacggagttacgttaggactaattaagtgtaagttatacgtagtgtcg

SEQ ID NO: 406704 - DNA, 546 bp, Homo sapiens
  misc_feature: GZ8MTXP02GPU33.45.53.E09.1.454.CMB.2.raw
  modified_base (216)..(216): a, c, t, g, unknown or other
  modified_base (230)..(230): a, c, t, g, unknown or other
  modified_base (275)..(275): a, c, t, g, unknown or other
  modified_base (293)..(293): a, c, t, g, unknown or other
  modified_base (352)..(352): a, c, t, g, unknown or other
  modified_base (422)..(422): a, c, t, g, unknown or other
tcagacgcgatcgacacgaccggtgctcgatttagagagagtgtgttgggtttgggacccaacaaccacatccctcctcagaagcccccagagcacaactcctcaccatggactggacctggaggatccttctttttggtggcagcagccacaggtgtccactcccaggtccagcatgtgcagtctggggctggaggcgaagaagcctggggcctnagtgaaggtttccngcaaggcttctggatacactttcgctgcccatgcattcattgggnccgcgacggcccccgganaaggcttgagtggatgggatggatcaacgcgtggcacgtggtaacacgagaatacgttnaactaagtaaacttccgagacagacgtaccactatttcgagggtacatattcgacgaacacacgacctanactcgacctgagctagtttgagtatcgtagacgacgacggtctcgtactattacgtgtaggcgaggaggggtacggggggagtaacgtagtggacaacgttaagtagtactagtactgtagtcg

SEQ ID NO: 406705 - DNA, 514 bp, Homo sapiens
  misc_feature: GZ8MTXP02FX7XC.45.53.E09.1.454.CMB.2.raw
  modified_base (233)..(233): a, c, t, g, unknown or other
  modified_base (280)..(280): a, c, t, g, unknown or other
  modified_base (295)..(295): a, c, t, g, unknown or other
  modified_base (304)..(304): a, c, t, g, unknown or other
  modified_base (348)..(348): a, c, t, g, unknown or other
  modified_base (355)..(355): a, c, t, g, unknown or other
  modified_base (364)..(364): a, c, t, g, unknown or other
  modified_base (369)..(369): a, c, t, g, unknown or other
  modified_base (383)..(383): a, c, t, g, unknown or other
  modified_base (386)..(386): a, c, t, g, unknown or other
  modified_base (395)..(395): a, c, t, g, unknown or other
  modified_base (397)..(397): a, c, t, g, unknown or other
  modified_base (399)..(399): a, c, t, g, unknown or other
  modified_base (403)..(404): a, c, t, g, unknown or other
  modified_base (414)..(414): a, c, t, g, unknown or other
  modified_base (426)..(426): a, c, t, g, unknown or other
tcagacgcgatcgacacgaccggtgctcgatttagagagagtgtgttggggtttggggacccaacaaccacatccctcctcagaagcccccagagcacaactcctcaccatggactggacctggaggatcctctttttggtggcagcagccacaggtgtccactcccaggtccagcatgtgcagtctggggctgaggcgaagaagccgtggggcctcagtgtaacggtttccngcaaggcttctggactacactttcgctgcccatgcctattcattggncgcaggcccccgganagggcttgngtggatggataggatcaacgcgtggcacctaggtacacagaatnttacaanagaactcgngacanatcactatagaganatntacacgaananancaannagacgtgagntagttgatatanagacgacgacgctctctagtagtagtcgcgaggaggggagggggacgggtagtagtactactaactaagtagtattatactacgtgtg

SEQ ID NO: 406706 - DNA, 603 bp, Homo sapiens
  misc_feature: GZ8MTXP01EAGFG.45.15.B04.1.454.CMB.2.raw
  modified_base (309)..(309): a, c, t, g, unknown or other
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagtagtgtttttacggccccaatagtaagaactacttagcttggaccagcagaagccgaggcagccctctagcctgcttctttacncgggtcctccgtacccgggacggtcccggggtccctggaccgattcccgaggtggcgaggccgggtctggggcagtatttcactcgtcacatcagcacgcctgcagcctagaagatgtcgactaacgtttactaacgttggttaccaggtactaaattattagtaggtactacttcccttctcctaacgttttccggggacgggtaacgggttacccgtaaagggtttcgaccgttacttaaccgtaaaaccgaaccgttgggtacggtcttacggaacccttaaccgttaacg

SEQ ID NO: 406707 - DNA, 579 bp, Homo sapiens
  misc_feature: GZ8MTXP01EHUTS.45.15.B04.1.454.CMB.2.raw
  modified_base (307)..(307): a, c, t, g, unknown or other
  modified_base (363)..(363): a, c, t, g, unknown or other
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagtagttgtttttacggcccaatagtaaagaactacttagcttggtaccagcaagaagccaggcagcctcagcctgcttctttacncggcctcgtacccgggtagtccgggtccctgaccgattcagtggcaggcgggtcgnggggctggtactttcactctcacatcagcaggcctgcagacccgtagaagtagtcgtacgacttaagtttacctaaccggttggtaccgaagacctaaattattagtggtaactacttccctacgttcctacgtttcggggacggttaacgggaccttaaaggttcgacgttaacttacgaaaaccgtaatgtaacggctcgactaaccaagttcc

SEQ ID NO: 406708 - DNA, 551 bp, Homo sapiens
  misc_feature: GZ8MTXP01DKOTC.45.15.B04.1.454.CMB.2.raw
  modified_base (305)..(305): a, c, t, g, unknown or other
  modified_base (339)..(339): a, c, t, g, unknown or other
  modified_base (366)..(366): a, c, t, g, unknown or other
  modified_base (544)..(544): a, c, t, g, unknown or other
tcagacgcgatcgacacgaccggtgctcgatttagacagtatatatccgcgggggctacaacaggcaggcaggggcagcaagatggtgttgcagacccaggtcttcatttctctgttgctctggatctctgttgcctacggggacatcgtgatgacccagtctccagactccctgactgtgtctctgggcgagagggccaccatcaactgcaggtccagccagagtgtttttacggccccaatagtaaagaactactagcttggtaccagcagaagccagggcagcctctagcctgctctttacnggcctcgtacccgggacgtccgggtcctgaccgnttcagtggcaggcgggtcgtgggggcngatttcactctcacatcagcagcctgcagcctagacgtatgtcgactagtttacctacgttgtcaagacctaattattagtgtaatcttcctctcctacggtttcgggcgggttacgggtaccgaggttcgcgttaaacttcgaaaaccgtaagtggtaacggctcggacctaaccgngtttccg

SEQ ID NO: 406709 - DNA, 582 bp, Homo sapiens
  misc_feature: GZ8MTXP01B0NAU.45.15.B04.1.454.CMB.2.raw
  modified_base (306)..(306): a, c, t, g, unknown or other
  modified_base (403)..(403): a, c, t, g, unknown or other
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagtagttgtttttacggccccaatagtaagaactactagcttggaccagcagaagccaggcagcctctagcctgctctttacnggcctcgtacccggagtccgggtcctgaccgattccagtggcagcgggtctggggcagactttcactctcacatcagcagcctgcagcctagaacgntcgtcgactaagtttactaacgttggtccaagtacctaaagttattaagtggtaatactttccctcgttctaacggttttccggggacggtaacgggacccgtaaagggttcgaccggttaattacccgaaaaaccggtcttcgggtcgggtaccttaggaacccgttaacccttaacg

SEQ ID NO: 406710 - DNA, 552 bp, Homo sapiens
  misc_feature: GZ8MTXP01A5285.45.15.B04.1.454.CMB.2.raw
  modified_base (371)..(371): a, c, t, g, unknown or other
  modified_base (412)..(412): a, c, t, g, unknown or other
  modified_base (445)..(445): a, c, t, g, unknown or other
  modified_base (449)..(449): a, c, t, g, unknown or other
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaaagaactacttagcttggtaccagcagaagccagggcagcctcagcctgcttctttacgtggcctcgtaccccgggagtcccggggtcctgaccgtattcgacgtggcagcgggtctgggggcngtatttcgactctcacatcagctagcctgcagcctagaacntgcgctagtttacacgtgtaccagctaaagttnttanggtaatctttacctcttccgtacgtttcgggcggttagggtacccttagggttcgacttacgttccaaaacgtaactggtaaggctacggctaaccttgttcc

SEQ ID NO: 406711 - DNA, 648 bp, Homo sapiens
  misc_feature: GZ8MTXP01BSUBN.45.15.B04.1.454.CMB.2.raw
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagttgtttttaccggcccaatagtaagaactactagcttggtaccagcagaagccagggcagcctctagcctgtcttctttacgcggtccctaccggtaccccgggtaggtccccgggggtccctacggtacccgtagtttccgaggttcgggacgacgggtccggggtaccgtcgggggactaaggtactttccgaccttcctaccgaccatcgacgtcacgcctgcctacgacccgttagaaagtcgtcgtccgtacttaacggttttacctaacggttcgtacgaagtaacctaaatttattacgtaggtacttaccttcctactccgtaccgtttcgggacgggttacggtaaccgttaggttcggacgttacgttacgaaaccgtaagtcggtcgtctacggacctaaccttcgtttccg

SEQ ID NO: 406712 - DNA, 655 bp, Homo sapiens
  misc_feature: GZ8MTXP01B5XDN.45.15.B04.1.454.CMB.2.raw
  modified_base (259)..(259): a, c, t, g, unknown or other
tcagacgcgatcgacacgaccggtgctcgatttagacagtatatatccgcgggggagctacaacaggcaggcaggggcagcaagatggtgttgcagacccaggtcttcatttctctgttgctctggatctctggtgccgtacggggacatcgtgatgacccagtctccagacctccctgactgtgtctcgtgggcgagacgggccaccatacaactgcacggtccagccagtagttcgttttaccgaccctaatagaanactactagctgacagcagaacgccgaggcacgcctcctacgcctgtcctttcgtttacgtcgggtccctcccggtacccggggtcggttcccgggtccctacggaccgtagttcccgaggtcggcgacggtcgggtcgtcggggcaggtacttccacctcctaccgacctatacgagccgacgcctagcaacggtcctaggaacgtcgtcgtcgtacttacgtttacacttgtaccagtaataattattagtagtaacttccgttccttacgttacgttaaccgggtttacggggaccggggttaaacggttaccgtaaagggttcggaacccgttaagttaaacccgtaaaaccggtgttcggtccgggacttacgggaacccttaacgtttccg

SEQ ID NO: 406713 - DNA, 747 bp, Homo sapiens
  misc_feature: GZ8MTXP01DJYZH.45.15.B04.1.454.CMB.2.raw
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacggggacatcgtgatgacccagtctccagactccctgactgtgtctcgtgggcgagacgggccaccatcaactgcaggtccagcagtagttcgttttaccgcccaatagtaagactactagcttggtaccagacagaacgcgagggcacgcctacctacgcctcgtctttccgtttacgtcggtccctccggtaccccggggtacggtcccgggggtccctacgaccgtattcgacggtcggacgacgggtccggggtcggtacgggggactaaggtactttccaccgttcctaccacctatccgagcacgtccctgaccaggtacctaggaaagtacgttcgggtacccgtacgtttaacgttttaaccctaacggttacggtaaccgtaaacgtaaccttaaaatttaagtttaacgtacgggttaaactttacccgttttcccctttaccgttaccccggtttaaccgggttttaacccgggggaaccggggttaaacggggttaaaccccgttaaaggggtttaccgaccgttaaaacgttaacccgaaaaacgggttccgtagggtcggtaccgtacgacccttaacccgttaaggttttcccg

SEQ ID NO: 406714 - DNA, 657 bp, Homo sapiens
  misc_feature: GZ8MTXP01CY2GQ.45.15.B04.1.454.CMB.2.raw
  modified_base (385)..(385): a, c, t, g, unknown or other
  modified_base (400)..(400): a, c, t, g, unknown or other
  modified_base (411)..(411): a, c, t, g, unknown or other
  modified_base (495)..(495): a, c, t, g, unknown or other
  modified_base (520)..(520): a, c, t, g, unknown or other
  modified_base (633)..(633): a, c, t, g, unknown or other
tcagacgcgatcgacacgaccggtgctcgatttagacagtatatatccgcgggggctacaacaggcaggcaggggcagcaagatggtgttgcagacccaggtcttcatttctctgttgctctggatctctggtgccgtacggggacatcgtgatgacccagtctccagactccctgactgtgtctcgtgggcgaggacgggccaccatcaactgcgacggtccagccaagtaggtttacgtttttaccggaccctaaagtaagtaaacgtaacttacgttagtcgttacggtaaccagacaagacgaccgagggcacgcctcacgcctgtcttctttacgtcgggtcctccggtaccggggtcggtccggggtcctcggaccgtntccgaggtcggacgnggtcgggtcgnggggcctgtacttccactctaccacgatcagtcacgcctagccctaagcgttagagtacgtcgaccgtacttacgtttaacccngggtttaccgagtaactataaattntaaggtcgtaaacttcctttcccgtactaccggttaccggttaaccgggacggggttaacggtaaaccgttggttacggacttaacgttaaccgaacgtaagttcgcggttcncggttaccctaacgttcgtttccg

SEQ ID NO: 406715 - DNA, 506 bp, Homo sapiens
  misc_feature: GZ8MTXP01EYR5L.45.15.B04.1.454.CMB.2.raw
  modified_base (301)..(301): a, c, t, g, unknown or other
  modified_base (421)..(421): a, c, t, g, unknown or other
  modified_base (498)..(498): a, c, t, g, unknown or other
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggcccaatagtaagaactactagcttgacagcagaagccaggcagcctctagcctgctctttacngggcctcgtacccgggagtccgggtcctgaccgattccagtgcagcggtctggggcagatttcactctcacatcagcagcctgcagctagaagatgtcgactagtttaccatggtcaganaatatatagatatctctctaacgtttcggcgggagggaccgaaaggtagttcgattacgaaacgaactaagtgtgcncgaactaa

SEQ ID NO: 406716 - DNA, 511 bp, Homo sapiens
  misc_feature: GZ8MTXP01EREMC.45.15.B04.1.454.CMB.2.raw
  modified_base (300)..(300): a, c, t, g, unknown or other
  modified_base (358)..(358): a, c, t, g, unknown or other
  modified_base (374)..(374): a, c, t, g, unknown or other
  modified_base (383)..(386): a, c, t, g, unknown or other
  modified_base (388)..(388): a, c, t, g, unknown or other
  modified_base (391)..(391): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (410)..(410): a, c, t, g, unknown or other
  modified_base (412)..(412): a, c, t, g, unknown or other
  modified_base (414)..(414): a, c, t, g, unknown or other
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgttttacgcccaatagtaaagaactactagcttggtaccagcagaagccaggcagcctcagctgctcttttacnggtcctctacccgggagtccggggtcctcgacgattcagtggcagcgggtctggggcngtatttcactctcacntcagcagcnnnncnganantcntattactacgtntnananaataatatagatactctctctcgtcggtacggacggacgttaagtacgtacgaacgttaacaaacgtaacgtagtaagtcgcgactaaccttaactc

SEQ ID NO: 406717 - DNA, 585 bp, Homo sapiens
  misc_feature: GZ8MTXP01BHJ1F.45.15.B04.1.454.CMB.2.raw
  modified_base (344)..(344): a, c, t, g, unknown or other
  modified_base (355)..(355): a, c, t, g, unknown or other
  modified_base (364)..(364): a, c, t, g, unknown or other
  modified_base (412)..(412): a, c, t, g, unknown or other
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctggcgagaggccaccatcaactgcaggtccagccagtagttgtttttacggccctaatagtaagaactactagcttggaccagcagaagccagggcagcctcctagcctgcttctttactcgggcctcgtacccgggagtcccggggtcctgaccgnttccagtggcnggcgggtcnggggcagtattcactctcaccatcagcagcctggcagcctagaacgtntcgtacgattacgtttaacctacgtggtaccaagtaccttaaatatttacaggtatacttccctactccgttaacgtttcgggaccgggtacgggacccgtaaaggggtttcaccggttaacttaccgtaaaaacggtcgtcgggttggaccttcggaaccttaaccctaacg

SEQ ID NO: 406718 - DNA, 527 bp, Homo sapiens
  misc_feature: GZ8MTXP02I63Q9.45.15.B04.1.454.CMB.2.raw
  modified_base (303)..(303): a, c, t, g, unknown or other
  modified_base (359)..(359): a, c, t, g, unknown or other
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggcccaatagtaagaactacttagcttggtaccagcagaagccaggcagcctctagcctgctctttacnggcctctacccgggagtccggggtccctgaccgattcagtgcagcggtctggggcngatttcactctcaccatcagcagccctgcagcctgaagatgtcgctagtttacactgtcagcaatatatgagattcctctcactttcggcggagggaccaaagggttcgacgaacttaccgaaaacgtaaaccgttggttacgggacttcggaccaaacccgtactcg

SEQ ID NO: 406719 - DNA, 519 bp, Homo sapiens
  misc_feature: GZ8MTXP02F7C5K.45.15.B04.1.454.CMB.2.raw
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccagggcagcctcctagcctgctctttactgggcctctacccgggagtccgggtcctgaccgattccagtgcagcggtctggggcagatttcgactctcaccatcagcagcctgcagcctgaagatgcgctagtttactactgtcagcaaatattatgagtattcctctctacgtttcgggacggtacgggaaccctaaagggttcgacgaatacgaaaacgactgtacggctagcaccta

SEQ ID NO: 406720 - DNA, 518 bp, Homo sapiens
  misc_feature: GZ8MTXP02HELYB.45.15.B04.1.454.CMB.2.raw
  modified_base (304)..(304): a, c, t, g, unknown or other
  modified_base (366)..(366): a, c, t, g, unknown or other
tcagacgcgatcgacacgaccggtgctcgatttagacagtatatatccgcggggctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccagggcagcctctagcctgctctttacnggcctctacccgggagtcccggggtccctgaccgattcacgtggcccagcgggtctggggcngatttcactctcaccatcagcagcctgcagcctgaagatgtcgctagtttactactgtcagctaatattatgagtattcctctctactttcggcggagggtaccaaagggttcgacgactacgaaaacgaacgtgtacggctgcaccgatcg

SEQ ID NO: 406721 - DNA, 577 bp, Homo sapiens
  misc_feature: GZ8MTXP02JH15Z.45.15.B04.1.454.CMB.2.raw
  modified_base (405)..(405): a, c, t, g, unknown or other
  modified_base (425)..(425): a, c, t, g, unknown or other
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagttgtttttaccggccccaatagtaagaactacttagcttggtaccagcaagaagccagggcagccctttccacgccccgctctttacgcggccctccgtacccgggcggtcccgggtccctgaccgtattcaggtaggaaggtcggtcgtggggacagtcttcactcctcaccatcancacgcctagcagcctagaanatgtcgatacgtttacagtcgtacagactaaatattaagtgaatactttcctcttactaacgtttccggggagggtaacgggtaaccaaaggggttcaacgtaactaaaccgaaaacggaacttggacgtactacgaccaacctataccttg

SEQ ID NO: 406722 - DNA, 522 bp, Homo sapiens
  misc_feature: GZ8MTXP02JGXPO.45.15.B04.1.454.CMB.2.raw
  modified_base (308)..(308): a, c, t, g, unknown or other
  modified_base (444)..(444): a, c, t, g, unknown or other
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccagggcagcctccagcctgctcttttacngggcctctacccgggagtccggggtccctgaccgattccagtgcagcgggtctggggcagatttcactctcaccatcagcagcctgcagcctagaagatgtcgctagtttactactgtcagctaaatattatgaanatttcctctctacgttttcggcggaacgggaccaaagggtttcgaccgaatacaaaacgactagtcggctagccacta

SEQ ID NO: 406723 - DNA, 539 bp, Homo sapiens
  misc_feature: GZ8MTXP02HOG1V.45.15.B04.1.454.CMB.2.raw
  modified_base (305)..(305): a, c, t, g, unknown or other
  modified_base (408)..(408): a, c, t, g, unknown or other
  modified_base (422)..(422): a, c, t, g, unknown or other
  modified_base (438)..(438): a, c, t, g, unknown or other
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactactagcttggtaccagcagaagccaggcagcctctagcctgctctttacnggcctcgtacccgggagtcccgggtcctgaccgatccagtgcaggcggtctggggcagtatttcactctcaccatcagcagccctgcagccctagaagatgcntagtttactacgtntacagactaatattangatacttcctctctacgtttcgggacgggtaacggaccgtaaaggttcgaccgtaattaccgaaaaacggtactaggtacggactcgacctaacccgtacg

SEQ ID NO: 406724 - DNA, 548 bp, Homo sapiens
  misc_feature: GZ8MTXP02HVVDL.45.15.B04.1.454.CMB.2.raw
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagttgtttttacggccccaatagtaagaactacttagctggtacagcagagcaggcagcctctagcctgcttctttactcgggcctcgtacccgggagtcccggggtccctgaccgtattccagtcggcaggcgggtctggggcagtattcactcctcacatcagcagcctgccagccctagaagtatgtcgactacgtttactactgtaccagactaatattagtgacgtacttacctctacgtacgtttcgggacgggtaacggaccgtaaggttcgaccgtaataccgaaaacggtactcggtcgactcgacctacctag

SEQ ID NO: 406725 - DNA, 615 bp, Homo sapiens
  misc_feature: GZ8MTXP02JXYOC.45.15.B04.1.454.CMB.2.raw
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacggggacatcgtgatgacccagtcctccagacctccctgactgtgtctcgtgggcgagacgggccaccatcaactgcaggtccagccagtagttgtttttaccggccctaatagtaagaactactagcttagtaccagcagaacgccgagggcagtccctctacgcctgtccttctttacgtcgggtccctccggtaccccgggtacggtcccgggtccctgaccgtacttcgacggtcggcgtacggtcgggtcgtggggctaggtctttccgacctccgtcaaccgtatccgaacgcacgccctgcacgtccgtagaagtctcgtctacgtagtttaccacgtagtccaagtactaaagttactagtacgtacttcttccttctaccgttacgttccgggacggtacggtaaccgtaggttcgaacgtactaaccgaaacgtaacgtcggacgtactacgaccgtactctttccg

SEQ ID NO: 406726 - DNA, 577 bp, Homo sapiens
  misc_feature: GZ8MTXP02H7NZ2.45.15.B04.1.454.CMB.2.raw
  modified_base (370)..(370): a, c, t, g, unknown or other
  modified_base (423)..(423): a, c, t, g, unknown or other
  modified_base (470)..(470): a, c, t, g, unknown or other
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacggggacatcgtgatgacccagtcctccagactccctgactgtgtctctgggcgagagggccaccatcaactgcaggtccagccagagttgttttacggcccaatagtaagactactagctggaccagcagagcaggcagcctcagcctgctctttacgcgggtcctccgtacccggggaggtcccggggtcccctggacccgattccaggtggcaggcgggtcgtggggcnggtactttcacttctccaccatcacgcacgccctagcacgcccgtagaaacgngtacgtcgacttaacgttttactacgttgtacagactaaattattanagtacgtacttcctctcgtaccgtttcgggacggaacgggtaccgtaagggttcgacgaacgttacgaaaacgtaacgttggtacggtctacgacctaacctattcg

SEQ ID NO: 406727 - DNA, 551 bp, Homo sapiens
  misc_feature: GZ8MTXP02H1443.45.15.B04.1.454.CMB.2.raw
  modified_base (308)..(308): a, c, t, g, unknown or other
  modified_base (344)..(344): a, c, t, g, unknown or other
  modified_base (369)..(369): a, c, t, g, unknown or other
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacggggacatcgtgatgacccagtctccagactcccctgactgtgtctctgggcgagagggccaccatcaactgcaggtccagccagagttgtttttacggcccaatagtaagaactactagcttggtaccagcagaagccagggcagcctcctagcctgcttctttacgnggtcctcgtacccgggagtcccggggtcctgaccgnttcagtggcaggcgggtctggggcngtatttcactctcacatcagcagccctgcagtcctagaagtatgtcgacgtaagtttactacttggtcagactaatattatgtagtacttcctctctacgtttcgggacggtacgggaaccgtaaagggttcgacgtaacttacgaaaacgtaacgtggtacggctacgacctacctattcg

SEQ ID NO: 406728 - DNA, 628 bp, Homo sapiens
  misc_feature: GZ8MTXP02HZ558.45.15.B04.1.454.CMB.2.raw
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacggggacatcgtgatgacccagtctccagactccctgactgtgtctctgggcgaggagggccaccatcaactgcaggtccagccagagttgtttttacggccctaatagtaagaactactagcttggaccagcagaagccaggcagcctcagcctgctctttacgcggtcctcgtacccgggtacgtcccggggtccctaggaccgtattccgacggtcggcacggccggggtcgttcggggctaggtactttcaccttccgtaccacctaatccgacgcgaacgcccgtcgccgacgtaccctaggaaagtagttcggtaccgacttaaggttttaaccctacgttacggttacaagtacctaaaattagtttaataggtaactctttacccttcttaccgtacgttttcgggacgggtacggaccgtaaagggtcgacgacgttaacgaaaacgtaacgtggtaacggtctacggaccacgtattccg

SEQ ID NO: 406729 - DNA, 532 bp, Homo sapiens
  misc_feature: GZ8MTXP02JTXCG.45.15.B04.1.454.CMB.2.raw
  modified_base (304)..(304): a, c, t, g, unknown or other
  modified_base (320)..(320): a, c, t, g, unknown or other
  modified_base (361)..(361): a, c, t, g, unknown or other
  modified_base (434)..(434): a, c, t, g, unknown or other
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagttgtttttacggccccaatagtaagaactacttagcttggtaccagcagaagccaggcagcctcagcctgctctttacnggcctcgtacccgggngtccggggtcctgaccgattcagtgcagcgggtctggggcngtatttcactctcaccatcagcagcctgcagcctgaacgatgtcgctagtttactactgtcagacaatattanagtttttagacttcctctctacgttcggtacggacgggtaccgtaaggttcgacgtactacgtaaacgaacgtcgtacggtcgtacgacacctactcg

SEQ ID NO: 406730 - DNA, 583 bp, Homo sapiens
  misc_feature: GZ8MTXP02HND2Q.45.15.B04.1.454.CMB.2.raw
  modified_base (281)..(281): a, c, t, g, unknown or other
  modified_base (447)..(447): a, c, t, g, unknown or other
tcagacgcgatcgacacgaccggtgctcgatttagacagtatatatccgcgggggctacaacaggcaggcaggggcagcaagatggtgttgcagaccccaggtcttcatttctctgttgctctggatctctggtgcctacggggacatcgtgatgacccagtctccagacctccctgactgtgtctctgggcgagagggccaccatcaactgcaggtccagccagagttgtttttaccggccccaataagtaagaactacttagcttggtaccagcagaanccagggcagccctcctagcctgtcttctttacgtcgggcctcgtacccggggacggtcccggggtcctgaccgtattcgagtggcagggcgggtcgtcggggcaggtactttcacctctacctaccatccgagcacgcccgtagctacgcctaggaagattggacncttaaacgtttactacgtgttacagactaaattataatggattacttcctactcgtaccgtttcgggacgggtaacggaccgtaaagggttcacgaattaaccgaaaaccgtaagttgcggctagccaccgtattc

SEQ ID NO: 406731 - DNA, 570 bp, Homo sapiens
  misc_feature: GZ8MTXP02FED6P.45.15.B04.1.454.CMB.2.raw
  modified_base (437)..(437): a, c, t, g, unknown or other
  modified_base (536)..(536): a, c, t, g, unknown or other
  modified_base (557)..(557): a, c, t, g, unknown or other
  modified_base (565)..(565): a, c, t, g, unknown or other
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacggggacatcgtgatgacccagtctccagactcctgactgtgtctcgtggcgagagggccaccatcaactgcacggtccagccagtagttcgttttttaccggccctaaatagtaagaactacttagcttggtacagcagaagccgagggcagcctctagcctgcttcttttacgtcggtcctccgtacccggggacgtcccgggggtccctgaccgtatttccgagtggcaggcggggtcgtcggggctagtactttcactcctacacagtcaacgcacgcctagcagccctagaaantcgtacgcttaaagtttctaactgtacagactaaatattatgaagtctcctcttacacgtttcgggacgggacgggaacctaaagggttcgcgtaaacncgaaaacgtaacgtgtggctnaccaactnttccg

SEQ ID NO: 406732 - DNA, 628 bp, Homo sapiens
  misc_feature: GZ8MTXP02I4X4R.45.15.B04.1.454.CMB.2.raw
  modified_base (352)..(352): a, c, t, g, unknown or other
tcagacgcgatcgacacgaccggtgctcgatttagacagtatatatccgcgggggagctacaacaggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagtagttgtttttacggccccaatagtaagaactacttagcttgtaccagcagaagccagggcacgcctcctagcctgctcttttacgcgggcctccgtacccgggagtcccggggtccctcgaccgtnttccagtggcaggtcgggtcgtggggctagtactttcgactcctcgacctatcagcagcctgccacgcccttaggaaagtactcggtcgtacgttaacggttttaacctaccgttaggttacccaaggtacctaaaattagtttaagtgtaaacgttactttcccctacgttaccgttaaccggtttccggggacggggtaacggggtaacccgtaagggtttcgacgtaacgttaaccgaaaacgtacgtcggtcggctcggacctacgtttacg

SEQ ID NO: 406733 - DNA, 620 bp, Homo sapiens
  misc_feature: GZ8MTXP02GBXF3.45.15.B04.1.454.CMB.2.raw
  modified_base (379)..(379): a, c, t, g, unknown or other
  modified_base (420)..(420): a, c, t, g, unknown or other
tcagacgcgatcgacacgaccggtgctcgatttagacagtatatatccgcgggggctacaacaggcaggcaggggcagcaagatggtgttgcagacccaggtcttcatttctctgttgctctggatctctggtgcctacgggacatcgtgatgaccagtctccagactccctgactgtgtctcgtgggcgagacgggccaccatcaactgcacggtccagccagtacgttcgtttttaccggaccctaatagtaagaactacttagcttagtaccagcagaagcaggcacgcctctagcctgtcttctttacgcggcctcgtacccgggacgtccgggtccctagaccgtatcaggtcgcgaggcgggtcgtggggacngtacttcacgttcctaccaacgactcgacgtcgacgtcccnggactacgccttaggaaactacgttcgtacgtacttaacggtttaactacgttcggttacaacggtaactaaagttaattagtagtaacgttacttcctacgtacgtacgtttacgggacggtaaacggtaccgtaagtacgtacgtaaactaccgaaaacgtaacgtcggtacggtctacggtacaccgttaagttccg

SEQ ID NO: 406734 - DNA, 803 bp, Homo sapiens
  misc_feature: GZ8MTXP02JEQSP.45.15.B04.1.454.CMB.2.raw
tcagacgcgatcgacacgaccggtgctcgatttagacagtatatatccgcgggggctacaacaggcaggcaggggcagcaagatggtgttgcagacccaggtcttcatttctctgttgctctggatctctggtgccgtacggggacatcgtgatgacccagtcctccagacctccctgactgtgtctcgtgggcgaggacggccaccgatccaactgacacggtccagccagtagttcgttttaccggaccctaagtagtaacgaacttacgtagtcgttaggaccagcaagaacgccgagggccacgtccctaccgtacgcctcgtccttactttaccgtcgggtccccttacccggtaccccggggtacggtccccggggttccctacggtacccgtagtttaccgacggttcgggaccgtacgggtccggggttccggtagggggtacctagggttaccttttacccggaaccgttcccctaaccctaacccgtagtaccccgtaacgacccgtaaccgcccgttaacgcccgaacggtcccgttaaagggaaacgttacgttccgggtaccgtaccgtttaaacggtttaacctacgtttacggtacgtaaccgtaattaaaactttagtttaacgtacggtaacgttacccgtttaccctccgttaacggttacccggtttacgggggaaccggggttaacgggtaaaccccggttaaggttacccggaacgtaaaccgtaaccggtaaaaaccgtccggtggtaccggtactacggtaccctaacctacgtttcccg

SEQ ID NO: 406735 - DNA, 472 bp, Homo sapiens
  misc_feature: GZ8MTXP01CKL81.3.21.B10.1.454.CMB.2.raw
  modified_base (463)..(472): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgttattactgtgcaagagcgaggaggagcagtttgacagctggggccaggggaaccctggtcaccgtctcctcagcctccaccaagggcccactcggtctccccctggccgccctgctccagggagcacctccgagacgcacagcggccctgggctgcctggtcaggctactcgagtcggcgtcctgagcggctggcaggcgcatgnnnnnnnnnn

SEQ ID NO: 406736 - DNA, 486 bp, Homo sapiens
  misc_feature: GZ8MTXP01CV8MY.3.21.B10.1.454.CMB.2.raw
  modified_base (478)..(486): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaaagtcgagtaatcatcaaacgccgacacatccaggaaccagttctccctgcaactgaagtctgtgactcccgaggacacggctgttatactgtgcaagagcgaggaggagcagtttgacagctggggccagggaaccctggtcaccgtctcctcagcctccaccaaggcccactccggtctccccctggccaaccctcctccaaagacgccaccctcgtcgggggcacgacgcggccctgggctgccctggtcaaggactacttccgagtgcgtcgtctgagcgggctggcaaggcgcatagnnnnnnnnn

SEQ ID NO: 406737 - DNA, 477 bp, Homo sapiens
  misc_feature: GZ8MTXP01AM88R.3.21.B10.1.454.CMB.2.raw
  modified_base (367)..(367): a, c, t, g, unknown or other
  modified_base (442)..(442): a, c, t, g, unknown or other
  modified_base (466)..(466): a, c, t, g, unknown or other
  modified_base (468)..(468): a, c, t, g, unknown or other
  modified_base (470)..(477): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagtttgacagctggggccaggggaacccctggtcaccgtctcctcagcctccaccaagggcccatcggtcttcccctggcnccctgctcccagggacgcacctccgagagcacagcggccctgggctgcctgtcaaggctacttccgagtggcgtntctgagcgggctgggccaggccgnangnnnnnnnn

SEQ ID NO: 406738 - DNA, 703 bp, Homo sapiens
  misc_feature: GZ8MTXP01BTXD8.3.21.B10.1.454.CMB.2.raw
tcagagacgcactccacgaccggtgctcgatttagtgtcgtcgcaagagaggagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgaccaaaggagacagcctacaagaagtcttattatgacaagctaggtaccagcaagaacgccgaaggacacggcccctagttacttgtcatactaagtaacggtaaaaaaccacccggtccctacgaacgggactacccgaagaccgtattcctccgtacggcctaccgacgtcctaacgaaacggaaccacgtacgtacctttacccgttacgaaccattaccgaacggttcggggaccttaccgaaggggaccggtaaagtagttacgggagggtacctaaggtaactttaacgtttaaccgtaccggttaaacccgggttccccgggggaaccaagggaccgtaaggttacgggtaaactagtttaggtagtaacgttacgttcgggggacggggaaacggaaccgttaaggggtccaaccggttcccgaacgttcgacgttacccgaaggccctaaccgcccctacgggttcctaaccgttccgttccccg

SEQ ID NO: 406739 - DNA, 486 bp, Homo sapiens
  misc_feature: GZ8MTXP01AYCID.3.21.B10.1.454.CMB.2.raw
  modified_base (199)..(199): a, c, t, g, unknown or other
  modified_base (218)..(218): a, c, t, g, unknown or other
  modified_base (369)..(369): a, c, t, g, unknown or other
  modified_base (470)..(470): a, c, t, g, unknown or other
  modified_base (473)..(486): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaaggctttatacaagtccaagtgggaacatcattatgcagaatctgtgaaaaagtcgagtaatcatcaacgccganacatccaggaaccagttcnccctgcaactgaagtctgtgactcccgaggacacggcttgttatactgtgcaagagcgaggaggagcagttttgacaggctggggccagggaaccctggtcaccgtctcctcacgcctccacaacgggccactccggtctccccgtggccnccctgctccaggagccacctccgagacgcacagcggccctgggctgcctgtcaagactactcgagtcggcgtctcgtgagcggggctggaccaaggccganagnnnnnnnnnnnnnn

SEQ ID NO: 406740 - DNA, 467 bp, Homo sapiens
  misc_feature: GZ8MTXP01A5Z09.3.21.B10.1.454.CMB.2.raw
  modified_base (217)..(217): a, c, t, g, unknown or other
  modified_base (270)..(270): a, c, t, g, unknown or other
  modified_base (290)..(290): a, c, t, g, unknown or other
  modified_base (314)..(314): a, c, t, g, unknown or other
  modified_base (319)..(319): a, c, t, g, unknown or other
  modified_base (321)..(321): a, c, t, g, unknown or other
  modified_base (331)..(331): a, c, t, g, unknown or other
  modified_base (351)..(351): a, c, t, g, unknown or other
  modified_base (353)..(353): a, c, t, g, unknown or other
  modified_base (363)..(363): a, c, t, g, unknown or other
  modified_base (369)..(369): a, c, t, g, unknown or other
  modified_base (375)..(375): a, c, t, g, unknown or other
  modified_base (390)..(390): a, c, t, g, unknown or other
  modified_base (412)..(412): a, c, t, g, unknown or other
  modified_base (454)..(467): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaaggctttatacaagtccaagtgggaacatcattatgcagaatctgtgaaaagtcgagtaatcatcaacgccgacacatccaggaaccagttcnccctgcaactgaagtctgtgactccgaggacacggctgttatactgtgcaagngcgaggagagcagtttgacngctggggccaggacctgcacgtcnctgcncnccacgacgcncgtcgtcctccgcgccctcncncctcgacgcncctccncgagcncacgcggccgcgcgncgcgtgacgacgactcgtacgngtcggtcgtcttcgaggcggcgtcggcgacggacgcgcaagnnnnnnnnnnnnnn

SEQ ID NO: 406741 - DNA, 512 bp, Homo sapiens
  misc_feature: GZ8MTXP01ENTMB.3.21.B10.1.454.CMB.2.raw
  modified_base (221)..(221): a, c, t, g, unknown or other
  modified_base (375)..(375): a, c, t, g, unknown or other
  modified_base (498)..(512): a, c, t, g, unknown or other
tcagagacgcactccacgaccggtgctcgatttagtgtcgtcgcaaggggccaggtagtctctacttacgagactgcatggaattggttcaggctgtccccttcgagaggccttgagtggctgggaaggctttatacaagtccaagtgggaacatcatttatgcagaattctagtgaaaagtcgagtaatcatcaacgccgacacatccaggaccagttcnccctgcaacgtgaagtctgtcgactcccgaggacacggtctgtttatactgtgcaagagcgagagagcagtttgacagctggggccaggggaaccctggtcaccgtctcctcagcctccaccaagggccccccagtcgtcttccccctggcccncccttgcctccgacgggtacgccaccgtccgacgcgcacagccgccctagggctacgtcctggtcaacgactacttccgaggtcgacgtctcgtgacgcgggctcggcgaacggcgcaagtgnnnnnnnnnnnnnnn

SEQ ID NO: 406742 - DNA, 527 bp, Homo sapiens
  misc_feature: GZ8MTXP01BNAV9.3.21.B10.1.454.CMB.2.raw
  modified_base (509)..(527): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgttatactgtgcaagagcgaggaggagcagtttgactagctggggccaggggacccctggtcaccgtctccctcacgccctccaccgaacgggcccacgtccggtccttcccccgtggcccgcccctgcctccgacgggacgccaccctccgagacgcacgacggccggcccgtgggctcgccgtggtacaaggacctacgtccgagtcggcgttctcgtgacgcgggcgtggacgaacggcgacgagtaggnnnnnnnnnnnnnnnnnnn

SEQ ID NO: 406743 - DNA, 534 bp, Homo sapiens
  misc_feature: GZ8MTXP01EP318.3.21.B10.1.454.CMB.2.raw
  modified_base (522)..(534): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgttattactgtgcaagagcgaggaggagcagtttgacagcgtggggccaggggaacccctggtcaccgtctccctcacgcctccaccgaacgggccccactccggtccttcccccgtggcccgcccctcgcctcccgaggcgccacccgtccgacgcgccacgacggccggcccgtggggctcggcccgtggtaccgaacggacctaccgttccgtacggtcgggcgttcgtcgtggacggcgggcgtgggacgaggcgcgagtgnnnnnnnnnnnnn

SEQ ID NO: 406744 - DNA, 554 bp, Homo sapiens
  misc_feature: GZ8MTXP01B3UR1.3.21.B10.1.454.CMB.2.raw
  modified_base (536)..(554): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggcttgttattactgtgcaagagcgaggaggagcagttttgacagctgggggccaggggaacccctggtccaccggtctccctcagcctccaccaaggggccccactccgggtcttcccccgtcggccgcccctgccctccgagggacgccaccctccgagacgccacacggccggcccgtcggggcctcggacccgtgggtaccaacgggtaccttaccgttccgagttcgggtcgtccgtcgtcggacggccggggcgtgggaccgaacggcggcctagtgnnnnnnnnnnnnnnnnnnn

SEQ ID NO: 406745 - DNA, 474 bp, Homo sapiens
  misc_feature: GZ8MTXP01BLSUS.3.21.B10.1.454.CMB.2.raw
  modified_base (330)..(330): a, c, t, g, unknown or other
  modified_base (361)..(361): a, c, t, g, unknown or other
  modified_base (386)..(386): a, c, t, g, unknown or other
  modified_base (461)..(474): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaaggctttatacaagtccaagtgggaacatcattatgcagaatctgtgaaaagtcgagtaatcatcaacgccgacacatccaggaaccagttctccctgcaactgaagtctgtgactcccgaggacacggcttgtttatactgtgcaagagcgaggaggagcagttttgacagctgggggccaggggacccctggcacggtctcctnagcctccacaaggccatcggctcccctgccnccctgctccagggcccacctcgagngcacagcgcccgtggctgcctggtcaaggactacttccgagtgcgtctctcggagcggctggcaaggcgcagtgnnnnnnnnnnnnnn

SEQ ID NO: 406746 - DNA, 496 bp, Homo sapiens
  misc_feature: GZ8MTXP01A14NS.3.21.B10.1.454.CMB.2.raw
  modified_base (358)..(358): a, c, t, g, unknown or other
  modified_base (484)..(484): a, c, t, g, unknown or other
  modified_base (487)..(496): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggcttatacaagtccaagtgggaacatcattatgcagaatctgtgaaaagtcgagtaatcatcaacgccgacacatccaggaaccagttctccctgcaactgaagtctgtgactcccgaggacacggctgttattactgtgcaagagcgaggaggagcagtttgacagctggggccagggaccctggtcaccgtctcctcagcctccacaaggcccatccggtcttccccgnggccgcccctgcctccgaggacgccaccctccgacgacgccacgacggcccggcccgtgggccttcggccctggtccaagggcctacgtccgagtcgcgtctcgtgagcggctggccaaggcgacntgnnnnnnnnnn

SEQ ID NO: 406747 - DNA, 469 bp, Homo sapiens
  misc_feature: GZ8MTXP01E3RXV.3.21.B10.1.454.CMB.2.raw
  modified_base (386)..(386): a, c, t, g, unknown or other
  modified_base (446)..(446): a, c, t, g, unknown or other
  modified_base (463)..(469): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagtttgacagctggggccaggggaaccctggtcaccgtctcctcagcctccacaagggcccatcggtctcccctgcgccctgctccaggagcacctcganagcacagcggcctgggctgcctggtcaaggctacttccgagtggcgtctctgagccgggntggcaagggcacatagnnnnnnn

SEQ ID NO: 406748 - DNA, 483 bp, Homo sapiens
  misc_feature: GZ8MTXP01EXENI.3.21.B10.1.454.CMB.2.raw
  modified_base (218)..(218): a, c, t, g, unknown or other
  modified_base (273)..(273): a, c, t, g, unknown or other
  modified_base (380)..(380): a, c, t, g, unknown or other
  modified_base (472)..(483): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttcnccctgcaactgaagtctgtgactcccgaggacacggctgttattactgtgcaagngcgaggaggagcagttttgacagctggggccaggggaaccctggtcaccgtctccctcagcctccaccaagggccactcggtctcccctgccgccctgctccaggcncacctccgagacgcacagcgccctgggctgcctggtcaacggctacttcgagtcggtctcgtgacggcgggctggacgaaggcgtcagtagnnnnnnnnnnnn

SEQ ID NO: 406749 - DNA, 642 bp, Homo sapiens
  misc_feature: GZ8MTXP01BHQFX.3.21.B10.1.454.CMB.2.raw
  modified_base (391)..(391): a, c, t, g, unknown or other
tcagagacgcactccacgaccggtgctcgatttagtgtcgtcgcaagagaggagggggctgggagaggagccccagccctgagattcccaggtgtttccattcagtgatcagcactgaacacagaggactcaccatggagttgggactgagctggtattttcctttggcttaattttaaaaggtgtccggtgtgaagtgcaactggtggagtcgtgggggagcttggtacagcctggcaggtccctgacgactctcctgtgcagcctctggattcacctttgatgtattatgccatcgcacgtcgggtccggcaacggcctaccggagggggaacgggtccgtgggacgtgggtctcgaggttacttacgttaggaatagtagaaataacngtcgggactatggcggtactgtggtgaacgggccgtagttccacctatcctaccaagacgaacaaccgaccaaacgtaacctccgtacgtactactcgaacctaaagtcgaaactagtctaggaacgaccgtaggaacggtaaccgacgggtacccgtttagtacgtttacgttacggttacggttaaacgggtaacccgggggtaaattaacgttaggttaccgttagttttaacgttaaccgtttaacg

SEQ ID NO: 406750 - DNA, 525 bp, Homo sapiens
  misc_feature: GZ8MTXP01AEVGQ.3.21.B10.1.454.CMB.2.raw
  modified_base (367)..(367): a, c, t, g, unknown or other
  modified_base (384)..(384): a, c, t, g, unknown or other
  modified_base (511)..(525): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagtttgacagctggggccagggaaccctggtcaccgtctcctcacgcctccaccaggccccatccggtctccccgtggccnccctgcctccagggacnccacctccgagacgccacgagcccggccctgggctcggccgtgggtaccgaacgggacctaccgtcgaacggtcggccgttccgtcgttcggacggccggggcgtcggacgaagggccgacagtagnnnnnnnnnnnnnnn

SEQ ID NO: 406751 - DNA, 557 bp, Homo sapiens
  misc_feature: GZ8MTXP01A24Z5.3.21.B10.1.454.CMB.2.raw
  modified_base (298)..(298): a, c, t, g, unknown or other
  modified_base (540)..(544): a, c, t, g, unknown or other
  modified_base (546)..(557): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagntggggccaggggaaccctggtcaccgtctccctcacgccctccaccgaacgggccccaagtccggtccttccccccgtggcccgcccctgccctccgagggacgccaccctccgagacgccacaggccggcccgtgggctcggcccgttggacgaacggtacctaccgttccggaacgtcggggcgtcgtccgttaggacggtccggggcgttgggaccgaaagggtccgacgagtaacggnnnnngnnnnnnnnnnnn

SEQ ID NO: 406752 - DNA, 532 bp, Homo sapiens
  misc_feature: GZ8MTXP01A0019.3.21.B10.1.454.CMB.2.raw
  modified_base (519)..(532): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgttattactgtgcaagagcgaggaggagcagttttgacagctgggggccagggaaccctggtcaccggtctcctcagccctccaccgaacggccccactccggtcttcccccgtggccgcccctgcctcccgagggacgccaccctccgagacgccacgacggccggccctggggctcggcccgtgggtccgaaacggtacctaccgttccgaacgtcgggcgtctcgtcggaggccgggcgtgggacgaagggcgacagagnnnnnnnnnnnnnn

SEQ ID NO: 406753 - DNA, 490 bp, Homo sapiens
  misc_feature: GZ8MTXP01A22RY.3.21.B10.1.454.CMB.2.raw
  modified_base (218)..(218): a, c, t, g, unknown or other
  modified_base (285)..(285): a, c, t, g, unknown or other
  modified_base (379)..(379): a, c, t, g, unknown or other
  modified_base (392)..(392): a, c, t, g, unknown or other
  modified_base (453)..(453): a, c, t, g, unknown or other
  modified_base (459)..(459): a, c, t, g, unknown or other
  modified_base (481)..(490): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttcnccctgcaactgaagtctgtgactcccgaggacacggctgtttattactgtgcaagagcgaggaggancagtttgacagctggggccaggggaaccctggtcaccgtctcctcagccctcaccaaggcccatccggtctccccgtgccgccctgctccaggncacctccgagacncacgagccggccctgggctcgccgtgtccaaaggcctaacgccgagtcggcgttcgctagnggcggngtcggacaacggtcgacatagnnnnnnnnnn

SEQ ID NO: 406754 - DNA, 565 bp, Homo sapiens
  misc_feature: GZ8MTXP01B45SG.3.21.B10.1.454.CMB.2.raw
  modified_base (401)..(401): a, c, t, g, unknown or other
  modified_base (544)..(544): a, c, t, g, unknown or other
  modified_base (546)..(550): a, c, t, g, unknown or other
  modified_base (552)..(565): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtcgactcccgaggacacggcttgtttattactgtgacaaggagcgaggaggagcgtagtttcgacaggcgtcggggaccgacggggaaccctggtaccctaccgtccgtccctcacggccctacccgaaccgaacggggcccctacgtcccggtccttcccccgnggcccgcccctgcccgtccgacgggcgcccacccgtccggaagacgacacgacggccggccgtcgggctcggccgtgacgaacggacctacgtcgagtcggcgtccgtgacggccgggcgtcggctaagggcgtcgaagtggngnnnnngnnnnnnnnnnnnnn

SEQ ID NO: 406755 - DNA, 486 bp, Homo sapiens
  misc_feature: GZ8MTXP01BONKZ.3.21.B10.1.454.CMB.2.raw
  modified_base (478)..(486): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccaggggaacccctggtcaccgtctcctcagcctccaccaagggcccatccggtcttccccctggccgcccctgcctccagggacgccacctccgagacgcacgacgcggccctgggctgcctggtcaaggactactccgagtggcgtctctgagcgggctggcaaggcgcatgnnnnnnnnn

SEQ ID NO: 406756 - DNA, 627 bp, Homo sapiens
  misc_feature: GZ8MTXP01ELACA.3.21.B10.1.454.CMB.2.raw
  modified_base (219)..(219): a, c, t, g, unknown or other
  modified_base (607)..(607): a, c, t, g, unknown or other
  modified_base (610)..(610): a, c, t, g, unknown or other
  modified_base (612)..(627): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaaggaaccagttcnccctgcaactgaagtctgtgactcccgaggacacggtcttgtttattacgtgtgacaaaggagcggagggaggagcgtagttttgacgagcggtcgggggccgaacggggaaccccgtggtacctacccggtctccctacacggtcccctaccgaaccgaaccggggtcccaaccgttcccggttcccttccccccgtcgggccccgtaccccgttcggcccttccggaacgggcgacccctaccccggtccggacggaccgccgaaacgcgggcccgggtaccccgtcggggtccgttccggccgttacgggtaccgaaacgggtaccctaaccgccgtacgtcgggtcgtacgtccgtaggcggccgggacgtggacgacgccganagngnnnnnnnnnnnnnnnn

SEQ ID NO: 406757 - DNA, 532 bp, Homo sapiens
  misc_feature: GZ8MTXP01AKRVL.3.21.B10.1.454.CMB.2.raw
  modified_base (275)..(275): a, c, t, g, unknown or other
  modified_base (520)..(520): a, c, t, g, unknown or other
  modified_base (522)..(532): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggcttgtttattactgtgcaagngcgaggaggagctagtttgacagcgtggggccagggacccctggcaccgtctccctcacgcctccaccgaacgggccccatccggtccttcccccgtggcccgccccttggcctccgagggacgcccacccgtccggagacgccacacggccggcccgtgggctcggcccgtggccgaacggtacctaaccgttccgaggtcgggcgtcgtcgtagggcggcgggcgtggacgacggcgactagngnnnnnnnnnnn

SEQ ID NO: 406758 - DNA, 622 bp, Homo sapiens
  misc_feature: GZ8MTXP01EOAGF.3.21.B10.1.454.CMB.2.raw
  modified_base (289)..(289): a, c, t, g, unknown or other
  modified_base (564)..(564): a, c, t, g, unknown or other
  modified_base (598)..(598): a, c, t, g, unknown or other
  modified_base (600)..(600): a, c, t, g, unknown or other
  modified_base (602)..(603): a, c, t, g, unknown or other
  modified_base (605)..(607): a, c, t, g, unknown or other
  modified_base (609)..(622): a, c, t, g, unknown or other
tcagagacgcactccacgaccggtgctcgatttagtgtcgtcgcaagggggccagtatctctacttacgagactgcttggaattggttcaggctgtccccttcgagaggccttgagtggctgggaagggctttatacaagtccaagtgggaacatcattatgcagaatctagtagaaaagtcgagtaatcatcaaccgccgacacataccgaggaacctagttcctccctgaccaactgaagttctgtgacctcccggaggacacggtcttgttattactgtgacaagngacgaggagagcgtagtttagacgagcggtcgggggacccacggggtaaccccgttggtacctacccgtctcccgtacgaccggccctcccgaaaccgaaccggggtcccctacggttccccggttcccttccccggtcggtccccgtaccccttcgtcccgtaccggtaacggacgcccctacccggtacggagacgaccacgtcggcccgtccgtgggactcggccgttaggaccgacggtacctcttacgggactcggggtcttcgtaccgnggacgggcgggactcgggaacgacgggtcaacgngngnngnnngnnnnnnnnnnnnnn

SEQ ID NO: 406759 - DNA, 516 bp, Homo sapiens
  misc_feature: GZ8MTXP01DRWCG.3.21.B10.1.454.CMB.2.raw
  modified_base (499)..(516): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaaagtcgaagtaatcatcaaacgccgacacatccaggaaccagttctccctgcaaactgaaagtctgtgactcccgaggacacggctgttatactgtgacaagagcgaggaggaagctagtttgacagctggggccagggaacccctggtacacgtctcctcagcctaccacaaagggccccaatccggtcttacccccgtggccgtcccctgctccaagggacgccaacctccgagacgcacgacgcggacctgggactgcctggtcaaaggactactccgagtggtcgtctctcgagcgggctggacaaaggtcgacagtagnnnnnnnnnnnnnnnnnn

SEQ ID NO: 406760 - DNA, 478 bp, Homo sapiens
  misc_feature: GZ8MTXP02JFWTJ.3.21.B10.1.454.CMB.2.raw
  modified_base (383)..(383): a, c, t, g, unknown or other
  modified_base (471)..(478): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgagaacacggctgttattactgtgcagagcgaggaggagcagtttgacagctggggccagggaaccctggtcaccgtctccctcagcctccaccaagggccccatcggtcttccccctggccgccctgcctccaggacnccacctccgagacgcacagcggccctgggctgcctggtcaaggactacttccgagtgcgtctctgagcgggctggcaaggcgcatagnnnnnnnn

SEQ ID NO: 406761 - DNA, 488 bp, Homo sapiens
  misc_feature: GZ8MTXP02HPJ6D.3.21.B10.1.454.CMB.2.raw
  modified_base (477)..(488): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgttattactgtgcaagagcgaggaggagcagtttgacagctggggccagggaaccctggtcaccgtctcctcagcctccaccaagggcccatccggtcttccccctggccgcccctgcctccaggacgccaccctccgagacgcacagccggccctgggctgcctggtcaagggactacttccgagtgcgtctctgagcgggctggcaagggcgcgatagnnnnnnnnnnnn

SEQ ID NO: 406762 - DNA, 499 bp, Homo sapiens
  misc_feature: GZ8MTXP02IUJL2.3.21.B10.1.454.CMB.2.raw
  modified_base (366)..(366): a, c, t, g, unknown or other
  modified_base (479)..(479): a, c, t, g, unknown or other
  modified_base (487)..(499): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgttattactgtgcaagagcgaggaggagcagtttgacagctggggccagggaaccctggtcaccgtctccctcagccctccaccaagggcccagtccggtccttcccccnggccgccccttgcctccaggacgccacctccgagacgcacagccgcccgtgggcctcgccgtggcaagggacctacgttccgagtgcgtctcgtgagcgggctggcgacggcncgagtagnnnnnnnnnnnnn

SEQ ID NO: 406763 - DNA, 477 bp, Homo sapiens
  misc_feature: GZ8MTXP02JGQJ3.3.21.B10.1.454.CMB.2.raw
  modified_base (365)..(365): a, c, t, g, unknown or other
  modified_base (391)..(391): a, c, t, g, unknown or other
  modified_base (449)..(449): a, c, t, g, unknown or other
  modified_base (467)..(477): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtatgtgactcccgaggacacggctgttatactgtgcaagagcgaggaggagcagtttgacagctggggccaggggaaccctggtcaccgtctcctcagcctccaccaaagggcccatcggtctccccctggcnccctgcctccaggacgcacctccgangcacagcggccctgggctgcctggtcaaggactacttccgagtgcgtctctgagcggntggcgaaggcgacatagnnnnnnnnnnn

SEQ ID NO: 406764 - DNA, 507 bp, Homo sapiens
  misc_feature: GZ8MTXP02I8RS5.3.21.B10.1.454.CMB.2.raw
  modified_base (371)..(371): a, c, t, g, unknown or other
  modified_base (493)..(507): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgttattactgtgcaagagcgaggaggagcagtttgacagctggggccagggaaccctggtcaccgtctccctcacgccctccaccaaggcccactccggtccttccccctggccncccctgcctccacggacgccacctccgagacgccacgacgccggcccgtcgggctcgcctggtccaagggacctacgttccgagtgcgtctcgtggagcgggctggcgaaggcgcgagtagnnnnnnnnnnnnnnn

SEQ ID NO: 406765 - DNA, 529 bp, Homo sapiens
  misc_feature: GZ8MTXP02FY4K0.3.21.B10.1.454.CMB.2.raw
  modified_base (510)..(510): a, c, t, g, unknown or other
  modified_base (512)..(529): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgagacacggctgttatactgtgcaagagcgaggaggagcagtttgacagctggggccagggaccctggcaccgtctccctcagccctccaccaacggggcccagtccggtccttcccccctggccgccccctgcctcccgaggacgccacctccgagacgcacgacgcggccctgggctcgcctggtcaagggactacgttccgagtcgccggttctccgtggacggccggggcgtcggggacgaaagggccggacctagtaaggngnnnnnnnnnnnnnnnnnn

SEQ ID NO: 406766 - DNA, 481 bp, Homo sapiens
  misc_feature: GZ8MTXP02JYT8Q.3.21.B10.1.454.CMB.2.raw
  modified_base (358)..(358): a, c, t, g, unknown or other
  modified_base (439)..(439): a, c, t, g, unknown or other
  modified_base (449)..(449): a, c, t, g, unknown or other
  modified_base (465)..(481): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgttatactgtgcaagagcgaggaggagcagttttgacagctggggccaggggaccctggcacgtctctcagcctccaccaaggccagtcgtctcccctggcnccctgcctccaggcgcacctccgagcgcacagccggccctgggctgcctggtcaacggctacttccggagtcgcgtctcgngacgcggcgngcgacgcgcgacgagnnnnnnnnnnnnnnnnn

SEQ ID NO: 406767 - DNA, 487 bp, Homo sapiens
  misc_feature: GZ8MTXP02HV0KR.3.21.B10.1.454.CMB.2.raw
  modified_base (218)..(218): a, c, t, g, unknown or other
  modified_base (367)..(367): a, c, t, g, unknown or other
  modified_base (382)..(382): a, c, t, g, unknown or other
  modified_base (466)..(466): a, c, t, g, unknown or other
  modified_base (473)..(487): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttcncctgcaactgaagtctgtgactcccgaggacacggctgtttatactgtgcaagagcgaggaggagcagtttgacagctggggccaggggaacccctggtcaccggtctcctcagcctccaccaagggcccatccggtctccccctggcnccctgcctccacggngccacctccgagagcacagcggccctggggctgcctggtcaaggctacttccgagtgcgttctctgagcgggctggcaaggcgnacgtagnnnnnnnnnnnnnnn

SEQ ID NO: 406768 - DNA, 490 bp, Homo sapiens
  misc_feature: GZ8MTXP02H3RPL.3.21.B10.1.454.CMB.2.raw
  modified_base (363)..(363): a, c, t, g, unknown or other
  modified_base (389)..(389): a, c, t, g, unknown or other
  modified_base (475)..(490): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactccgaggacacggctgtttatactgtgcaagagcgaggaggagcagtttgacagctggggccaggaccctggtcaccgtctctcagcctccacaagggcccatccggtccttccccctggccnccctgcctccaggacgcaccctcganacgcacagccgcccgtgggctgcctggtcaacggctacgtccgagtgcgttctcgtgagcgggctggacgaagggccgacgagagnnnnnnnnnnnnnnnn

SEQ ID NO: 406769 - DNA, 492 bp, Homo sapiens
  misc_feature: GZ8MTXP02HIJW2.3.21.B10.1.454.CMB.2.raw
  modified_base (478)..(492): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttattactgtgcaagagcgaggaggagcagttttgacagctggggccagggaaccctggtcaccgtctccctcagcctccaccaagggcccactccggtcttccccctggccgccctgcctccaggacgccacctccgagacgcacacgccgcccgtgggcctgccctggtcaagggactacgttcgagtgcgtctctgagcgggctggcaggcgcatgnnnnnnnnnnnnnnn

SEQ ID NO: 406770 - DNA, 526 bp, Homo sapiens
  misc_feature: GZ8MTXP02FHWRI.3.21.B10.1.454.CMB.2.raw
  modified_base (513)..(526): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgttattactgtgcaagagcgaggaggagcagttttgacagctggggccgaggacctggcaccgtctcctcgcgccctccacgaccggcctacgtccgtcccctcccgcggcccgccctcgccctaccgacggacgaccctacccgaccgacgacgaccaacgcggcccgccggtcggcgtcgccgtcggtacgaacgactaccgtccgtagcgtcgtcgtcgtggacgggccggcgtcggacgacggcgacgagagnnnnnnnnnnnnnn

SEQ ID NO: 406771 - DNA, 496 bp, Homo sapiens
  misc_feature: GZ8MTXP02IV2XM.3.21.B10.1.454.CMB.2.raw
  modified_base (376)..(376): a, c, t, g, unknown or other
  modified_base (486)..(496): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggcttgtttattactgtgcaagagcgaggaggagcagttttgacagctggggccaggggaaccctggtcaccgtctccctcagccctccaccaagggcccacgtccggtccttccccctggccncccctgcctccaggacgccaccctcgagagcacagcgcccgtgggctgccctggtcaaggactacttccgagtcgcgtcctcgtgagcgggctggcaagggcgacagtgnnnnnnnnnnn

SEQ ID NO: 406772 - DNA, 517 bp, Homo sapiens
  misc_feature: GZ8MTXP02F3VLC.3.21.B10.1.454.CMB.2.raw
  modified_base (363)..(363): a, c, t, g, unknown or other
  modified_base (501)..(517): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggcacggctgtttattactgtgcaagagcgaggaggagcagtttgacagctggggccagggaacccctggtccaccgtctcctcagccctccacaaggcccatccggccttcccccnggccgcccctgcctccgaggacgccaccgtccgagacgccacgacgccggcccgtggggctcgccctgggtcaaggacctacgttccgagtcgcgtctcgtgaggccgggcgtggccgaagggccgagtagtaggcgnnnnnnnnnnnnnnnnn

SEQ ID NO: 406773 - DNA, 504 bp, Homo sapiens
  misc_feature: GZ8MTXP02GN6GA.3.21.B10.1.454.CMB.2.raw
  modified_base (491)..(504): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggcttgtttattactgtgcaagagcgaggaggagcagtttgacagctggggccgaggaaccctggtcaccgtctccctcagcctccaccaagggcccacgtcgtccttccccctggccgcccctcgcctccaggtcgccacctccgagacgcacgacgccggccctgggcctcgcctggtcgaacggacctacttaccgagtcgcgtctcgtggacgcgggcgtggcaaggcgcagtgnnnnnnnnnnnnnn

SEQ ID NO: 406774 - DNA, 560 bp, Homo sapiens
  misc_feature: GZ8MTXP02JI665.3.21.B10.1.454.CMB.2.raw
  modified_base (541)..(541): a, c, t, g, unknown or other
  modified_base (547)..(560): a, c, t, g, unknown or other
tcagagacgcactccacgaccggtgctcgatttagtgtcgtcgcaaggggccagtatctctacttacgagactgcttggaattggttcaggctgtccccttcgagaggccttgagtgggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgtttatactgtgcaagagcgaggaggagctagtttgacagcgtggggccaaggggaacccctggtcacccggtctccctcgtacgccctcccgacccgaaaggggcccccaacgtccgggtccctttccccccgtgggcccgcccccttgccctcccgaggggacgccaacccgtccgaagcgccacacggcccgcccgtgggccctcggccgtgggtccaaagggtacctaccgttccggaggtcgtccgtcgtctggacgccggggctcgggcaagggccgngagagnnnnnnnnnnnnnn

SEQ ID NO: 406775 - DNA, 509 bp, Homo sapiens
  misc_feature: GZ8MTXP02F0626.3.21.B10.1.454.CMB.2.raw
  modified_base (365)..(365): a, c, t, g, unknown or other
  modified_base (494)..(509): a, c, t, g, unknown or other
tcagagacgcactccacgaccggtgctcgatttagtgtcgtcgcaaggggccagtatctctacttacgagactgcttggaattggttcaggctgtcccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggacacggctgttattactgtgcagagcgaggaggagcagttttgacagctggggccaggggaaccctggtcaccgtctcctcagcctccacaacgggcccatccggtccttcccccnggccgcccctgcctccgaggacgccaccctccgagacgacacacgcccggcccgtgggcctcgcctcggtacaaggactaccgtccgagtcgcgtcgtctggaggcgggctggcgaaggcgacgatagnnnnnnnnnnnnnnnn

SEQ ID NO: 406776 - DNA, 570 bp, Homo sapiens
  misc_feature: GZ8MTXP02JEGU7.3.21.B10.1.454.CMB.2.raw
  modified_base (392)..(392): a, c, t, g, unknown or other
  modified_base (551)..(551): a, c, t, g, unknown or other
  modified_base (554)..(570): a, c, t, g, unknown or other
tcagagacgcactccacgaccggtgctcgatttagtgtcgtcgcaaggggccagtatctctacttacgagactgcttggaattggttcaggctgtcccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgagacacggctgttatactgtgcagagcgaggaggagcgtagtttgacgagcgtggggccgacggggaacccctggtccaccgtcctccctccacgccctccacccgaacgggccccacgtccggttacccttcccccctgggcccncccctcgccctccgaggaccgcccacccgtccgagacgccacgacggcccggcccgtgggccttcggcccgtcggtacgaacggtacctaccgttaccggagttccggacgttcccgtcgtcgggacggtccgggcgtcgggcgaacgggcgccaaggngcnnnnnnnnnnnnnnnnn

SEQ ID NO: 406777 - DNA, 607 bp, Homo sapiens
  misc_feature: GZ8MTXP02JJGOE.3.21.B10.1.454.CMB.2.raw
  modified_base (587)..(587): a, c, t, g, unknown or other
  modified_base (589)..(589): a, c, t, g, unknown or other
  modified_base (591)..(607): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtgaaaagtcgagtaatcatcaacgccgacacatccaggaaccagttctccctgacaactgaagtctgtgacctcccgaggacacggcttgtttattactgtgcaagagcgaggaggagctagtttgacagcgtggggccagggaccctggtcaccgtctccctcacgccctccaccgaaacggcccaccgtccggtccctcccccgtggcccgcccctgccctccgagggaccgcccaccctccggaacgacgacccacgacggcccggcccgtcggggcccgtcggcccgtacggggtaccgaaacgggtacccttacccgttaccggtacggttcggtcccggttccgttccggttagggaccgggtccgggggtccgtacgggggaccgaaacggggccgacgtaaagtacggngngnnnnnnnnnnnnnnnnn

SEQ ID NO: 406778 - DNA, 524 bp, Homo sapiens
  misc_feature: GZ8MTXP02H4I3N.3.21.B10.1.454.CMB.2.raw
  modified_base (201)..(201): a, c, t, g, unknown or other
  modified_base (372)..(372): a, c, t, g, unknown or other
  modified_base (377)..(377): a, c, t, g, unknown or other
  modified_base (506)..(511): a, c, t, g, unknown or other
  modified_base (513)..(521): a, c, t, g, unknown or other
  modified_base (523)..(524): a, c, t, g, unknown or other
tcagagacgcactccacgaccggtgctcgatttagtgtcgtcgcaaggggccagtatctctacttacgagactgcttggaattggttcaggctgtcccccttcgagaggccttgagtggctgggaagggctttatacaagtccaagtgggaacatcattatgcagaatctgtgaaaaagtcgagtaatcatcaacgccganacatccaggaaccagttctccctgcaactgaagtctgtgactcccgaggacacggcttgttattactgtgcaagagcgaggaggagctagtttgacagcgtggggccagggaaccctggtcaccgtctcctcacgccctccaccgaaggcccacgtccggtccttcccccnggccnccctgcctccgaggacgccacctcgagcgccacacgccggcccgtgggctcgccgtggtcgaacgctacttccggagtcgcgtctcgtggacggcgggcgtacgggcgaagggccgacgacgtaggcgnnnnnncnnnnnnnnncnn

SEQ ID NO: 406779 - DNA, 538 bp, Homo sapiens
  misc_feature: GZ8MTXP02GYCCW.3.21.B10.1.454.CMB.2.raw
  modified_base (297)..(297): a, c, t, g, unknown or other
  modified_base (335)..(335): a, c, t, g, unknown or other
  modified_base (358)..(358): a, c, t, g, unknown or other
  modified_base (520)..(526): a, c, t, g, unknown or other
  modified_base (528)..(538): a, c, t, g, unknown or other
tcagagacgcactccacgaccggtgctcgatttagtgtcgtcgcaaggggccagtatctctacttacgagactgcttggaattggttcaggctgtccccttgagaggccttgagtggctgggaaggctttatacaagtccaagtggaacatcattatgcagaatctgtgaaaagtcgagtaatcatcaacgccgacacatccaggaccagttcaccctgacaactgaagtctgtgactcccgaggcacggcttgtttatactgtgcaagtgcggaggaggagcagtttgacagtcgnggggccaagggaacccctggtccgaccgtctcccgtanacgccctaccgaccgacgggccncgtaccggtccctcccccgtggccccgtccctgccgtaccgaggacgcctaccgtcgacgcgacgacaccggtccgcccgcgggctcgaccgtcggtccgaaggcctacgttacggcgtgcgttcgcgttgcggccggcgaggcgaacggtccgaagtgagnnnnnnncnnnnnnnnnnn

SEQ ID NO: 406780 - DNA, 537 bp, Homo sapiens
  misc_feature: GZ8MTXP02IW5BK.3.21.B10.1.454.CMB.2.raw
  modified_base (325)..(325): a, c, t, g, unknown or other
  modified_base (381)..(381): a, c, t, g, unknown or other
  modified_base (415)..(415): a, c, t, g, unknown or other
  modified_base (521)..(537): a, c, t, g, unknown or other
tcagagacgcactccacgaccggtgctcgatttagtgtcgtcgcaaggggccagtatctctacttacgagactgcttggaattggttcaggctgtcccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgacctcccgaggacacggtctgttattactgtgcaagagcgaggaggagcagtttgacagcgtggggccaggggaacccctggtccnccgtctccctcacgccctccacccaaggggccccagtccggtcctccccctggccnccccctgcctccgacggtacgccaccctccgagngaccaccgagcccggcccgtgggccctcggccctggtccgaaaggactacgttccggagtggccgtctcgtggacggtcgggctcggacgaaggccgtcagtacgnnnnnnnnnnnnnnnnn

SEQ ID NO: 406781 - DNA, 556 bp, Homo sapiens
  misc_feature: GZ8MTXP02FM1O2.3.21.B10.1.454.CMB.2.raw
  modified_base (292)..(292): a, c, t, g, unknown or other
  modified_base (419)..(419): a, c, t, g, unknown or other
  modified_base (537)..(538): a, c, t, g, unknown or other
  modified_base (540)..(556): a, c, t, g, unknown or other
tcagagacgcactccacgaccggtgctcgatttagtgtcgtcgcaaggggccagtatctctacttacgagactgcttggaattggttcaggctgtcccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgactcccgaggcacggctgtttatactgtgcagagcgaggaggagcagtttganagctggggccagggaccctggtcaccgtctccctcgacgccctccacgtaacggcccacgtccggtcccttccccctggccgcccccttgcccttccgaacggcaccacccgtccgaagacgcaacncggcccgcccgtgggctacgcccgtgggtaccaaggtactaaccgtccggtacgtcggaccgtcctcgtcggaacgggccggggactcggggccgaaacggggccgacgtagtacggnngnnnnnnnnnnnnnnnnn

SEQ ID NO: 406782 - DNA, 551 bp, Homo sapiens
  misc_feature: GZ8MTXP02GRPW1.3.21.B10.1.454.CMB.2.raw
  modified_base (534)..(551): a, c, t, g, unknown or other
tcagagacgcactccacgaccggtgctcgatttagtgtcgtcgcaaggggccagtatctctacttacgagactgcttggaattggttcaggctgtcccccttcgagaggccttgagtggctgggaagggctttatacaagtccaagtgggaacatcattatgcagaatctgtgaaaagtcgagtaatcatcaacgccgacacatccaggaaccagttctccctgcaactgaagtctgtgacctcccgaggacacgggctgtttattactgtgcaagagcggaggaggagctagtttgacaggcgtggggcccaggggaccctggtcaccgtctccctcacgccctccaccgaacgggcccacgtcccgtcccttccccccgtggcccgtccccttcgcccgtaccgacggacgccctaccctccgaacgcgccaccgacggcccggacccggtgggacctcgcccgtggtaccgaagggactaccgtccgagtcgcgtctcgtggacgcgggcgtggcgaacggcgcgagtgcnnnnnnnnnnnnnnnnnn

SEQ ID NO: 406783 - DNA, 572 bp, Homo sapiens
  misc_feature: GZ8MTXP02JL7UQ.3.21.B10.1.454.CMB.2.raw
  modified_base (200)..(200): a, c, t, g, unknown or other
  modified_base (203)..(203): a, c, t, g, unknown or other
  modified_base (240)..(240): a, c, t, g, unknown or other
  modified_base (256)..(256): a, c, t, g, unknown or other
  modified_base (267)..(267): a, c, t, g, unknown or other
  modified_base (272)..(272): a, c, t, g, unknown or other
  modified_base (274)..(274): a, c, t, g, unknown or other
  modified_base (510)..(510): a, c, t, g, unknown or other
  modified_base (523)..(523): a, c, t, g, unknown or other
  modified_base (535)..(535): a, c, t, g, unknown or other
  modified_base (547)..(547): a, c, t, g, unknown or other
  modified_base (552)..(552): a, c, t, g, unknown or other
  modified_base (555)..(572): a, c, t, g, unknown or other
tcagagacgcactccacgaccggtgctcgatttagtgtcgtcgcaaggggccagtatctctacttacgagactgcttggaattggttcaggctgtccccttcgagaggccttgagtggctgggaagggctttatacaagtccaagtgggaacatcattatgcagaatctgtagaaaagtcgagtaatcatcaacgccganacntccaggaaccagttcctccctgcaactgaagtctgtnactcccgagacacggntgttatctgtnacagngngaggagagctaggtttcgactaggcgtggggtccgagggtaacccgtggtccacccgtcgtcccactacggccctacccgaccgaaccggggccctaccggtccgttacccctcccccgtggccccgtcctcgccctaccgaggaccgcccacccgtaccggacgaccgacgaccgtacggcccggtcccgtcgggcctacggccgtacggtaccgaacggtacgtaccttccggnggtaccgcgttcncgtggacgcggngtcggacgacgnacganagnnnnnnnnnnnnnnnnnn

SEQ ID NO: 406784 - DNA, 542 bp, Homo sapiens
  misc_feature: GZ8MTXP01AMPI3.45.42.D09.1.454.CMB.2.raw
  modified_base (202)..(202): a, c, t, g, unknown or other
  modified_base (234)..(234): a, c, t, g, unknown or other
  modified_base (358)..(358): a, c, t, g, unknown or other
  modified_base (375)..(375): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccacctgtctgtgtctccgaggggaaangtcaccctctcctgcagggccagcccagggtntcagcagcgacttagcctggtaccagcagaaacctggccaggctcccaggcctcctcatctatggtcgccttcctccgagggccactggtactcccagtccaggttcagtcggcaggtgggtcngggaacagtcgtttacnctcaccatcaaacacgccctcaggtctagaagtattttgactagtttatactgtcactagtataatagtgacctcgtgacgtcgacaaggaccgaaggtggaaactaacaaacgacgtggttggctcgcaccgttactctgttcttcacgttccttaacccgcctaa

SEQ ID NO: 406785 - DNA, 718 bp, Homo sapiens
  misc_feature: GZ8MTXP01DEYZX.45.42.D09.1.454.CMB.2.raw
  modified_base (202)..(202): a, c, t, g, unknown or other
  modified_base (210)..(210): a, c, t, g, unknown or other
  modified_base (298)..(298): a, c, t, g, unknown or other
tcagacgcgatcgacacgaccggtgctcgatttagacacatacgcaggggaaagggggaggaactgctcagttaggacccagacggaaccatggaagccccagcgcagcttctcttcctcctgctactctggctcccagattccacgggagaaatagtgatgacgcagtctccagccaccctgtctgtgtctccaggggaangtcacctntcctgcagggccagccagagtgtcagcagcgacttagcctggtaccagcaagaaaccctggacccaggcctacccgaggtcctccctnatctagttcggtcgtcctttcccgtccgacgggggcccctaacgtttcgggtaacttcccccgaaggtccccgtaaggggtttccaagggttcgggactaggggttcggggtacgtacgggggaactaacgggttccgttttaacctccgttaccaacccctatacccaaactaccgtccctaccgtagtaccgtaggtaaaggttatttttcggacctttaaggttttaacttacgttcgttacctaaccgtaaggttaacttaaagttaacgttcgttacccgttccggtaggtaccggttaccggacgtaaacggggtaccgtaagggtaggaaaactacgaaacggtaacgttggttgggacttcggcttaaccctaattccgttcgttcttccttacttcccgttccccgtaacc

SEQ ID NO: 406786 - DNA, 612 bp, Homo sapiens
  misc_feature: GZ8MTXP01D4NI7.45.42.D09.1.454.CMB.2.raw
  modified_base (200)..(200): a, c, t, g, unknown or other
  modified_base (208)..(208): a, c, t, g, unknown or other
  modified_base (266)..(266): a, c, t, g, unknown or other
  modified_base (286)..(286): a, c, t, g, unknown or other
  modified_base (299)..(299): a, c, t, g, unknown or other
  modified_base (379)..(379): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctccagattccacgggagaaatagtgatgacgcagtctccagccacctgtctgtgtctcgaggggaaangtcacctncctgcaggccagccagagtgtcagcagcgtacttagccctggtaccagcaagaaaccnggccaggctcccaggcctcncatctagtggtcncttcctcgacgggccacgtggtactcccagccaggttcaggtggacgaggtgggtctaggggactcggtcgttttaaccnctacaactactacaaactcgtcctcgagtctagtaagttatttcgactttagtttactacgtactactaacgtaagttaacttaagtaacgttcggccgttaccggtacggttaccggttaccggaaccggtaaacgggaacgtaaaggtaacggtaaaactaacgaaaacgtacgttggtacgtacttacgccttactaattcttcgttcttacttaccttcccgttccgtc

SEQ ID NO: 406787 - DNA, 502 bp, Homo sapiens
  misc_feature: GZ8MTXP01DOJIB.45.42.D09.1.454.CMB.2.raw
  modified_base (203)..(203): a, c, t, g, unknown or other
  modified_base (212)..(212): a, c, t, g, unknown or other
  modified_base (285)..(285): a, c, t, g, unknown or other
  modified_base (295)..(295): a, c, t, g, unknown or other
  modified_base (470)..(470): a, c, t, g, unknown or other
  modified_base (477)..(477): a, c, t, g, unknown or other
tcagacgcgatcgacacgaccggtgctcgatttagacacatacgcagggaaagggggaggaactgctcagttaggacccagacggaaccacggaagccccagcgcagcttctcttcctcctgctactctggctcccagattccacgggagaaatagtgatgacgcagtctccagccaccctgtctgtgtctccgaggggaaangtcaccctntcctgcagggccagccagagtgtcagcagcgacttagcctggtaccagcagaacctggccaggctccagctcnatctatggtncttcctcaggccagtgtactccagccaggttcagtcgcaggtggtctgggaacagtcgtttactctacaccatcaaacacgccctacagtctagaagtattttgctagtttatactgtcactagtataatagtgcctcgtgcgtcgacgaaggtacaggtgaaatcaaagactgnggctgcncatctgtcttcattccttccgctaa

SEQ ID NO: 406788 - DNA, 633 bp, Homo sapiens
  misc_feature: GZ8MTXP01CS4PH.45.42.D09.1.454.CMB.2.raw
  modified_base (262)..(262): a, c, t, g, unknown or other
  modified_base (305)..(305): a, c, t, g, unknown or other
  modified_base (512)..(512): a, c, t, g, unknown or other
tcagacgcgatcgacacgaccggtgctcgatttagacacatacgcagggaaagggggggagaggagcccagcactagaagtcggcggtgtttccattcggtgatcagcactgaacacagaggactcaccatggagtttgggctgaacttgggttttcctcgttgcttcttttaagaggtgtccagtgtcaggtgcacttggtggagtcgtgggggagcgtggtccagccgtgggagtccctgagactctcctgtgcagcctntggattccaccttcagctactatggcatgcacgtcgggtcccncgaggcctaccgaggccaagggggtcgtgggggacgggggttgctacgttatagtcaattacgtggaattagggtaaaactttagtaaaacgttactaacgtccaaaggtaccttccggaggaacgggtccctattaccactactccgtaccaagacgaactaacgttaccaaagacacgctagtactcgtagaactaatacgaacngcctagagagtcgaggaacggccgaacggtcttacggttaccttagtttaaccgtggttaacggacgaaaacgtaacgtaaaccggtaaatttacgtagttacgtaacgttaaccgtaacg

SEQ ID NO: 406789 - DNA, 611 bp, Homo sapiens
  misc_feature: GZ8MTXP01A5UID.45.42.D09.1.454.CMB.2.raw
  modified_base (202)..(202): a, c, t, g, unknown or other
  modified_base (211)..(211): a, c, t, g, unknown or other
  modified_base (267)..(267): a, c, t, g, unknown or other
  modified_base (299)..(299): a, c, t, g, unknown or other
  modified_base (371)..(371): a, c, t, g, unknown or other
  modified_base (384)..(384): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccaggggaaangtcaccctntcctgcagggccagccagagtgtcagcagcgacttagcctggtaccagcagaaccnggccaggctcccaggcctcctcatctatggtnccttcctccagggccacgtggtatcccagccaggttcaggtggcaggtgggtctgggactggtcgttttacnctacacatacacncgtcctacagtctagtaagttatttcgacttagtttacttacgtcgtactaacgtaaggttaaataaagttaacggtccggtacccgttccggtacggtaccggttaccgggaaccgtaaacggggtaaccgtaaagggtaacggaaactaaccgaaacggtaacgttcggtacggtacgttacgaccaccgtaattcgtcgttcctacgttacttcccgttcccgc

SEQ ID NO: 406790 - DNA, 655 bp, Homo sapiens
  misc_feature: GZ8MTXP01BZGZA.45.42.D09.1.454.CMB.2.raw
  modified_base (201)..(201): a, c, t, g, unknown or other
  modified_base (292)..(292): a, c, t, g, unknown or other
  modified_base (303)..(303): a, c, t, g, unknown or other
  modified_base (311)..(311): a, c, t, g, unknown or other
  modified_base (389)..(389): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccaggggaangtcaccctctcctgcagggccagccagagtgtcagcagcgacttagcctggtaccagcaagaacctggccaggcctcccgaggcctccgtnatctatggtcncctttccncgagggcccacgttggtactcccgagcctaggtttccaggtggactaggtcgggtcctaggggactggtcgttttacncctcgacctatcaacgacgcctaccgagtctagtaagttattttcggacttagttttacttacttcgttactaccgtaagggttaactttaaacgttaacgttccgttacccttccgggttacggtaccggtttaccgggaccgtaaagggggtacccgtaaagggttacggaaaacttacgaaaacggtaacgttggtacggtcgttacgaccgacctaagttcgttaacggttccttacttaccttcccgtttccccgtaaccg

SEQ ID NO: 406791 - DNA, 690 bp, Homo sapiens
  misc_feature: GZ8MTXP01EB4I4.45.42.D09.1.454.CMB.2.raw
  modified_base (279)..(279): a, c, t, g, unknown or other
  modified_base (309)..(309): a, c, t, g, unknown or other
  modified_base (369)..(369): a, c, t, g, unknown or other
tcagacgcgatcgacacgaccggtgctcgatttagacacatacgcagggaaagggggggagaggagcccagcactagaagtcggcggtgtttccattcggtgatcagcactgaacacagaggactcaccatggagtttgggctgaactgggttttcctcgttgcttcttttaagaggtgtccagtgtcaggtgcacgttggtggagtcgtggggggaggcgtggtccagccgtgggacgtccctgacgactctcctgtgcagcctctgattccaccttnagtcctactatggcatcgcacgtgggcccnccgaggcctccgaggcgaaggggtcgtgggggagggggtgactacgtttatatcattacnggtagtaggtaaacttataaaacgttactaactccgaagtacccgttccggtaggaaccgggggtcctacttaccgaccctaactaccgacgaagtaaactaaacgtacctaacgaaccgactactacgttatactacggtactaaaacgtaacgtaaacgacgaccgtacggtaaggaacgtacgtacggaacggaaccggtaccgtaacgtcgttaacgttacgtttaaaccgtggttaacggaacgttaaacgttaaacgttaaacccggtaaagttaactttaacgtaggttaaccttaaccgttaacgttaaccgg

SEQ ID NO: 406792 - DNA, 595 bp, Homo sapiens
  misc_feature: GZ8MTXP01DBZG2.45.42.D09.1.454.CMB.2.raw
  modified_base (203)..(203): a, c, t, g, unknown or other
  modified_base (217)..(217): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccgaggggaaangtccaccctctccngcagggccagccagagtgtcagcagcacttagcctggtaccagcaagaacctggccaggcctacccgaggtcctcctcactctagtgtcgccttcctccgagggccctacgtggtactcccgagcctaggttccacggtcggactagggtcgggtcgtaacggggactcgggtcctttaaccgcctaccaccctatccaaacacgtcctaccagtctagtaagttattttcgacttagttattactgtacactagtataatagtcgtcctcgtggtacgttacggacgtaacgggacgtaaggtaaggtaaactacgaaacgtacgttgtcggcttacgcacctaactctgttccttcttaccttccttcccgtaacc

SEQ ID NO: 406793 - DNA, 606 bp, Homo sapiens
  misc_feature: GZ8MTXP01A54V7.45.42.D09.1.454.CMB.2.raw
  modified_base (259)..(259): a, c, t, g, unknown or other
  modified_base (278)..(278): a, c, t, g, unknown or other
  modified_base (304)..(304): a, c, t, g, unknown or other
  modified_base (379)..(379): a, c, t, g, unknown or other
tcagacgcgatcgacacgaccggtgctcgatttagacacatacgcaggggaaaggggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggaggcgtggtccagccgtgggaggtccctgagactctcctgtgcngcctctggattccaccttnagctactatggcatgcacgtgggccnccaggctccgaggcgaggggtcgtggggagggggtgcacttatatcatatgagtaggaacttataaaacgtactntaccagtaccgttccgaggaacggggcctaacttccaccactctacccaagtaacgaactaacttaccaaacgaaaccacgtcttagtaatcgtagactaaaatcgaaacgacgtccgaggaagacgtcgtaggacggtaacgcggtcttagtacttagttacgtgttaacgttacggaaaataacgtaaacggtaaattacctaattacgtaacttaaccgtaacg

SEQ ID NO: 406794 - DNA, 731 bp, Homo sapiens
  misc_feature: GZ8MTXP01DUMOZ.45.42.D09.1.454.CMB.2.raw
  modified_base (193)..(193): a, c, t, g, unknown or other
  modified_base (274)..(274): a, c, t, g, unknown or other
  modified_base (302)..(302): a, c, t, g, unknown or other
  modified_base (353)..(353): a, c, t, g, unknown or other
tcagacgcgatcgacacgaccggtgctcgatttagacacatacgcagggaaagggggggagaggagcccagcactagaagtcggcggtgtttccattcggtgatcagcactgaacacagaggactcaccatggagtttgggctgaactgggttttcctcgttgcttcttttaagaggtgtccagtgtcaggtnctacttggtggagtcgtgggggagcgtggtccagcctgggagtccctgagactctcctgtgcagcctctggattcaccttnagctactatggcatgcacgtgggtcccncgaggcctccgaggcgaaggggtcgtgggggacgggggttgctacgtttanatcattactggtaattacgggtaaactttaagtaaaacgttacttaacttacccgaagtaacccgttccggtaggaaacggggtcctaactttcccaacctacttaccgtaccctaaggaacgtaaacctaacttacccgaaaacgtaaaccacgtccttagtacttcgtaacgaactaaaacgtcgaaacaccggtacccttaggaaaacgggtcgtaccggtacgggaaccggaacccggtaacggttacgttacggtttaaccgttttaaacgttacggtacggttaaacggttaaacggttaaaacgtaaacccggttaaaaccggttaaaactttaacgtaagttaaccgtaacccgttaacccgttaaccgg

SEQ ID NO: 406795 - DNA, 605 bp, Homo sapiens
  misc_feature: GZ8MTXP01C3K9B.45.42.D09.1.454.CMB.2.raw
  modified_base (302)..(302): a, c, t, g, unknown or other
tcagacgcgatcgacacgaccggtgctcgatttagacacatacgcagggaaagggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggaggcgtggtccagcctgggagtccctgagactctcctgtgcagcctctggattccaccttcagctactatggcatgcacgtgggtcccnccaggcctccagggcaaggggtctgggggagggggttgcacttatatcatatgatggtaaactttataaaacgtactaatcccagtacctccgtggaaacggggtccattccacctatcctaccagagaactaacttaccaaagacacgcttagtatcgtagactaaatcgaacacgcctaggaagacgtcgtaggacggtacgaacggcttgttacgttattaccgtggttacgaacggttaaacggtaacgttaaacccgggtaaatttaaccgtagttacgtaacttaaccgttaaccgg

SEQ ID NO: 406796 - DNA, 624 bp, Homo sapiens
  misc_feature: GZ8MTXP01BAYW8.45.42.D09.1.454.CMB.2.raw
  modified_base (204)..(204): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagcccaccctgtctgtgtctccgaggggaaangtccaccctctcctgcagggccagccagagtgtcagcagcgacttagcctggtaccagcaagaacctggccaggcctcccgaggcctcctcatcctatcggtctccttccgtcgacgggtcccacgtcggtactcccagcctaggttccaggtcggctaggtcggggtctggggactggtcctttacgcctccaccatccaaactcgtccctccgaagttctaggtaagttacttttggacttaagtttacttactgtactaacgtagttaactaaagttacgtcggtaccctcggtacggtaccggttaccggaccgaaaggggtaaccctaaggggtaacgaaacttacgaaaacggacgttggacgtacttggccactaacgttctaacggttctcttacttcccgttcccgtaacc

SEQ ID NO: 406797 - DNA, 607 bp, Homo sapiens
  misc_feature: GZ8MTXP01AKY03.45.42.D09.1.454.CMB.2.raw
  modified_base (203)..(203): a, c, t, g, unknown or other
  modified_base (269)..(269): a, c, t, g, unknown or other
  modified_base (289)..(289): a, c, t, g, unknown or other
  modified_base (300)..(300): a, c, t, g, unknown or other
  modified_base (308)..(308): a, c, t, g, unknown or other
  modified_base (329)..(329): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccgaggggaaangtcaccctctcctgcagggccagccagagtgtcagcagcgtacttagcctggtaccagcagaaccnggccaggctcccagctcctnatctatcggtncctttccncgagggtcccagttcggtacncccagcctaggttcaggtgcaggtggctgggactggtccttacgctacaccgtatccaaactcgtcctacctagtccgtagtaaagttcttttagacttagtttaacttcgtcggtacctaacgtagtaacttaaacgttaggtcggtacccgttcggtaggtaccgtttaccgggacgaaacgggtaccgaaaggttcgggaaaattcccgaaagtacgttggttacggacttcgacttactaactctaacgttctacgactttcccggcccgtaac

SEQ ID NO: 406798 - DNA, 705 bp, Homo sapiens
  misc_feature: GZ8MTXP01APWM1.45.42.D09.1.454.CMB.2.raw
  modified_base (203)..(203): a, c, t, g, unknown or other
  modified_base (216)..(216): a, c, t, g, unknown or other
  modified_base (272)..(272): a, c, t, g, unknown or other
  modified_base (410)..(410): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccgaggggaaangtcaccctctccngcagggccagccagagtgtcagcagcgacttagcctggtaccagacagaaacccgnggccaggcctacccgaggcctcctcattcgtagtggtcgtccttcccgccgacgggtccctacgtcggtactcccgagcccgtaaggttccagggtggacgtagggtcggggtccgtaggggactggttccgtttacnctaccaacctactacaaacgtaccgtcctacccgtagttccgtaggtaagtttaacgtttttcggactttaacggttttactttaccgttacgttacctaaacgtaagggtttaaattaaacgttaagggtccggtacccgttaccggtacgggtaccggtttaccgggaaccgaaacggggtaacccgtaaagggtacggtaaactaacgttaaacgtaacggttggtacgggtacttcggccttaacctaagtccgttaacgttccttacttccttaaccccgttccgtaacc

SEQ ID NO: 406799 - DNA, 670 bp, Homo sapiens
  misc_feature: GZ8MTXP01EAAVN.45.42.D09.1.454.CMB.2.raw
  modified_base (203)..(203): a, c, t, g, unknown or other
  modified_base (403)..(403): a, c, t, g, unknown or other
  modified_base (425)..(425): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccgaggggaaangtccacctctcctgcagggccagccagagtgtcagcagcgacttagcctggtaccagcaagaaacctggaccaggcctaccaggtcctcctcatctagtcggtctccttccgtccgagggtccctacgttggtacctcccgagaccgtaggttccaggtcggacgtagggtcgggtcgtacggggactggtccttttacnccgtacaaccgtataccaaacncgtccctactagtacgtagtaagttattttcgactttagtttatactcgtactaaccgtaaggttaaactaagttaacgggtccggtacccgttaccgggttcgggtaccggtttaccgggacccgtaaagggggtaaccctaaggggtaacggtaaaacttaacgaaaacggttaacgttggtacggtacttacgccttaacctaacgttcttcgttacttcgactttcccgttcccgtaaccg

SEQ ID NO: 406800 - DNA, 611 bp, Homo sapiens
  misc_feature: GZ8MTXP01CFINW.45.42.D09.1.454.CMB.2.raw
  modified_base (278)..(278): a, c, t, g, unknown or other
  modified_base (304)..(304): a, c, t, g, unknown or other
  modified_base (351)..(351): a, c, t, g, unknown or other
tcagacgcgatcgacacgaccggtgctcgatttagacacatacgcagggaaagggggggagaggagcccagcactagaagtcggcggtgtttccattcggtgatcagcactgaacacagaggactcaccatggagtttgggctgaactgggttttcctcgttgcttcttttaagaggtgtccagtgtcaggtgcacgttggtggagtcgtggggggagcgtggtccagccgtgggacgtccctgagactctcctgtgcagcctctggattccaccttnagctatatggcatgcacgtgggtccncaggcctccgaggcgaaggggtcagggggagggggtgctacgtttanatcgattacgtgagttaggtaaactttagtaaaagttactaatccgaagtaccttaccggaggaacggggccctattacccacctacttcctaccgaagacgtaacctaacttaccaaagtaacacgactagtactcgtagaactaaatcgaaactacgcctagagacgtctaggaacggtcaacgggtcttggtacttagttactgttacgacgaaagtaactaaaccggtaattacacttagtaacttaaccgtaacg

SEQ ID NO: 406801 - DNA, 591 bp, Homo sapiens
  misc_feature: GZ8MTXP01BN4YW.45.42.D09.1.454.CMB.2.raw
  modified_base (299)..(299): a, c, t, g, unknown or other
  modified_base (467)..(467): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggagcgtggtccagcctgggagtccctgagactctcctgtgcagcctctggattcaccttcagctactatggcatgcacgtcgggtccnccaggctccgaggcaaggggtcgtgggggagggggtgactagttatatcaattacgtgattacggaaactttagtaaaacgttacctaatcccaaggtacccttccggtagggaacggggccctattaccactactcctacagagaacctaattaccaaagacacgtntagtatcgagacaaatacgaacacgccgtagaaggacgcgtaggacgcgaacggtcttgtcttagttacgtgttagacgaaagtaactaaccggtaaattcgaacttgtaacttaaccgtaacg

SEQ ID NO: 406802 - DNA, 730 bp, Homo sapiens
  misc_feature: GZ8MTXP01AF8E5.45.42.D09.1.454.CMB.2.raw
  modified_base (150)..(150): a, c, t, g, unknown or other
  modified_base (204)..(204): a, c, t, g, unknown or other
  modified_base (238)..(238): a, c, t, g, unknown or other
  modified_base (243)..(243): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacggganaaatgtgatgacgcagtctccagccacctgtctgtgtctaccggaaggggaaancgtccaccctctccgtgacgacgggccagccagngtgcngcagctacttgcctaggaccagacagaacctggaccaggcctccgaggcctcctcattctagtggtctccttccgcgacggcctagtcgtactccgagctaggttcaggtcggagtgggtcggtcgtaacggggacttcgggttcctttaccgctaaccaccgtactaaccaaacgtccgtcctacccgtagttaccgttaaggtaatttacgtttacgaaccgttttaaattttaccgaaacgtttcgtaaaccgttaaccgaaagggggttttaaactaaacggggtttaacgggtcccgtttacccgggttaccgggtacgggtaaccggtttacccggggaaaccgtaaacggggggaccgaaagggtttaaacgggaaaacctttaacggaaaacggtaccgttgtaccggggtacttccgaaacccgttcttaagttcccgttcgtttaccttccggttaccctcccgtttcccggaaccc

SEQ ID NO: 406803 - DNA, 623 bp, Homo sapiens
  misc_feature: GZ8MTXP01ANDZ3.45.42.D09.1.454.CMB.2.raw
  modified_base (138)..(138): a, c, t, g, unknown or other
  modified_base (148)..(148): a, c, t, g, unknown or other
  modified_base (198)..(198): a, c, t, g, unknown or other
  modified_base (208)..(208): a, c, t, g, unknown or other
  modified_base (212)..(212): a, c, t, g, unknown or other
  modified_base (264)..(264): a, c, t, g, unknown or other
  modified_base (288)..(288): a, c, t, g, unknown or other
  modified_base (407)..(407): a, c, t, g, unknown or other
  modified_base (426)..(426): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctccagnttccaggganaaatgtgatgacgcagtctccagccacctgtctgtgtctccgaggggaangtccaccctntccngcagggccagccagagtgtcagcagcgtacttgcctggtaccagcagaaccnggacaggcctccgaggtcctcctntatctagtggtcgtccttccgaccgacgggtccctacgttcggtacctcccgaggtacccgtaggttccgaggtcggacgtaggggttcgggtcgtaacggggactggttccgtttacncctacgacctatccaaacncgtcctacgtagtactagtaagttctttcgacttagtttaacttacgtagtacctacgtaagttaactaaagttacgtcggtaccgtcggtggtaccgttacggacgtaaggggactaaggggtacgaaactacgaaacggtattgggtcggtcttacgcaccgtaatctaacgtctacttacgtccgttcccgtcg

SEQ ID NO: 406804 - DNA, 634 bp, Homo sapiens
  misc_feature: GZ8MTXP02HQZEI.45.42.D09.1.454.CMB.2.raw
  modified_base (201)..(201): a, c, t, g, unknown or other
  modified_base (369)..(369): a, c, t, g, unknown or other
  modified_base (381)..(381): a, c, t, g, unknown or other
  modified_base (394)..(394): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccacctgtctgtgtctccaggggaaangtcaccctctcctgcagggccagccagagtgtcagcagcgacttagcctggtaccagcagaacctggccaggctcccgaggctcctcatctatggtcgctttcctccgaggggcccacgttggtactccccagcccaggttccaggtggcaggtggggtctggggacnggtcgttttacnctccacatcaacncgcctacagtctagtaagttatttgacttagtttacttacgttcgttacctaacgttaagttaattaaagttacggttcggtacccgttccggtacgggtaccggttcgggaccgtaacggggtaaccgtaaagggtaacggtaaaacgtaaccgtaaaacggtaacgttaggtacggtacgtacgtaccgacctaacgttcgttacgttaccttacgtacctttcccgtttacccgtac

SEQ ID NO: 406805 - DNA, 491 bp, Homo sapiens
  misc_feature: GZ8MTXP02GOQPM.45.42.D09.1.454.CMB.2.raw
  modified_base (336)..(336): a, c, t, g, unknown or other
  modified_base (346)..(346): a, c, t, g, unknown or other
  modified_base (378)..(378): a, c, t, g, unknown or other
  modified_base (384)..(384): a, c, t, g, unknown or other
  modified_base (387)..(387): a, c, t, g, unknown or other
  modified_base (389)..(389): a, c, t, g, unknown or other
  modified_base (391)..(391): a, c, t, g, unknown or other
  modified_base (398)..(398): a, c, t, g, unknown or other
  modified_base (401)..(401): a, c, t, g, unknown or other
  modified_base (403)..(405): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (414)..(414): a, c, t, g, unknown or other
  modified_base (416)..(416): a, c, t, g, unknown or other
  modified_base (419)..(419): a, c, t, g, unknown or other
  modified_base (421)..(421): a, c, t, g, unknown or other
  modified_base (423)..(423): a, c, t, g, unknown or other
  modified_base (428)..(429): a, c, t, g, unknown or other
  modified_base (434)..(434): a, c, t, g, unknown or other
  modified_base (439)..(439): a, c, t, g, unknown or other
  modified_base (484)..(484): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtctgggggaggcgtggtccagcctgggaggtccctgagactctcctgtgcagcctctggattcaccttcagctactatggcatgcactgggtccgccaggctccaggcaaggggtctggaggggtgcacttanatcatatgangatataatatatcagatccgtgaaggacgatnacatcncanananatacaanaanannnantnanaananaanancnagagnngaganacgcntctattactagtagagaaagaaagaaacgaaaactaaactaatanactacac

SEQ ID NO: 406806 - DNA, 695 bp, Homo sapiens
  misc_feature: GZ8MTXP02FW08D.45.42.D09.1.454.CMB.2.raw
  modified_base (201)..(201): a, c, t, g, unknown or other
tcagacgcgatcgacacgaccggtgctcgatttagacacatacgcagggaaaggggaggaactgctcagttaggacccagacggaaccatggaagccccagcgcagcttctcttcctcctgctactctggctcccagattccacgggagaaatagtgatgacgcagtctccagcccacctgtctgtgtctccgagggaaangtccaccctctcctgcgaggccagccagtagtgtcagcacggcgtacttacgccgtacggacagacaacgaaccgtggaccacggcctacccgagtccctcctactactctagtcggtctccttcccgaccggacggtccctacgttcgtaccgtacccgacgtccgtaggttcacggtacggcgtagggtcgggttacgacggggtacctacgggttccctttacgtacctacccgtacctaataccgaacgtaccgtcccttaaccgtagttccgtaagttaacgtttattcggtactttaagtttactacgtctaaacctaacgtatttaaagtagttaaccggtcggtacccgttccggtaggtaccggttaccgggaaacgaacgggtaacgaaggttaacctaaaacgtaccgaaaagttcgtacggttcgaccgtacgtaccctaactcgtttctcgttacctccgtttacgtacccgtccgtaacc

SEQ ID NO: 406807 - DNA, 603 bp, Homo sapiens
  misc_feature: GZ8MTXP02JXT6A.45.42.D09.1.454.CMB.2.raw
  modified_base (203)..(203): a, c, t, g, unknown or other
  modified_base (301)..(301): a, c, t, g, unknown or other
  modified_base (307)..(307): a, c, t, g, unknown or other
  modified_base (372)..(372): a, c, t, g, unknown or other
  modified_base (390)..(390): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagcccaccctgtctgtgtctccaggggaaangtcaccctctcctgcagggccagccagagtgtcagcagcgacttagcctggtaccagcagaaacctggccaggctcccaggcctcctcatctatggtncttccnccagggcccatggactcccagccaggttcaggtggcaggtgggtctggggactggtcgttttacnctacacctataccaaacncgtccctacacgttctagtaagttatttgacttaagtttacttactgtaccacgtagtaataagtagtcggtccttcggtacggtacggttccggaccgaaacggggtaaccgtaaagggtacggaaaactacgaaaacggtaacgtggtacggtactacgaccaaccgtaagtcgttacgttccttaccgtactttcccgtttaccccgacc

SEQ ID NO: 406808 - DNA, 589 bp, Homo sapiens
  misc_feature: GZ8MTXP02HLB4H.45.42.D09.1.454.CMB.2.raw
  modified_base (271)..(271): a, c, t, g, unknown or other
  modified_base (298)..(298): a, c, t, g, unknown or other
  modified_base (485)..(485): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggagcgtggtccagcctgggaggtccctgagactctcctgtgcagcctctgattcaccttnagctactatggcatgcacgtgggtccnccgaggctccgaggccaaggggtctggggaggggtgctacgttatatcatactgattaggtaaaacttataacgttactagtcccaagaaccttccggtaggaaacggggcctaacttccaacctatcctaccgaagacgaactaaacttaccaaagaaccacgctagtatcagtacaaatgaaacngcctagagacgctagaacggacacggtctagtacttaattacgtgtacgaacgtaaaagtaacgtaaaccggtaaatttaccattacgaacttaacccgtaacg

SEQ ID NO: 406809 - DNA, 530 bp, Homo sapiens
  misc_feature: GZ8MTXP02I0UYQ.45.42.D09.1.454.CMB.2.raw
  modified_base (202)..(202): a, c, t, g, unknown or other
  modified_base (211)..(211): a, c, t, g, unknown or other
  modified_base (298)..(298): a, c, t, g, unknown or other
  modified_base (353)..(353): a, c, t, g, unknown or other
  modified_base (364)..(364): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccaggggaaangtcaccctntcctgcagggccagccagagtgtcagcagcgacttagcctggtaccagcagaacctggccaggctcccaggctcctcatctatggtncttcctccagggccatggtactcccagccaggttcagtgcaggtggtctgggacnggtcgtttacnctcacctatcaacagcctcagtctagaagtattttgactagtttatactgtacactagtataatagtgcctcgtggacgttcggacaagggacaagggtagaaactacgaaacgactggtacggctacgacacctaagtctacgttcttactacttccttcccgac

SEQ ID NO: 406810 - DNA, 521 bp, Homo sapiens
  misc_feature: GZ8MTXP02IR06W.45.42.D09.1.454.CMB.2.raw
  modified_base (299)..(299): a, c, t, g, unknown or other
  modified_base (366)..(366): a, c, t, g, unknown or other
  modified_base (451)..(451): a, c, t, g, unknown or other
  modified_base (455)..(455): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggaggcgtggtccagcctgggaggtccctgagactctcctgtgcagcctctggattcaccttcagctactatggcatgcactgggtccnccaggctccaggcaaggggtctgggagggggtgcacttatatcatatgatggaacttataagtactntccagactccgtgaacgggctatcaccatctccagacgacaacttccaaagaacacgctgtatctagacaaatgaacagcctganagcngagacacggctgtctattactgtagacgaaagaataaccggtaaattactagtacgactacctacg

SEQ ID NO: 406811 - DNA, 543 bp, Homo sapiens
  misc_feature: GZ8MTXP02JRGCU.45.42.D09.1.454.CMB.2.raw
  modified_base (300)..(300): a, c, t, g, unknown or other
  modified_base (387)..(387): a, c, t, g, unknown or other
  modified_base (424)..(424): a, c, t, g, unknown or other
  modified_base (459)..(459): a, c, t, g, unknown or other
  modified_base (493)..(493): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggaggcgtggtccaggcctgggaggtccctgagactctcctgtgcagcctctggattcaccttcagctactatggcatgcactgggtccnccagggcctccgaggccaaggggtcgtgggaggggtgccacttatatcatatgatggaaacttataagtactatccagtacctccgngaacggcatcacatctcagagacaatacaagaacacnctagtactctagactaaatgaaacagacctgaagngacgtagaacggacacggctcgtactacttacgngtacgaacgaaagaacgtaaccggtaaattactagtactacgtacctacg

SEQ ID NO: 406812 - DNA, 537 bp, Homo sapiens
  misc_feature: GZ8MTXP02HZB56.45.42.D09.1.454.CMB.2.raw
  modified_base (272)..(272): a, c, t, g, unknown or other
  modified_base (300)..(300): a, c, t, g, unknown or other
  modified_base (323)..(323): a, c, t, g, unknown or other
  modified_base (375)..(375): a, c, t, g, unknown or other
  modified_base (418)..(418): a, c, t, g, unknown or other
tcagacgcgatcgacacgaccggtgctcgatttagacacatacgcagggaaagggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtctgggggagcgtggtccagcctgggaggtccctgagactctcctgtgcagcctctggattcaccttnagctactatggcatgcacgtgggtcccnccaggctccgaggcaaggggtcnggggaggggtgctacgttatatcatatgactaggaactttataaacgtactntcccaagtacctccggtagaacgggcctatcacatctacaganacaactcaaagaacacgactagactctagacaaactgaacagccaggagagtcagagacgacgctgtactatacgtgtagacgaaagtaagtaaacgaattacgtatacgactacctag

SEQ ID NO: 406813 - DNA, 596 bp, Homo sapiens
  misc_feature: GZ8MTXP02JM4LP.45.42.D09.1.454.CMB.2.raw
  modified_base (301)..(301): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtctgggggaggcgtggtccagcctgggaggtccctgagactctcctgtgcagcctctggattcaccttcagctactatggcatgcacgtcgggtcccnccaggcctccgaggcaaggggtctggggagggggtgctacttatatcatatgatggaacttataagttactatccaagtacctccgtagaacggggccctattaccacctaactcctacccgaagacgaactaacttacccaaagacgaccacgtacctagtaactcctagactaaaagtgaaaccacggcctaggaagacgcgtagacggaccgacgggtccttaggtacttaagttacgtggtacgacgtaaaagtacgtaaaccggtaaattactaagtacgtactaacccg

SEQ ID NO: 406814 - DNA, 648 bp, Homo sapiens
  misc_feature: GZ8MTXP02JZIWV.45.42.D09.1.454.CMB.2.raw
  modified_base (205)..(205): a, c, t, g, unknown or other
  modified_base (469)..(469): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagcccaccctgtctgtgtctccgaaggggaaangtccaccctctcctgcagggccagccagagtgtcagcagcgacttagcctggtaccagcaagaaacctggaccaggcctacccgaggcctcctacattctagtgggtctcctttcccgtccgaggggtcccctaacgttcggtacctccccgaagcccgtaagggttcagggtcgggctagggttcggggtctaggggactggggtcctttaacctcgtaccaaccgtaataccaaacacgtccctacgagttctagaaagttnttttgactttagtttattactgtacaactagtaataagtagtcggtcccttcggtaggtaccgttacggaccgtaaacggggaaccgtaaagggtaacgaaaacgtaccgaaaacgtacgtaggtacggactacgaccaacgtaagttctacgttcttactaccttccgttacccgtac

SEQ ID NO: 406815 - DNA, 540 bp, Homo sapiens
  misc_feature: GZ8MTXP02IAXJN.45.42.D09.1.454.CMB.2.raw
  modified_base (300)..(300): a, c, t, g, unknown or other
tcagacgcgatcgacacgaccggtgctcgatttagacacatacgcagggaaagggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtggggggaggcgtggtccagcctggggaggtccctgagactctcctgtgcagcctctggattcaccttcagctactatggcatgcactgggtccnccaggctccaggcaaggggtctggggaggggtgcacgttatatcatatgatggaacttataagttactatccagactccgtaggaacgggccattcacactctaccagagacaattaccaaagaacacgctagtatctagaccaaatgaaacagcctagagagctagaggacacggctgtactattactgtagacgaaaagaacgtaaccggtaaaattactaatacgtaactacctacg

SEQ ID NO: 406816 - DNA, 529 bp, Homo sapiens
  misc_feature: GZ8MTXP02JQNSK.45.42.D09.1.454.CMB.2.raw
  modified_base (298)..(298): a, c, t, g, unknown or other
  modified_base (405)..(405): a, c, t, g, unknown or other
  modified_base (423)..(423): a, c, t, g, unknown or other
  modified_base (430)..(430): a, c, t, g, unknown or other
  modified_base (433)..(433): a, c, t, g, unknown or other
  modified_base (437)..(437): a, c, t, g, unknown or other
  modified_base (440)..(440): a, c, t, g, unknown or other
  modified_base (456)..(456): a, c, t, g, unknown or other
  modified_base (469)..(469): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtctgggggaggcgtggtccagcctgggaggtccctgagactctcctgtgcagcctctggattcaccttcagctactatggcatgcactgggtccncaggctccaggcaagggtctggagggggtgcacttatatcatatgatggaaacttataaagtactatccaagactccgtgaaacgggccgattcaccatctcagaanacaactacaaagaacacntatatcnganaaanaanaacacgacagagaganagagacgacgctntactattactacgtacgaacgaaagaagtaaacgtaaactaactaatagaactaactacg

SEQ ID NO: 406817 - DNA, 557 bp, Homo sapiens
  misc_feature: GZ8MTXP02FX52N.45.42.D09.1.454.CMB.2.raw
  modified_base (299)..(299): a, c, t, g, unknown or other
  modified_base (321)..(321): a, c, t, g, unknown or other
  modified_base (340)..(340): a, c, t, g, unknown or other
  modified_base (346)..(346): a, c, t, g, unknown or other
  modified_base (360)..(360): a, c, t, g, unknown or other
  modified_base (410)..(410): a, c, t, g, unknown or other
  modified_base (437)..(437): a, c, t, g, unknown or other
  modified_base (456)..(456): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggagcgtggtccagcctgggagtccctgagactctcctgtgcagcctcgtggacttccaccttcagctactatggcatgcacgtggccncaggctccgaggcaaggggtcnggggaggggtgctacttanatcatntgatggtaacttanaacgttctgtccagtacctccgtgaacgggcctattcactatctacaganacaacttaccaaagacacgctagtacncttagactaaagtgaaacncgcctagacgacgcgtaggaacgacgacggtcttagtacttaagttactgtacgacgtaaaagaacgtaaccggaaatttacgattacgaacttacgtacg

SEQ ID NO: 406818 - DNA, 538 bp, Homo sapiens
  misc_feature: GZ8MTXP02G7ERV.45.42.D09.1.454.CMB.2.raw
  modified_base (201)..(201): a, c, t, g, unknown or other
  modified_base (303)..(303): a, c, t, g, unknown or other
  modified_base (351)..(351): a, c, t, g, unknown or other
  modified_base (362)..(362): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccaggggaangtcaccctctcctgcagggccagccagagtgtcagcagcgacttagcctggtaccagcagaacctggccaggctcccaggctcctcatctatggtgcttccncgaggccactggtatcccagccaggttcagtgcaggtggctggggacnggtcgtttacnctcaccatcaaacacgcctccagtctagaagtattttgacttagtttattactgtacactagtataatagtgtacctcgtggacgttcggacgtaagggaccaaagggtcggaaaactacgaaacgaacgtgtacggactacgctactaagtctcgttcttcacttccttcccgac

SEQ ID NO: 406819 - DNA, 556 bp, Homo sapiens
  misc_feature: GZ8MTXP02GFEA8.45.42.D09.1.454.CMB.2.raw
  modified_base (299)..(299): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtctgggggaggcgtggtccagcctgggaggtccctgagactctcctgtgcagcctctggattcaccttcagctactatggcatgcacgtgggtccnccaggcctccgaggcaaggggtctggggagggggtgctacttatatcatatgatggtaaacttataagttactatccagtacctccgtagaacgggccgtattccacctatcctaccagacgactaacttccaaagaacacgctagtactctagacaaatcgaacacgcctagacgtacgctaggacgacacggctagtactattacgtgtacgacgaaaagaacgtaaccggtaaattacgtatagactacgtacg

SEQ ID NO: 406820 - DNA, 559 bp, Homo sapiens
  misc_feature: GZ8MTXP02GCMKM.45.42.D09.1.454.CMB.2.raw
  modified_base (203)..(203): a, c, t, g, unknown or other
  modified_base (304)..(304): a, c, t, g, unknown or other
  modified_base (311)..(311): a, c, t, g, unknown or other
  modified_base (384)..(384): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccgaggggaaangtcacctctcctgcagggccagccagagtgtcagcagcgacttagcctggtaccagcaagaaacctggccaggcctcccgaggcctcctcatctatggtcncttcccncgagggccctacgtggtactcccgagccaggttcaggtcggctaggtgggtctaggggactggtccgtttacnctaccacctatcaaacacgccctacagtctagaagtatttgactagtttactactgtacactagtaataatagtgactcgtgacgttcgacgaaggacgtaaggtacgaaaactacgaaaacgtacgtggtacgctacgccaacaacgttctacgtcctctacttccttcccgac

SEQ ID NO: 406821 - DNA, 597 bp, Homo sapiens
  misc_feature: GZ8MTXP02FRFJ5.45.42.D09.1.454.CMB.2.raw
  modified_base (150)..(150): a, c, t, g, unknown or other
  modified_base (201)..(201): a, c, t, g, unknown or other
  modified_base (209)..(209): a, c, t, g, unknown or other
  modified_base (290)..(290): a, c, t, g, unknown or other
  modified_base (308)..(308): a, c, t, g, unknown or other
  modified_base (357)..(357): a, c, t, g, unknown or other
  modified_base (363)..(363): a, c, t, g, unknown or other
  modified_base (373)..(373): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacggganaaatagtgatgacgcagtctccagccaccctgtctgtgtctcgaggggaangtcacctntcctgcagggccagccagagtgtcagcagcgtacttagcctggtaccagcaagaacctggccaggcctcccaggcctcctnatctatggtctccttccncgagggcccacgtggtactcccgagctaggttcaggtggcaggtggtcngggacnggtcgttacnctacacctataccaactcgtccctactagtactagtaagttatttgacttaagtttacttactcgtacaaccgtagttactaaagttacggtcggtaccttaccggtaggtaccgttacgggaaccgtaagggaaccgtaagggtacggtaaaactacgaaaacggtctagggtcgacgtacgacaaccgtaattcgtcgttactacgtaccttcctccgtacc

SEQ ID NO: 406822 - DNA, 654 bp, Homo sapiens
  misc_feature: GZ8MTXP02I5K3H.45.42.D09.1.454.CMB.2.raw
  modified_base (202)..(202): a, c, t, g, unknown or other
  modified_base (218)..(218): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccgaggggaangtcaccctctcctgcngggccagccagagtgtcagcagcgacttagcctggtaccagacaagaacctggaccaggccctccccgaggtcctcctcattctagtggtctccttccctccgacgggccctacgtggtacctcccgagcccgtaggttcaggtcggctaggtcgggtacgtgggactggttccgtttactcctaccacctataccaacacgtccctacgtagtctaaggtaagtttatttcggactttaagttttacttaccgtgttaacctaccttaagttaacttaaggtagttcggactacggtccggtagggtaccggttcggaacgtaacggggaacctaagggtaacggaaaactaacggaaaaccgtaagttcggtacgaccgtgaacccgtaaccttagttcccgttacgttctttccgtacctttcccgttccccg

SEQ ID NO: 406823 - DNA, 740 bp, Homo sapiens
  misc_feature: GZ8MTXP02I6GVJ.45.42.D09.1.454.CMB.2.raw
  modified_base (261)..(261): a, c, t, g, unknown or other
  modified_base (274)..(274): a, c, t, g, unknown or other
  modified_base (301)..(301): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggaggcgtggtccaggccgtggggagtccctgagactctctgtgcagcctntggattcaccttnagctactatggcatgcacgtgggcccncaggcctccgaggcgaaggggtcgtggggagggggtgactacttaatagtcaagtagtggtaagttagggtaaaaccttttagtaaaacggttacttaacgtccccaaaggtaacccgtttacccggggtaagggaaaccgggggtacccttaaactttacccgaacccctaaactttcccgtaacccgaaaggtaaacggaaacctaaaccgtttacccgaaaaggacgtaccgaaccggtcttaggttactacgtacgaacctaaaagtacgaaaaccgacggaccgtaggaacgtacgtacggtacggaacggggtaccgtacggtaccgttacggttaaccgttaaacgtttaccggtacggtaacgtaaaacgggtaaaacggtaacgttaaaaccggttaaacttaacgttacgtaacggttaaccgtaaccg

SEQ ID NO: 406824 - DNA, 595 bp, Homo sapiens
  misc_feature: GZ8MTXP02HO94W.45.42.D09.1.454.CMB.2.raw
  modified_base (301)..(301): a, c, t, g, unknown or other
  modified_base (324)..(324): a, c, t, g, unknown or other
  modified_base (494)..(494): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggagcgtggtccagcctgggagtccctgagactctcctgtgcagcctctggattccaccttcagctaactatggcatgcacgtgggtcccnccaggcctccgaggcaagggtcnggggaggggtgactacttatatcatagtgtatggtaaactttataaacgttactatcccaagtaccttaccgtagggaaacgggccctaattccaccatcctaccgagacgtaactaacttaccaaagaaccacgtacctagttaactccttagactaaaagtagaaacngtacctagagacgctaggacgacgacggcttaggtactaagttctagtacgaacgaaaagtttaacgaaaccggtaaattactaatagtacctaactacgg

SEQ ID NO: 406825 - DNA, 723 bp, Homo sapiens
  misc_feature: GZ8MTXP02HNKNF.45.42.D09.1.454.CMB.2.raw
tcagacgcgatcgacacgaccggtgctcgatttagacacatacgcagggaaagggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtggggggaggcgtggtccaggccgtggggacggtccctgagactctcctgtgcagcctcgtggtattccacccttcagctactatggcatgccacgtgggtcccgccagggcctaccgaggccgaaggggtcgtggggacgggggttgccttaacgttaatatcgaattagtagattaggggtaaacttttaagtaagttaactactcccgaaagttacccgttacccgggttagggaaaccgggggtcccgttaaattacccgtaaaccctactttaccctaccccgtaaaggaaccgtaaacctaaacgtttaacccgaaaacggtacgtacccgaaccgtccgttaggttaaactccgttaacgaacctaaaagttcgaaaacgtacgtaccgtaggacggaggacgtaggaacggaccgacggtcgttacgtacttaaacgttacgtaggtacgaacggtaaaacgtaacgttaaacccggtaaaattaccgtaacacgttaacctaacccg

SEQ ID NO: 406826 - DNA, 615 bp, Homo sapiens
  misc_feature: GZ8MTXP02HN2BY.45.42.D09.1.454.CMB.2.raw
  modified_base (204)..(204): a, c, t, g, unknown or other
  modified_base (303)..(303): a, c, t, g, unknown or other
  modified_base (365)..(365): a, c, t, g, unknown or other
  modified_base (376)..(376): a, c, t, g, unknown or other
  modified_base (389)..(389): a, c, t, g, unknown or other
tcagacgcgatcgacacgaccggtgctcgatttagacacatacgcagggaaagggggaggaactgctcagttaggacccagacggaaccactggaagccccagcgcagcttctcttcctcctgctactctggctcccagattccacgggagaaatagtgatgacgcagtctccagccaccctgtctgtgtctccgaggggaaangtcaccctctcctgcagggccagccagagtgtcagcagcgacttagcctggtaccagcagaaacctggccaggctcccgaggcctcctcatctatggtnccttcctcagggccacttggtactcccgagtccaggttcagtggctaggtgggtctgggacnggtcgtttacnctcatcatcaacngcctcagtctagtagtattttgacttagtttacttactgttacctaacctaagttaattaagttaaagggtcgtacccgttaccggtacggtaccggttacgaaaccgtaaacggggtaacctaaaacgggttaacggaaaacgtaacgaaaacgtaaacgttaggtacgggtacctggaccaacctacgttaccttcggtacctttcgtactttcctttaccccg

SEQ ID NO: 406827 - DNA, 594 bp, Homo sapiens
  misc_feature: GZ8MTXP02FOFQV.45.42.D09.1.454.CMB.2.raw
  modified_base (272)..(272): a, c, t, g, unknown or other
  modified_base (301)..(301): a, c, t, g, unknown or other
  modified_base (357)..(357): a, c, t, g, unknown or other
  modified_base (505)..(505): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggagcgtggtccagcctgggaggtccctgagactctcctgtgcagcctctggattcaccttnagtctactatggcatgcacgtgggtcccncaggcctaccgaggccaaggggttccgtaggggaacgggggttgcctaacgtttanatctaatactggattagggtaaactttaagtaaacgtacttatccgaagtacctcccggtagaaacggggcctattaccactatcctaccgaagacgaacaacttaccaaacgaacacgctagtactactagactaaaatcggaaacncgacctagagagctaggaggacacggctgtctattacgtagacgacgaaataacgtaaacgtaaattacgtatacaacgtacctaacgg

SEQ ID NO: 406828 - DNA, 623 bp, Homo sapiens
  misc_feature: GZ8MTXP02GB10S.45.42.D09.1.454.CMB.2.raw
  modified_base (309)..(309): a, c, t, g, unknown or other
  modified_base (539)..(539): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggaggcggtggtccagccgtggggaggtccctggagactctcctgtgcagcctctggacttcaccttcagctactatggcatgctacgtcggggtcccnccgagggcctccgaggccgaaggggtcgtggggagggggtggctacgttatatctatagtagagtaggtaaactttataaagtactatccaagtaccgtccggtaggaacggggtcccgtattccacctaacttcacccgaagacgtaaacctacttaccaaacgacacgtcttagtactctagacaaatagaaacacgccgtagaggactcgaggacgactaccgggtntcgttactaagttacgtggtacgaacggtaaaagtaaccgttaaaaccggttaaattaccgtaagtacgaaccgttaccgtacg

SEQ ID NO: 406829 - DNA, 641 bp, Homo sapiens
  misc_feature: GZ8MTXP02G2QNH.45.42.D09.1.454.CMB.2.raw
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggaggcgtggtccagcctgggaggtccctgagactctcctgtgcagcctctggattcaccttcagctactatggcatgcacgtcgggtcccgccagggcctccgaggaccgaaggggtcgtggggagggggttgctacttatatcatatgataggaacttataagtactatccaagtacctccgtaggaacgggtccgtattccaaccctattccgtaccaagaacgaactaaacttaccaaacgaaaccacgtacctagtacttctacgaactaaagtcgaaaccacgcccgtaggagtaacgccgtaaggacggaaccgtaacgggtccttaggttaccttaaagtttaccgtacggttaggaaccggtaaaagtaacgttaaaacccgggtaaaatttaccgaattaacggtaactaacccgtaacgg

SEQ ID NO: 406830 - DNA, 752 bp, Homo sapiens
  misc_feature: GZ8MTXP02IZIA1.45.42.D09.1.454.CMB.2.raw
  modified_base (256)..(256): a, c, t, g, unknown or other
  modified_base (274)..(274): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggaggcgtggtccagccgtgggaggtccctgagactctcctgtgcngcctctggattcaccttnagtctactatggcatcgcacgtcgggtcccgcgagggcctccgagggaccgaaggggtcgtggggaggggggtcgacctacgtttaatacgtctaattagtacgattaggggtaaaaccttttaagtaaacgttaaccttataccccgtagtaaccccgttcccggttaggggaaacggggcccgttaactttacccgaaaccctacttacccgttaccgaaacgaacgtaaaacctaaaccgtttaacccgaaaacggtaaacccacgtacgttaagttacttacgtacgtaaacgtaaaacgttcggaaaaccctaaccggtccgtaggaacggaacggttcgaaacgggaccggaaccgtaccggggttcttacggttactttaacgtttaccggtaggttaaacggaacggtaaaaacgtaacggtaaaacccggttaaaattaaccgtagtaacgtaacctaaccttaaccgg

SEQ ID NO: 406831 - DNA, 550 bp, Homo sapiens
  misc_feature: GZ8MTXP02HWB0Z.45.42.D09.1.454.CMB.2.raw
  modified_base (298)..(298): a, c, t, g, unknown or other
  modified_base (466)..(466): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggagcgtggtccagcctgggagtccctgagactctcctgtgcagcctctggattcaccttcagtctactatggcatgcactgggtccncaggctccgaggcaaggggtctgggaggggtgctacgttatatcattatgaatggaaactttataagtactatccaaagtctccgtagaacgggctattcaccatctcagagacaattccaaagacaacgctagtactctagacaaatgaaccagcctaggagagacnggaacgacacggacttaggtacctatttaacgcgtacgaacgtaaagtaacgtaacgtaaattactagtacgtactaacgtacg

SEQ ID NO: 406832 - DNA, 557 bp, Homo sapiens
  misc_feature: GZ8MTXP02GATDY.45.42.D09.1.454.CMB.2.raw
  modified_base (271)..(271): a, c, t, g, unknown or other
  modified_base (299)..(299): a, c, t, g, unknown or other
  modified_base (503)..(503): a, c, t, g, unknown or other
  modified_base (515)..(515): a, c, t, g, unknown or other
tcagacgcgatcgacacgaccggtgctcgatttagacacatacgcagggaaagggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggagcgtggtccagcctgggagtccctgagactctcctgtgcagcctctggattccaccttnagctactatggcatgcactggggtcccnccagggcctccgaggccaaggggtctggggagggggtgctacgttatatcatagtgatagggtaaactttagtaaacgtactatcccaagtacctccggtagaaacggggccctattccacctactctacagagacaacttacaaagaacacgctagtactctagacaaatacgaaacacgcctagagagcgtgacgacacggntgtctattacgngtagacgaaagaacgtaacggaaattactatagactactacg

SEQ ID NO: 406833 - DNA, 863 bp, Homo sapiens
  misc_feature: GZ8MTXP02JGSV3.45.42.D09.1.454.CMB.2.raw
  modified_base (203)..(203): a, c, t, g, unknown or other
  modified_base (212)..(212): a, c, t, g, unknown or other
  modified_base (231)..(231): a, c, t, g, unknown or other
  modified_base (259)..(259): a, c, t, g, unknown or other
  modified_base (305)..(305): a, c, t, g, unknown or other
  modified_base (313)..(313): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccgaggggaaangtcaccctntcctgcaggcccagccagngtgtcagcagcgacttagcctggtaccngcagaacctggccaggcctcccgaggcctcctcatctagtcggtcnccttcccnccgacgggccacgttggtactcccccgaggtcccgtaaggtttcgaacgggttcggacgtacgggttcgggggttccgtagggggaacctagggttcccgtttttaaacctccttacccgtaaccctaacttacccaaaccgtaacccgtcccccttacccgtacggttacccgttacgggttaaaacgtttacgttttttacggtaacctttaaggttttttaaacgtttaaccctttcggtttaaacccttaaaccccggttaaagttttaaacgtttaaaagttaaaccgggtttccgggggttaacccccgtttacccggggttacgggggttaaccccgggtttacccgggggtaaaccccggtaaaaccgggggtaaaccccggtaaaacgggggttaacgggtaaaaaaccggtttaacccggaaaaaccgggttaaaacggttcggggtacgggtacccgttaacggaccccgtaacccgttaacgttccgtttacggtttacccttaccgttaaccgtttccccgtttacccccgtacccg

SEQ ID NO: 406834 - DNA, 615 bp, Homo sapiens
  misc_feature: GZ8MTXP02IFERN.45.42.D09.1.454.CMB.2.raw
  modified_base (302)..(302): a, c, t, g, unknown or other
tcagacgcgatcgacacgaccggtgctcgatttagacacatacgcagggaaagggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggaggcgtggtccagcctgggaggtccctgagactctcctgtgcagcctctggattcaccttcagctactatggcatgcactggggtcccnccagggcctccgaggccgaaggggtctggggagggggtggactacgttatatcattagtagatggtaaacttataaagttactactccaaggtaccttcccggtaggaaacgggggtcctagtttacccaccacttacctaccgagaacgaacaaacttaccaaagtaaccacgctagtactcgtagacaaatacgaaacacgacctaggagaacgctaggaacggaccgtaacgggtctacggttactagttactggtacgacgtaaaagaacgttaaaccggtaaaattactaatacgtaactacctacgg

SEQ ID NO: 406835 - DNA, 588 bp, Homo sapiens
  misc_feature: GZ8MTXP02JYBJ5.45.42.D09.1.454.CMB.2.raw
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggagcgtggtccagccgtgggagtccctgagactctcctgtgcagcctcgtggattcaccttcagctactatggcatgcacgtcgggtcccgccaggcctccgagggccgaaggggtctggggagggggtcgactacgttatatctatatagataggaaactttataagtactatccagtacctcgagaacgggcatccaccatctaccagacaacacttaccaaagtacacgactagtactctagaactaaatcggaaacacgccgtaggacgagccgtagaacggaaccgtacgggtaccttggtaccttagtaccgtggtacgaaccgaaagtaaccgtaacggtaaaacttacgtaatcgtaactaccgtaacg

SEQ ID NO: 406836 - DNA, 655 bp, Homo sapiens
  misc_feature: GZ8MTXP02JHDUK.45.42.D09.1.454.CMB.2.raw
  modified_base (259)..(259): a, c, t, g, unknown or other
  modified_base (264)..(264): a, c, t, g, unknown or other
  modified_base (277)..(277): a, c, t, g, unknown or other
tcagacgcgatcgacacgaccggtgctcgatttagacacatacgcagggaaagggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggaggcgtggtccaggcctggggacgtccctgagtactctcctgtgcngcctntgacttcaccttnagctactatggcatgcacgtcggtccgcaggcctccgaggccgaaggggtcgtggggagggggtgacgtacttatatcaatatgagtacgtaaactttagtaaacgttactacgtaccaaggtaccgttccggtagggaaacgggtccgtacttacccacctactcccgtacaagacgtaactaaacttaccgaaaagtaaccacgtcttaacgtactaccgtagacctaaaagtacgaaactacggacctaggacgaacgccgtaggggaacggaaccgtacggtcgttacgtaccttagttacgtcggtaacgaacggtaaaacgtaacgtaaaaccggttaaaacttacgttaatacgtaaacctacgtaaccgg

SEQ ID NO: 406837 - DNA, 770 bp, Homo sapiens
  misc_feature: GZ8MTXP02GMU6R.45.42.D09.1.454.CMB.2.raw
  modified_base (200)..(200): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctcgagggaangtccaccctctcctgcgagggccagccagagtgcagcagcgtacttagcctggtaccagcaacgaaaccgtggaccaggccctcccgaggtcctcccgtactacttcctaagttcgggtcgtcccttttcccgacccgacggggtcccctaacggtttcgggtaaccttcccccgagtccccgtaagggtttcacggttcgggctaggggttcggggtctaggggacctaggggttccgttttacctccgttaccaaccctattacccaaaccgtacgtccccttaccgaacgttccgtaaggtaaacgtttatttttcggacgtttaagtttttaacttacgtcgtacctaaccgttaaagttaactttaaagtaacggttccgggtacccgttaccgggttacgggtaacccgggtttcggaaacccggtaaacgggggtaacccgtaaaggggttaacggaaaacctaaccggtaaaacggtaaccgtttgggacggtaccgtacggtaacccaccgtaattccgtacggtttaccttaccgtactttccccggttaccccgtaccg

SEQ ID NO: 406838 - DNA, 694 bp, Homo sapiens
  misc_feature: GZ8MTXP02G6MIR.45.42.D09.1.454.CMB.2.raw
  modified_base (202)..(202): a, c, t, g, unknown or other
  modified_base (348)..(348): a, c, t, g, unknown or other
  modified_base (693)..(693): a, c, t, g, unknown or other
tcagacgcgatcgacacgaccggtgctcgatttagacacatacgcagggaaagggggaggaactgctcagttaggacccagacggaaccatggaagccccagcgcagcttctcttcctcctgctactctggctcccagattccacgggagaaatagtgatgacgcagtctccagccaccctgtctgtgtctccgaggggaanagtccaccctctcctgcagggccagccagagtgtcagcagcgacttagcctggtaccagcaacgaaacctggaccaggcctcccgacggcctcctcatctagttcggtctccttcccgtcgacgggtccctacgttcgtttacccncccgacgtccgtaggttcgacggtcggtcgtgggttcgggtcggtacgggtacgttcggttaccgtttactcctacctaacctactaccaaacgccgtaccctaccgtacgtcgtaagtaacgtttcgtttagtactttagtttacttacttacgtaacctaacgttaaagttaagttaacgttacggtccggtaccgttacgggtacggttaccggttaccggaacggtaaacgggtaacggtaagggtaacgtaaaacgtaaccggtaaacggtacggtaggtacggtacgtacgaaccgtacgtcgtaccgttcgttcctaccttaccttccccgttacccnc

SEQ ID NO: 406839 - DNA, 756 bp, Homo sapiens
  misc_feature: GZ8MTXP02GMH4V.45.42.D09.1.454.CMB.2.raw
  modified_base (276)..(276): a, c, t, g, unknown or other
  modified_base (305)..(305): a, c, t, g, unknown or other
tcagacgcgatcgacacgaccggtgctcgatttagacacatacgcagggaaaggggggagaggagcccagcactagaagtcggcggtgtttccattcggtgatcagcactgaacacagaggactcaccatggagtttgggctgaactgggttttcctcgttgctcttttaagaggtgtccagtgtcaggtgcacttggtggagtcgtgggggaggcgtggtccagccgtgggaggtccctgagactctcctgtgcagcctctggacttccaccttnacgctactatggcatgcacgtcgggtccnccgaggcctccgaggcgaagggtcgtgggaggggtcgctacttatatactatagtgataggtaaacttataacgttactactaccgaagtaccgttacggtagaacgggggtcccagtttacccaacccgtatacccgtacccgaaaggtaacgtaaaaccgtaaattaccccgaaaacgaaaccaaacccggtacgttaaacggtttaactaccgtacggtaaaacctaaaacgttaccggaaaaccgtaaccggtaccgttacggaaacggaaccggtcgtaacggggaaaccgggtaacccggtacgggtacccgtttaggttaacccctttaaaggttacttaccggggtaaacggaaccgttaaaaaacggaacggtttaaaaacccccggtaaaattttaaacccgtaacgtaaacgttaaaccgttaaacccgtttaacccggg

SEQ ID NO: 406840 - DNA, 531 bp, Homo sapiens
  misc_feature: GZ8MTXP01AIPUX.52.34.D01.1.454.CMB.2.raw
  modified_base (433)..(433): a, c, t, g, unknown or other
  modified_base (529)..(529): a, c, t, g, unknown or other
  modified_base (531)..(531): a, c, t, g, unknown or other
tcagcgcagtacgacacgaccggtgctcgatttagatcgtctgtgttgggtttggggaggcttggtaaagcgggggtatctgagactctcctgttcagtctctggattcaccttaaataactatggcatgagctgggtccgccaggctccagggaagggctggagtgggtctcatttatcagtggtactggtggtagcacatactacgcagactccgtgaagggccggttcaccatctccaaagcaattccaaagaacacgctgtatttacaaatgaacagcctgagagccgaggacacggccgtatattactgtgtgaaagatctccacgtctcgccccttggactggttattccgactctggggccagggaaacccctagtcgccgtctctcagcctcaccaggcccatcgtctcccctgcacctcctcanacgcacctctggggggcacgacgcggccctgggcctgcctggtcaaggctacttcctattacgattcgctgacgcgggctgggcaaggcgcgatgngn

SEQ ID NO: 406841 - DNA, 575 bp, Homo sapiens
  misc_feature: GZ8MTXP01D9NF8.52.34.D01.1.454.CMB.2.raw
  modified_base (569)..(569): a, c, t, g, unknown or other
  modified_base (573)..(573): a, c, t, g, unknown or other
  modified_base (575)..(575): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaagggctggagtgggtctcatttatcagtggtactggtggtagcacatactacgcagactccgtgaagggccgttcaccatctaccaaagacaattccaagaacacgctgtatttacaaatgaacagcctgagagccgaggacacggccgtatattactgtgtgaaagatctccacgtctcgcccccttggactggttatttccgactcgtggggccagggaaaccctagtgcccgtctccctcacgccctccacccacgggcccatccggtccttccccctggcccacccctcctcccaagacgccaccgtcgtcggggggggcacgacgcccggcccgtgggctcgcccgtggtcaacggactaccttcctaattacgacttcgcgtgacgcgggctgggcaaggccganatgngn

SEQ ID NO: 406842 - DNA, 604 bp, Homo sapiens
  misc_feature: GZ8MTXP01CYTAS.52.34.D01.1.454.CMB.2.raw
  modified_base (335)..(335): a, c, t, g, unknown or other
  modified_base (366)..(366): a, c, t, g, unknown or other
  modified_base (602)..(602): a, c, t, g, unknown or other
  modified_base (604)..(604): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattccaagacacgctgtattacaaatgaacagcctgagagccgaggacacggccgtatattactgtgtgaaagatctccacgtcnccgtccccttgactggttatttccgactcgngggccagggaaaccctagtcgcccgtctcctcacgccctaccaccaacgggcccacgtccggtccttcccccgtcggccctacccctccctacccaaagacgcctaacccgtcgtcgggggggggccacgacgccgggccccttggggcctgcccgtggtaccaaacggaccttacctttcctaacttacggacttcggtcctgggacgcgggctcggacgaacggcgcagtaagngn

SEQ ID NO: 406843 - DNA, 546 bp, Homo sapiens
  misc_feature: GZ8MTXP01EFU8Z.52.34.D01.1.454.CMB.2.raw
  modified_base (541)..(541): a, c, t, g, unknown or other
  modified_base (545)..(546): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattccaagaacacgctgtatttacaaatgaaacagcctgagagccgaggacacggccgtatattactgtgtgaaagatctccacgtctcgcccccttgactggttatttccgactctggggccagggaaacccctagtgccgtctccctcagcctccaccaacggcccatcggtcttcccctggccaccctcctccaagacgcacctcgtggggggggcacgagccggccctgggctcgcctggtcaaggctactcctacttcgacttcgctgagcggctggcaaggccgnatgnn

SEQ ID NO: 406844 - DNA, 568 bp, Homo sapiens
  misc_feature: GZ8MTXP01DKWHU.52.34.D01.1.454.CMB.2.raw
  modified_base (536)..(536): a, c, t, g, unknown or other
  modified_base (556)..(556): a, c, t, g, unknown or other
  modified_base (558)..(558): a, c, t, g, unknown or other
  modified_base (563)..(563): a, c, t, g, unknown or other
  modified_base (565)..(565): a, c, t, g, unknown or other
  modified_base (567)..(568): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaagggctggagtgggtctcatttatcagtggtactggtggtagcacatactacgcagactccgtgaagggccgttcaccatctaccaaagacaattccaagaacacgctgtatttacaaatgaacagcctgagagccgaggacacggccgtatattactgtgtagaaagatctccacgtctccgccccttggactggttatttccgactcgtggggccagggaaacccctagtcgcccgtctccctcacgccctcccaaccaaacgggcccatcggtcctccccctcggcccaccctcctccaacgacgcaccgtcgtcgggggggggcacgacgccggcccgtcggggctcggacctggtccaaggactacttctanacgacttcgctgagcggcgngnaagcnangnn

SEQ ID NO: 406845 - DNA, 603 bp, Homo sapiens
  misc_feature: GZ8MTXP01B7QVL.52.34.D01.1.454.CMB.2.raw
  modified_base (583)..(583): a, c, t, g, unknown or other
  modified_base (601)..(601): a, c, t, g, unknown or other
  modified_base (603)..(603): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaaagacaattccaaagaacacgctgtatttacaaatgaacagcctagagagccgaggacacggccgtatattactgtgtagaaagactctccacgtctccgcccccttggactggttactttccgactcgtggggccagggaaaccctagtcgccgtctccctcacgccctaccaccaacgggcccacgtccggtcccttcccccgtcggccctacccctcctacccaacgcgccaccgtcgtcggggggggacacgacgcccggcccgtgggcctggcccgtggtaccgaacggtaccttaccttccctaattaccgattccgctgacggcgggcngggcaacggcgcataagngn

SEQ ID NO: 406846 - DNA, 684 bp, Homo sapiens
  misc_feature: GZ8MTXP01AYMN3.52.34.D01.1.454.CMB.2.raw
  modified_base (225)..(225): a, c, t, g, unknown or other
  modified_base (241)..(241): a, c, t, g, unknown or other
  modified_base (244)..(244): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctgganatgcattgacaaacgntangcttatggacagcagaagccggcaggcccctgtgttggtgatgtaataaagcactgagacggccctgagggactccctgacgccgactttctcgtcggcctaccgagggtcgaaggggaaccaaacgggttccaacgtaacgtttcgggacccctaagtaccgtaaggttacgggacgttacccgaaggggaccaaggggaagggaccggaaacggggtcttaacggaacttttaaagtttaacgggtttacggttaacaaaacgtttaccaaaaccgtaacggaaccctaaacccgtaagttttacgggttaacctttagttccggtttacgttaaccgggtaaacttcggaccgttaaccgtaaacggtcccgttaacccggttccgttcgggtaaccaccggaacccaacgggaccccaacccctcgttcgtaaccc

SEQ ID NO: 406847 - DNA, 528 bp, Homo sapiens
  misc_feature: GZ8MTXP01BHU6Z.52.34.D01.1.454.CMB.2.raw
  modified_base (490)..(490): a, c, t, g, unknown or other
  modified_base (497)..(497): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaacgccggccaggcccctgtgttggtgatgtaataaagacactgagacggccctcgagggactccctgacgcccgattctctggcctccgaggtcgagggaccaacgggtcactagttcggccatcgagtggagtccgaggcaggagacgagctgactattagttgtacaagtacaaactagacacctaattcgtacttatgtcttcggaacttgccacgaagtccncggttcngggtcagcccaaggcccaaccgtcttcgtcc

SEQ ID NO: 406848 - DNA, 584 bp, Homo sapiens
  misc_feature: GZ8MTXP01B6PS6.52.34.D01.1.454.CMB.2.raw
  modified_base (416)..(416): a, c, t, g, unknown or other
  modified_base (425)..(425): a, c, t, g, unknown or other
  modified_base (428)..(428): a, c, t, g, unknown or other
  modified_base (438)..(438): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattccaagaacacgctgtatttacaaatgaacagcctgagagccgaggacacggccgtatatactgtgtgaaagatctccacgtctcgccccttgactggttacttccgactcgtcgggccagggaaaccctagtcgccgtctcctcacgcctcaccacggccancgtctcccngcnccctctcagncacctcgtcggggggcacgacgcggcccgtgggctcgccgtcggtacgaacggaccttacgttcccctaacgttcgacgttcgtacgttcggaacgggttcggccgttaacgggccgaacgggaccgacgttacgtcggttccgcg

SEQ ID NO: 406849 - DNA, 525 bp, Homo sapiens
  misc_feature: GZ8MTXP01DWT42.52.34.D01.1.454.CMB.2.raw
  modified_base (314)..(314): a, c, t, g, unknown or other
  modified_base (431)..(431): a, c, t, g, unknown or other
  modified_base (435)..(435): a, c, t, g, unknown or other
  modified_base (443)..(443): a, c, t, g, unknown or other
  modified_base (520)..(520): a, c, t, g, unknown or other
  modified_base (524)..(525): a, c, t, g, unknown or other
tcagcgcagtacgacacgaccggtgctcgatttagatcgtctgtgttgggtttggggaggcttggtaaagcgggggtatctgagactctcctgttcagtctctggattcaccttaaataactatggcatgagctgggtccgccaggctccagggaagggctggagtgggtctcatttatcagtggtactggtggtagcacatactacgcagactccgtgaagggccgttcaccatctccaaagcaattccaagacacgctgtattacaaatgaacagcctgagagccgaggacacggccgtatattactgtgtnaaagatctccacgtctcgcccccttggactggttattccgactctggggccaggggaaaccctagtcgccgtctccctcacgcctccaccaaggcccatcgtctccctgcaccctcnccanagcactcnggggggcacacgcggccctgggctgccctggtcaaggctactcctattacgattcgctgagcgggctggcaagcganatgnn

SEQ ID NO: 406850 - DNA, 630 bp, Homo sapiens
  misc_feature: GZ8MTXP01DR441.52.34.D01.1.454.CMB.2.raw
  modified_base (184)..(184): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctgggagtgggtctcatttancagtggtactggtggtagcacatactacgcagactccgtgaagggccgttcaccatctaccaaaagacaattccaaagaacacgcttagtatttacaaatgaaacagcctgagagccgaggacacggccgtatattactgtgtagaaagatcctccacgtctccgtccccttgactggttactttccgactcgtggggccagggaaaccctagtcgccgtctcctcacgccctaccgaccaacgggcccacgttccggtccttcccccgtggaccctacccctcctaccaacgacgccaccgtcggtcgggggggccacgacggccggccccgtgggcctcgccgtcggtaccaacggtaccttaccgttcccgtaacgttacgacgttcgtaccgtggaacggttcggttaccgtggaaccgaagggaccctagacgtcgcgtcg

SEQ ID NO: 406851 - DNA, 705 bp, Homo sapiens
  misc_feature: GZ8MTXP01ECWF1.52.34.D01.1.454.CMB.2.raw
  modified_base (227)..(227): a, c, t, g, unknown or other
  modified_base (245)..(245): a, c, t, g, unknown or other
  modified_base (286)..(286): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattcgaccaaacgntatgcttatgtaccagcagacgccggcagccctgtgttggnatagtataagacactgagacgcctgaggactccgtgacgcgacttctcgtcggcctaccgtagggtcacgggtaacaaccggtcaactagttcgggacccatacgaggtacgggacgtacccgaagggacaacgggaaggaaccgggagggtaccgtaaggtaaacctttaagtttaaggttttacggtaaacctaaaacgttacccaaaaacgtaaccggaaacccgtaaacccttaaagtttacgggttaaccttttaaagttcggtttaacccgttaacgggtaaaccttcgggaacccgttaaacccgtaaacggttcccgttaaccccggttccgttaacgggggtaacctaacccgggaacccccgtaaacgggtaccccccaaaaccccgtaaccggtttaacgtaaccccg

SEQ ID NO: 406852 - DNA, 611 bp, Homo sapiens
  misc_feature: GZ8MTXP01D7V7K.52.34.D01.1.454.CMB.2.raw
  modified_base (234)..(234): a, c, t, g, unknown or other
  modified_base (394)..(394): a, c, t, g, unknown or other
  modified_base (455)..(455): a, c, t, g, unknown or other
  modified_base (608)..(608): a, c, t, g, unknown or other
  modified_base (610)..(610): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccgagggaaggggctggagtgggtctcatttatcagtggtactggtggtagcacatactacgcagactccgtgaaggccgttnaccatctccaaagacaattccaagaacagctgtattacaaatgaacagcctgagagccgaggacacggccgtatattactgtgtagaaagatctccacgtctccgcccccttggacttggttactttccgactcgtggggccacggggaaaccctagtcnccgtctccctcacgccctccaccgaacggcccatccggtcccttccccccgtggacccccnctcctacccaacgacgaccacctccgtcggggggcgacgacgccggcccgtcggccgtcgccgtcggtccgaacggtacctaaccgttcctaacgttaccgtacttccgtcgtcgacggcgggcggtcgggcgaacggccgacgacgtaacgngng

SEQ ID NO: 406853 - DNA, 581 bp, Homo sapiens
  misc_feature: GZ8MTXP01BS2TD.52.34.D01.1.454.CMB.2.raw
  modified_base (183)..(183): a, c, t, g, unknown or other
  modified_base (201)..(201): a, c, t, g, unknown or other
  modified_base (462)..(462): a, c, t, g, unknown or other
  modified_base (473)..(473): a, c, t, g, unknown or other
  modified_base (579)..(579): a, c, t, g, unknown or other
  modified_base (581)..(581): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccgagggaagggctggagtgggtctcatttancagtggtactggtggtancacatactacgcagactcgtgaaggccgttcaccatctacaaagacaatccaaagacacgctagtatttaacaaatgaacagcctgagagccgaggacaccggcgtatattactgtgtagaaagatctccacgtctccgcccccttgactgttacttccgactcgtggggccacggaaaccctagtcgcccgtctccctcacgccctccaaccgacggcccactccggtcccttcccctgcccacccctcctaccaacgcnccacgtccggnggggggcacgacgcccggccgtgggctcgccctcgggtacaacggtacctacttcctattacgacttccgcgtgacggcgggccgtggcgaacggcgacttagtgngn

SEQ ID NO: 406854 - DNA, 561 bp, Homo sapiens
  misc_feature: GZ8MTXP01EDXS6.52.34.D01.1.454.CMB.2.raw
  modified_base (556)..(556): a, c, t, g, unknown or other
  modified_base (560)..(561): a, c, t, g, unknown or other
tcagcgcagtacgacacgaccggtgctcgatttagatcgtctgtgttgggtttggggaggcttggtaaagcggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattccaagaacacgctgtatttacaaatgaacagcctgagagccgaggacacggccgtatattactgtgtgaaagatctccacgtctcgcccccttgactggttatttccgactcgtggggccagggaaacccctagtcgccgtctcctcacgcctccaccaagggcccatccggtccttccccctggccaccctcctccaagacgcacctcgtcgggggggggcacgacgccggccccgtggggcctcggcctgggtccaagggacctacttcctattacgattcgctgagcgggctggcaaggcgnatgnn

SEQ ID NO: 406855 - DNA, 592 bp, Homo sapiens
  misc_feature: GZ8MTXP01ECAAB.52.34.D01.1.454.CMB.2.raw
  modified_base (319)..(319): a, c, t, g, unknown or other
  modified_base (590)..(590): a, c, t, g, unknown or other
  modified_base (592)..(592): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccgagggaaggggctggagtgggtctcatttatcagtggtactggtggtagcacatactacgcagactcgtgaaggccgttcaccatctaccaaaagacaattccaagaacacgctgtattacaaatgaacagctgagagccgagacacggccgtatatactgtgtanaaagatctcacgtctccgtccccttggacttgttatttccgactcgtggggccacgggaaaccctagtcgccgtctccctcacgccctccaaccaacgggcccatccggtccttccccctggacccacccctcctaccaaacgacgcctacctcgtcggggggggcaacgacgccggccccgtggccgtgacccgtcggtaccaaggtaccttacttccctaacgttcgagttcgcgtgacggttcggccgtggacaacggccgacatcgngn

SEQ ID NO: 406856 - DNA, 649 bp, Homo sapiens
  misc_feature: GZ8MTXP01EUB09.52.34.D01.1.454.CMB.2.raw
tcagcgcagtacgacacgaccggtgctcgatttagatcgtctgtgttgggtttgggggaggcttggtaaaggcggggggggtatctgagactctcctgttcagtctctggattcaccttaaataactatggcatgagctgggtccgccaggctccgagggaaggggctggagtgggtctcatttatcagtggtactggtggtagcacatactacgcagactccgtgaagggccggttcaccatctaccaaaagacaattccaaagaacacgctagtattaacaaatgaacagcctgagagccgaggacacggccgtatattactgtgtagaaagatctccacgtcctccgcccccttggacttggtttactttccgacctcgtggggcccacgggtaaaccctagtcgcccgtctccctcacgccctccaaccgaacgggcccagtcccggtccttccccccgtggcccaccccctcctacccaagccgctacccgtcgtcggggggggcaccgacggccggcccgtcggggctcgcccgtggtaccgaaacggtccttaaccttcccgtaacgttcggacgttcggtccgtgggaacggttcgggttcccgttgggacccgaacgggtccgaccgttagtcggcctcg

SEQ ID NO: 406857 - DNA, 585 bp, Homo sapiens
  misc_feature: GZ8MTXP01CYXAH.52.34.D01.1.454.CMB.2.raw
  modified_base (583)..(583): a, c, t, g, unknown or other
  modified_base (585)..(585): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaagaacacgctgtatttacaaatgaacagcctgagagcgaggacacggccgtatatactgtgtagaaagatctccacgtctccgccccttgactgttatttccgactcgtgggccaggaaaccctagtcgcccgtctcctcacgccctcaccacggcccatccggttcctccccctggccaccccgtcctaccaacgacgcacccgtcgtcggggggggcacgcggccggcccgtgggcctcggcccgtggtccgaaacggtaccttaccttcctaattacgtagttccgcgttgacgggccgggcgtgggcgaaggcgcataagngn

SEQ ID NO: 406858 - DNA, 653 bp, Homo sapiens
  misc_feature: GZ8MTXP01BJUDH.52.34.D01.1.454.CMB.2.raw
  modified_base (325)..(325): a, c, t, g, unknown or other
  modified_base (488)..(488): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagcaattccaagacacgctgtattacaaatgaacagctgagagccgaggacacggcctagtattactgtgtagaaagntcctccacgtcctccgcccccttgactgttattccgactcgtcggggccagggaaaccctagtcgcccgtctccctcacgcctccaaccgacgggccctacgtccggtcccttcccccgtggtacccaccccttccctacccaaacgcgaccacccgttcggngggggggggaccacggaccggccgggcccgtcggggccttcgcccgtggttaccgaacgggtaccttaacccgttcccgtaaacggttcggcggttcggtaccgtgggaacgttcggttcccgttcgggaccgtaaccgggaccccgttagacgtccgcgtcccg

SEQ ID NO: 406859 - DNA, 610 bp, Homo sapiens
  misc_feature: GZ8MTXP01BX716.52.34.D01.1.454.CMB.2.raw
  modified_base (443)..(443): a, c, t, g, unknown or other
  modified_base (467)..(467): a, c, t, g, unknown or other
  modified_base (608)..(608): a, c, t, g, unknown or other
  modified_base (610)..(610): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaagaacacgctgtattacaaatgaacagcctgagagccgaggacacggccgtatattactgtgtagaaagatctccacgtctccgtcccccttgacttgttacttccgactcgtggggccaggaaaccctagtcgccgtctcctcacgcctccaccgaacgggccctagtccggtccttcccccgngccctacccctcctacccaagacnccaccgtcggtcggggggggccacgacggccccggtcccgtcggggccttcggcccgtgggtaccaacggtaccttaccttcctacgttacgacttccggacgtggacggccgggcgtaacggcgaacgggcacagtaagngn

SEQ ID NO: 406860 - DNA, 617 bp, Homo sapiens
  misc_feature: GZ8MTXP01E0PQA.52.34.D01.1.454.CMB.2.raw
  modified_base (243)..(243): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattcgaccaaacgntatgcttattggtaccagcagaacgccggccaggcccctgtgttggtgatgtaataaagacatgagacggccctacgagggactccccgtaggacgccgtactttcgtcgtggcctacccgagggttcgaagggaccgaacgggtcaactagttcggcccagtcgagtcggagtccgagggcgaaggacgggacgagggctaggtaacttaagtttagttcggttaacaacttacgaaacagaacctacctaagttaggttaactttatcgttcgttaacggtaacttcggaccgttaaacgtaacggtccaaccggttcgttacgggtcacgaaccccgaagggtccccaaaccccgtcgttcggttaacccc

SEQ ID NO: 406861 - DNA, 507 bp, Homo sapiens
  misc_feature: GZ8MTXP01DICC8.52.34.D01.1.454.CMB.2.raw
  modified_base (237)..(237): a, c, t, g, unknown or other
  modified_base (312)..(312): a, c, t, g, unknown or other
  modified_base (430)..(430): a, c, t, g, unknown or other
  modified_base (480)..(480): a, c, t, g, unknown or other
  modified_base (485)..(485): a, c, t, g, unknown or other
  modified_base (499)..(499): a, c, t, g, unknown or other
tcagcgcagtacgacacgaccggtgctcgatttagatcgtctgtgttgggttgggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggccaggcccctggtgttggtgatgtataaagacactgagacgggccctnagggactcccgtgacgccgattctcgtggctccagggtcagggaccaaacggtcacgattggccatcagtggagtccgaggcagaggacgaggctgactattagttgtacaatcaaanagacacaattggtacttatgtctggaacttgcgttacaggtccacgttcnggtcncgccaggccacccncttcgtcc

SEQ ID NO: 406862 - DNA, 586 bp, Homo sapiens
  misc_feature: GZ8MTXP01CLXI9.52.34.D01.1.454.CMB.2.raw
  modified_base (225)..(225): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgganatgcattcgaccaaacgatatgcttatgtaccagcagaagccggccacggcccctgtgttggtgatgtaataaagacactgagacggccctcgagggactcccgtgacgtccgtattcgtcgtcggcctaaccgaggtcgagggaacaacgggtcactacgttcggacctagtcgaaggtgggacgtaccgagggacagggaggacggaggctagacgttattaggttagtacaatacaaacacgacactattcggtacttagtcgttcgttaacggaacttggaccgacgtaaacggtccttacccgttcgttcgggtaaccacgtaacccgaacggacccaaccccgtcttcgtaaccc

SEQ ID NO: 406863 - DNA, 693 bp, Homo sapiens
  misc_feature: GZ8MTXP01E0CFZ.52.34.D01.1.454.CMB.2.raw
  modified_base (184)..(184): a, c, t, g, unknown or other
  modified_base (205)..(205): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccgagggaaggggctggagtgggtctcatttancagtggtactggtggtagcanatactacgcagactccgtgaacgggccgttcaccatctaccaaagacaattccaagaacacgcttagttattaacaaatgaaacagcctgagacgcgagacacggctatattactgtgtagaagtactcctaccacgtcctcccgtccccgttggaccttgtttacttcccgacctcggtcggggacccaacggggtaaaaccctagtcgcccgtcgtcctacgacgtccctaccaaccgaacgggtcccacgttccggtcccttccccgtggacccctaccccttccgaccgaacgcgaccctaccgtcggtacgggggggccacggaccggcccggccgtcgggccttcggacctcggtaccaaacgggtacccttaccgttaacccgtaacgttaccggtacgttccggtcgttacgggacggttccggttccgttaacgggaaccggtaaccggggtaccccagttacccgttggttcccgtcg

SEQ ID NO: 406864 - DNA, 639 bp, Homo sapiens
  misc_feature: GZ8MTXP01AE6GQ.52.34.D01.1.454.CMB.2.raw
  modified_base (505)..(505): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgctattcgaccaaaccgatatgcttagttggtacagcaagaacgccgggcacggcccctgtgttggtgatgtaataaagacactggagacggcccctacgagggtactccccgtggacgccgtattcgtcgtcggcctacccgagggtccgaacggggaacctaacgggtccaacgtacgtttcggaccctaagtcgaggttgggaacgttccggaaggcgaagggagggaccgagggtctagtaacttagttagttgtactaaactacaaacganaactaccgtatttcggttaacttaagttcgttccgttaacgaaaccgttcggaccgttaccgtaaacgggtccacccggttcgttcgggaaccaccgaaccccgaacggaccccttaaccctcgttcgtaaccc

SEQ ID NO: 406865 - DNA, 574 bp, Homo sapiens
  misc_feature: GZ8MTXP01DF00G.52.34.D01.1.454.CMB.2.raw
  modified_base (572)..(572): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaaattccaaagaacacgctagtatttacaaatgaacagcctgagagccgaggacacggccgtatattactgtgtgaaagatctccacgtctcgcccccttggactggttatttccgactccgtggggccagggaaaccctagtcgccgtctcctcacgcctccaccaacggcccatcggtccttccccctggccaccctcctccaagacgcacctcgtggggggcacgacgccggccctgggctgcctggtcaacggcttaccttcccaacgttcgacgttcgtcgtggacgcgggttcctggacaaggccgcgttagtcgntc

SEQ ID NO: 406866 - DNA, 657 bp, Homo sapiens
  misc_feature: GZ8MTXP01EH0OI.52.34.D01.1.454.CMB.2.raw
  modified_base (144)..(144): a, c, t, g, unknown or other
  modified_base (183)..(183): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccnccaggctccagggaaggggctggagtgggtctcatttancagtggtactggtggtagcacatactacgcagactccgtgaagggccgttcaccatctaccaaaagacaattccaaagaacacgctagtatttacaaatgaacagcctgagagccgaggacacggccgtatattactgtgtagaaagatctccacgtctccgccccttgactggttatttccgactcgtggggccagggaaaccctagtcgccgtctcctcacgccctccaccgaacgggcccacgtccggtccttcccccgtggccctacccctcctaccgaagcgcacctcggtcggggggcacgacgcccggcccgtgggcctcggcccgttggtaccgaaacgggtacccttaaccgttcccgtaacgttaccggtaacgttccggtacccgttaggaacgggttccgggttcccgttaacggggacccgtaaacggggtaccccgacgttaagttaacccggttcgtcg

SEQ ID NO: 406867 - DNA, 598 bp, Homo sapiens
  misc_feature: GZ8MTXP01AR3FQ.52.34.D01.1.454.CMB.2.raw
  modified_base (591)..(591): a, c, t, g, unknown or other
  modified_base (597)..(598): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtgtagcacatactacgcagactccgtgaagggccgttcaccatctaccaaagacaattccaagaacacgctgtatttacaaatgaacagcctgagagccgaggacacggccgtatattactgtgtagaaagatctccacgtctccgtcccccttgactggttactttccgactcgtggggcccagggaaaccctgtcgccgtctccgtcacgtccctaccaacccgaacgggccccacgttccgggtcccttcccccgtggcccacccctcctacccgaagacgcctacccttcggacggggggggcaccgacggccggcccgtgggcctgcccgtggtacaaggaccttctcctattcgacttcgcgtggacgcgggctgggacaacggccganagtcgnn

SEQ ID NO: 406868 - DNA, 604 bp, Homo sapiens
  misc_feature: GZ8MTXP01A7Q85.52.34.D01.1.454.CMB.2.raw
  modified_base (186)..(186): a, c, t, g, unknown or other
  modified_base (337)..(337): a, c, t, g, unknown or other
  modified_base (449)..(449): a, c, t, g, unknown or other
  modified_base (602)..(602): a, c, t, g, unknown or other
  modified_base (604)..(604): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccaggggaaggggctgggagtgggtctcatttancagtggtactggtggtagcacatactacgcagactccgtggaagggccgttcaccatcctaccaaaagacaattccaaagaacacgcttagtatttaacaaatgaacagcctgagagccgaggacacggcgtatattactgtgtagaaagntctccacgtctccgccccttggactgttacttccgactcgtggggccacggaaaccctagtcgccgtctcctcacgccctaccacgacggccctagtccgtcccttccccgnggtacccacccctcctaccaagacgccaccgtcggtcgggggggccacggacggcccggtcccgtgggcctcgccgtggtaccgaacggtaccttacgttcctaacttacgacttcgccgtggacggcgggctgggacgaacgggcacgatgngn

SEQ ID NO: 406869 - DNA, 609 bp, Homo sapiens
  misc_feature: GZ8MTXP01A4MY0.52.34.D01.1.454.CMB.2.raw
  modified_base (569)..(569): a, c, t, g, unknown or other
  modified_base (584)..(584): a, c, t, g, unknown or other
  modified_base (589)..(589): a, c, t, g, unknown or other
  modified_base (607)..(607): a, c, t, g, unknown or other
  modified_base (609)..(609): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccaggggaaggggctgggagtgggtctcatttatcagtggtactggtggtagcacatactacgcagactccgtgaagggccgttcaccatctccaaagcaattccaagaacacgctgtatttaacaaatgaacagcctgagagccgaggacacggccgtatattactgtgtgaaagatctccacgtctccgtcccccttggactggttatttcccgactcgtggggcccacgggaaaccctagtcgcccgtctcctcacgcctacccaccgacgggcccacgtccggtcccttcccccgtggccccacccctcctaccgaacgacgccaccgtccgtcggggggggccacgacgcccgggcccgtgggccttcgcccgtggtaccaacggtacctccttccctattacgacttccggntcgacggcgggttcncgggnaacgggcgacttataagngn

SEQ ID NO: 406870 - DNA, 596 bp, Homo sapiens
  misc_feature: GZ8MTXP01APCWX.52.34.D01.1.454.CMB.2.raw
  modified_base (291)..(291): a, c, t, g, unknown or other
  modified_base (391)..(391): a, c, t, g, unknown or other
  modified_base (569)..(569): a, c, t, g, unknown or other
  modified_base (583)..(583): a, c, t, g, unknown or other
  modified_base (596)..(596): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattccaagaacacgctgtatttacaaatgaacagcctgagngccgaggacacggcctatattactgtgtagaaagatcctccacgtctccgccccttgactggttactttccgactcgtggggccagggaaacccctgtcnccgtctcctcagccctaccaaccacgggcccacgtcggtccttcccccgtgccctacccctcctacccaacgacgcctacccttcgcgggggggcacgacgcccggcccgtcgggcctcgccgtgtccgaacggtacctacttccccgaagttcgacgttcgcgtcgacggcggttcnggaccaacgggacncgacgtaacgctn

SEQ ID NO: 406871 - DNA, 537 bp, Homo sapiens
  misc_feature: GZ8MTXP01BSGNK.52.34.D01.1.454.CMB.2.raw
  modified_base (385)..(385): a, c, t, g, unknown or other
  modified_base (513)..(513): a, c, t, g, unknown or other
  modified_base (515)..(515): a, c, t, g, unknown or other
  modified_base (526)..(526): a, c, t, g, unknown or other
  modified_base (532)..(537): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaagggctggagtgggtttcatttatcagtggtactggtggtagcacatactacgcagactccgtgaagggccgttcaccatctaccaaaagacaattccaagaacacgctgttaattacaaatgaacagccagagagccgaggacacggccgtatattactgtgtagaaagatctccacgtcctcgccccttgactggtattcgactcgtgggcaggaccctaagacnccgtctcctcacgcctcaccaacggcccactcggtcctcccctgcccaccctcctaccaacgacgcacctcgtcggggcacgacgccgcccgtggcctcgctggtcaaggctactcaatcgatccggngngcgcggcgcgngagcgnnnnnn

SEQ ID NO: 406872 - DNA, 622 bp, Homo sapiens
  misc_feature: GZ8MTXP01BMBQV.52.34.D01.1.454.CMB.2.raw
  modified_base (619)..(619): a, c, t, g, unknown or other
  modified_base (621)..(621): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagcggtactggtggtagcacatactacgcagactccgtgaagggccgttcaccatctaccaaagacaattccaagaacacgctagtatttaacaaatgaacagcctgagagccgaggacacggcgtatattactgtgtagaaagatctccacgtctccgcccccttgactgttacttccgactcgtggggccacggaaaccctagtcgccgtctccctcacgccctccaccgacgggcccagtccggtccttcccccgtggccctacccctcctccgaaacgcgccaccctcggtacggggggggcaccgacggcccggtcccgtcggggcctcgccgtcggtaccgaaacgggtccttaccttccctaaagttaccggtaacttccggcgtcggacgggttccgggcgtcgggacgaagggcccggacagtgngng

SEQ ID NO: 406873 - DNA, 627 bp, Homo sapiens
  misc_feature: GZ8MTXP01B86SW.52.34.D01.1.454.CMB.2.raw
  modified_base (624)..(624): a, c, t, g, unknown or other
  modified_base (626)..(626): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccaggggaaggggctggagtgggtctcatttatcagtggtactggtggtagcacatactacgcagactccgtgaagggccgttcaccatctaccaaagacaattccaagaacacgctagtatttacaaatgaacagcctgagagccgagacacggctatatactgtgtagaaagatctcacgtctccgtccccttggacttggttactttccgacctcgtcggggaccacgggaaacccttagtcgcccgtctcctcacgccctccaaccgaacgggcccacgttccggtcccttcccccgtcggaccccaccccgtccctaccgaacgacgccaccgtcggtcggggggggcaacgacggcccggccgtcgggctcggccgttcggtaccaacggaccttacttaaccctaagttaccgacttccggtcgtggacggcggggccgtaagggccgaagggccggacgagtgngng

SEQ ID NO: 406874 - DNA, 605 bp, Homo sapiens
  misc_feature: GZ8MTXP01AKPNT.52.34.D01.1.454.CMB.2.raw
  modified_base (605)..(605): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattccaagaacacgctgtatttacaaatgaacagcctgagagccgaggacacggccgtatattactgtgtgaagatctccacgtctcgcccccttggactggttatttccgactcgtggggccacgggaaaccctaggtcgcccgtctcctcacgcctccaccaacgggcccactcggtccttccccctggccaccctcctcccaagacgccacctcgtcggggggggcacgagcccggcccgtggggcctcggcctcgggttccaaagggtcctaaccgtttccccgaacgttacgcgttcgtacgtcgaaggttcggccgttgggacccgaagggacccggacgactcgcgtn

SEQ ID NO: 406875 - DNA, 604 bp, Homo sapiens
  misc_feature: GZ8MTXP01EO80A.52.34.D01.1.454.CMB.2.raw
  modified_base (292)..(292): a, c, t, g, unknown or other
  modified_base (602)..(602): a, c, t, g, unknown or other
  modified_base (604)..(604): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattaccaaagaacacgctgtaatttaacaaatgaacagcngagagccgacggacacggccgtatattactgtgtagaaagatctccacgtctccgccccttgacttggttatttccgactcgtggggccaacggaaaccctagtcgccgtcctcctcacgccctcccacccaacgggcccacgtccggtcccttcccccgtggcccaccccttccctcccgaaacgacgccacctcggtcggggggggcaacgcggcccgggcccgtcgggctcgcccgtggtaccgaacgtacctcttaacctacttacggacttcgctggacggcgggctgggaccaaggcgacatgngn

SEQ ID NO: 406876 - DNA, 720 bp, Homo sapiens
  misc_feature: GZ8MTXP01BKT1E.52.34.D01.1.454.CMB.2.raw
tcagcgcagtacgacacgaccggtgctcgatttagatcgtctgtgttgggtttgggggaggcttggtaaaggcggggggggtatctgagactctcctgttcagtctctggattcaccttaaataactatggcatgagctgggtccgccaggctccgaggggaaggggctggagtgggtctctatttatcagtggtactggtggtagcacatactacgcagactccggtggaacgggccgttcaccatcctaccaaaagactaattaccaaagaacacgcttagtaatttaacaaatgaaacagcctagagacgaccggaggacgaccggacgtaatacttacgtgtagtagaaagtactccgtccctaccgttcctcccgtcccccgttggacgttggtttactttcccgaccttccggtcggggacccaacgggtaaaccctagtcgtcccgtctccctcacgtcccctaccgaacccgacggccctacgtcccgttccccttccccgtcgaccctacccctcctaccaacgtaccaccgtacccgtcggtacggggggcccaacggccggcccggtcccgtcggtccgtcgtcccgtcggtaaccgtaaacgtacccttacccgttaacccgtaacggttaccgtacggttcggtcgttacgggaccggttcgggttaccggtaacggaccggtaacggaccgtacgacgtcgccgtg

SEQ ID NO: 406877 - DNA, 588 bp, Homo sapiens
  misc_feature: GZ8MTXP01B64AG.52.34.D01.1.454.CMB.2.raw
  modified_base (451)..(451): a, c, t, g, unknown or other
  modified_base (587)..(588): a, c, t, g, unknown or other
tcagcgcagtacgacacgaccggtgctcgatttagatcgtctgtgttgggtttggggaggcttggtaaagcgggggggtatctgagactctcctgttcagtctctggattcaccttaaataactatggcatgagctgggtccgccaggctccagggaagggctggagtgggtctcatttatcagtggtactggtggtagcacatactacgcagactccgtgaaggccgttcaccatctccaaagacaattccaagaacacgcttgtatttacaaatgaacagcctgagagccgagacacggcgtatatactgtgtagaaagatctccacgtctccgcccccttgactggttatttccgactcgtggggccacgggaaaccctagtgcccgtctccctcacgcctccaaccgaacggcccatccggtccttccccctggacccaccccttcncccgaaaggcaccaccttcgcgggggggggcaccgacgccggcccgtcggggcctcggcccgttacgggtaccaagggtaccttcttcccgtaacgttcgacgttgctgagcgctggacaagggccagttagtcgnn

SEQ ID NO: 406878 - DNA, 572 bp, Homo sapiens
  misc_feature: GZ8MTXP01EBSDP.52.34.D01.1.454.CMB.2.raw
  modified_base (226)..(226): a, c, t, g, unknown or other
  modified_base (244)..(244): a, c, t, g, unknown or other
  modified_base (283)..(283): a, c, t, g, unknown or other
  modified_base (440)..(440): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacaggacggccaggatcacctgctctgganatgcattcgaccaaacgntatgcttatggtacagcagagcggcaggccctgtgtggnatagtataaagacactgagacgcctgagggtactcccgaggacgccggattcgtcgtacgcctaccgaggtcgagggaacaacgggtcacgtatcggaccagtcgaaggtggagtaccagggacaggaggacgaggctagaattattagtatataanacaaacaagacaactagttaggtacttagtcgtcgttaacggaacttcggaccgaacgtaaacggtccgaccgtttccggacgggtccaacggaaccccgaacggaccccaacccgtaacgttcgtaacccg

SEQ ID NO: 406879 - DNA, 682 bp, Homo sapiens
  misc_feature: GZ8MTXP01BOMII.52.34.D01.1.454.CMB.2.raw
  modified_base (289)..(289): a, c, t, g, unknown or other
  modified_base (672)..(672): a, c, t, g, unknown or other
  modified_base (681)..(681): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaaggggctgggagtgggtctcatttatcagtggtactggtggtagcacatactacgcagactccgtggaagggccgttcaccatcctaccaaagacaattccaaagaacacgctagtattaacaaagtnaacagcctagagacgacgaggacacggcgtatatactgtgagaaagatcctccaccgtctccgtccccttggacttggtttactttccgacctcgtggggaccacgggaaaccctagtcgcccgtcctcctcaccgccctaccgaacccgaccgggccctacgttcccgggttccccttcccccgtacggtaccccctaacccccgttcccaacccgaaacggccgccctacccgttccgggacggggggggaccaaccggcgggccccgggtcccgtggggccctacggtcccgtacggtaaccgaaacggtacccttaccgttaacccgtaacgttcgtacgttcgtacgtggacggttcgggcgtggaccgaacgggccngacgtcgcnc

SEQ ID NO: 406880 - DNA, 553 bp, Homo sapiens
  misc_feature: GZ8MTXP01BMYR2.52.34.D01.1.454.CMB.2.raw
  modified_base (448)..(448): a, c, t, g, unknown or other
  modified_base (519)..(519): a, c, t, g, unknown or other
  modified_base (540)..(540): a, c, t, g, unknown or other
  modified_base (542)..(542): a, c, t, g, unknown or other
  modified_base (544)..(544): a, c, t, g, unknown or other
  modified_base (548)..(550): a, c, t, g, unknown or other
  modified_base (552)..(553): a, c, t, g, unknown or other
tcagcgcagtacgacacgaccggtgctcgatttagatcgtctgtgttgggtttgggggaggcttggtaaagcgggggggtagtctgagactctcctgttcagtctctggattcaccttaaataactatggcatgagctgggtccgccaggctccgagggaaggggctggagtgggtctcatttatcagtggtactggtggtagcacatactacgcagactccgtgaagggccgttcaccatctccaaagacaattccaagaacacgctgtatttacaaatgaacagcctgagagcccgaggacacggccgtatattactgtgtgaaagatactccacgtctccgcccccttggactggttatttccgactcgtggggccagggaaaccctagcgccgtctcctcagcctcaccacgggcccatcggtcctcccctgaccacccttccnccaagacgctacctcgtcggggggggcacacgcggccccgtgggctcggcctggtaccagacctcttcctnttcgattcgctaggcgcgcgngngngcgnnngnn

SEQ ID NO: 406881 - DNA, 543 bp, Homo sapiens
  misc_feature: GZ8MTXP01DMKP3.52.34.D01.1.454.CMB.2.raw
  modified_base (456)..(456): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaaaccgatatgcttatggtacagcagagccggcaggccctgtgtggtgatgtaataaagacactgagaggccctagaggactcccgtgagcccgtattctcgtcggctacccgagggtcgaacgggaactaacgggtacacgtagttcgggacctagtcaaggtggacgtccgaggcgaggaggacgaggctagactattagtgtacaatacaaanagacactattgtactatgtcgtaagacttgacacgaaggtccacgttcagggtcacgtcccgaacggcccaaccctcgttcgtaacc

SEQ ID NO: 406882 - DNA, 654 bp, Homo sapiens
  misc_feature: GZ8MTXP01BERCH.52.34.D01.1.454.CMB.2.raw
  modified_base (206)..(206): a, c, t, g, unknown or other
  modified_base (340)..(340): a, c, t, g, unknown or other
  modified_base (485)..(485): a, c, t, g, unknown or other
  modified_base (652)..(652): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaaggggctgggagtgggtctctatttatcagtggtactggtggtancacatactacgcagactccgtggaacgggccgttcaccatctaccaaaagacaattccaaagaacacgtcttagtaattaacaaatgaacagcctagagagccgaggacacggctatattactgtgtagaaagntctccacgtcctccgtccccttggacttggtttacttcccgactcggtcgggacccgaacggaaaccccttagtcgcccgtcctccctccgaccgtccctacccgaaccgaaccgggccctacgtcccggttccccttcccccgnggccccctaaccccttcccaaccaaacggcacccgtaccgtcgggcggggggacaacgccggtcccggcccgtggacctcggtccctaggtaccaacggtccttacctccgtaagttcgtacgttcgcgtgacggttcggctcgggacgaacggccattacgtcgcncg

SEQ ID NO: 406883 - DNA, 593 bp, Homo sapiens
  misc_feature: GZ8MTXP01AOMKU.52.34.D01.1.454.CMB.2.raw
  modified_base (402)..(402): a, c, t, g, unknown or other
  modified_base (591)..(591): a, c, t, g, unknown or other
  modified_base (593)..(593): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcattttatcagtggtactggtggtagcacatactacgcagactccgtgaagggccgttcaccatctaccaaagacaattccaaagaacacgctagtatttacaaatgaacagctgagagcgaggacacggcctatattactgtgtagaaagatctccacgtctccgcccccttggactggtttatttccgactcgtggggccaggaacccttagcgccgtctccncacgcctccaccgaacgggcccatccggtccctccccgtggcccaccccgtcctaccaagcgcacccgtcgtgggggggcacgacggcccggcccgtgggctcggccgttggtccaaaggtccttaccttccgtaagttccgacgttcgctcggacggcggttcgtcgggacaacggcgacagtaacgngn

SEQ ID NO: 406884 - DNA, 599 bp, Homo sapiens
  misc_feature: GZ8MTXP01DYKLU.52.34.D01.1.454.CMB.2.raw
  modified_base (567)..(567): a, c, t, g, unknown or other
  modified_base (594)..(594): a, c, t, g, unknown or other
  modified_base (598)..(599): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattcccaagaacacgcttagtatttacaaatgaacagcctgagacgaccgaggacacggccgtatattactgtgtagaaagatcctccaccgttctcccgtccccttggacttggttactttccgacctccgtggggcccacgggaaacccctagtcgcccgtctccctcacgccctccaccgacgggcccacgtccggtcccttccccgtgcccacccctcctaccaagacgccacctcgtcggggggggcacgacgccggccgtggcttcgaccgtggtaccgaaggtacctacttcctattacgtattccgntggacggcgggctgggacaagggccanatgnn

SEQ ID NO: 406885 - DNA, 615 bp, Homo sapiens
  misc_feature: GZ8MTXP01BTAFW.52.34.D01.1.454.CMB.2.raw
  modified_base (306)..(306): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctcgtggagatgctattcgaccaaaccgtatatgtacttagtggtaccagacaggaacggcccgggccacggtccccttggtcgttggngatagtaaataaagacagtagagacggccctagacgggactccgagacgtctacttcgtcgtcggccttaccgaggtcgaagggtaaccgaacggtcacgtagttcggacctagtcgaggtggacgtaccgaggacgaaggaaggacgaggctagtaactttaagttacgttacgtactaaactacgaaacgtacgaacctacgtagtttggtaacttgttatcgttaacggacttcgaccgttacgaacggtccaccggttcttcgggtcaccgcccgtaacgcccttaacccctaagttcgtaaccc

SEQ ID NO: 406886 - DNA, 684 bp, Homo sapiens
  misc_feature: GZ8MTXP01AE93G.52.34.D01.1.454.CMB.2.raw
  modified_base (284)..(284): a, c, t, g, unknown or other
  modified_base (467)..(467): a, c, t, g, unknown or other
  modified_base (681)..(681): a, c, t, g, unknown or other
  modified_base (683)..(683): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaaggggctggagtgggtctcatttatcagtggtactggtgtagcacatactacgcagactccgtagaagggccgttcaccatctaccaaagacaattccaagacacgctgtattacaatgaacngctgagagccgaggacacggtcgtatattactgtgtagaagactctccacgtcctccgccccgttgtacttggttactttcccgactccggtcggggaccgaacgggtaaaccctaggtcgccgtcctcctcacgtccctaccaaccgaacggtccctacgttcccgggtccctttcccccgnggacccctacccctactacccaacgaccgccacccgttcgggacgggggggaccaaccggacggccccggggtccccgtgggggtccctaacgggtcccttacgggggtacctaaacgggtacccttacccgtttaacaacgtttacgacgttcggtccgggtcgggaccggttccggggttacgtaacggggacgaacgggcgtacgacgtgngng

SEQ ID NO: 406887 - DNA, 591 bp, Homo sapiens
  misc_feature: GZ8MTXP01A4XE1.52.34.D01.1.454.CMB.2.raw
  modified_base (187)..(187): a, c, t, g, unknown or other
  modified_base (449)..(449): a, c, t, g, unknown or other
  modified_base (589)..(589): a, c, t, g, unknown or other
  modified_base (591)..(591): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaaggggctgggagtgggtctcatttancagtggtactggtggtagcacatactacgcagactccgtgaagggccgttcaccatctaccaaagacaattccaagaacacgcttgtatttacaaatgaacagcctgagagccgaggacacggccgtatattactgtgtagaaagatctccacgtcctccgcccccttggacttggttacttccgactcgtggggccaggaaaccctagtcgccgtctcctcacgccctccaccaacggcccactccggtcccttcccccgnggcccacccctcctaccaacgacgccaccgtcgtcgggggggcacgacgccggcccgtggcctcgccgtggtaccgaacggtacctaccgttcctacttacgacttcgacctggacggcgggctgggcaacggcgcatgngn

SEQ ID NO: 406888 - DNA, 714 bp, Homo sapiens
  misc_feature: GZ8MTXP01C60WD.52.34.D01.1.454.CMB.2.raw
  modified_base (455)..(455): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaagggctggagtgggtctcatttatcagtggtactggtggtagcacatactacgcagactccgtgaaggccgttcaccatctaccaaagacaattccaagaacacgctgtattacaaatgaacagcctgagagccgagacacggcgtatattactgtgtagaaacgatctccacgtctccgcccccttggacttggttactttccgactcgtggggcccaaggggaaacccctgtaacgcccgtctccctcacgccctaccaacccgaaacgggcccctagtccggtccttcccccgnggccctaacccttccacccaaaggacgccaacccgttcgtcgggggggggggaccaaccgtacggccccgggcccccgttgggggaccttcggaccccgtttggggtacccgaaaacggggtaccccttaaaccgtttcccccttaaagttacccgggaaagtttccggcccgtttaggggaacggttcccgggggccccgtttaaggggaaccccgtaaaagggggtccccgggtaaacgttaacgtaacgttcgtcg

SEQ ID NO: 406889 - DNA, 840 bp, Homo sapiens
  misc_feature: GZ8MTXP01A23LR.52.34.D01.1.454.CMB.2.raw
  modified_base (331)..(331): a, c, t, g, unknown or other
  modified_base (839)..(839): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgagggaagggctggagtgggtctcatttatcagtggtactggtggtagcacatactacgcagactccgtgaaggccgttcaccatctaccaaagacaatacaagacacgcttagtaattacaaatgaacagcctagagagaccgaggacacggccgtatattacgtgtgtagaaagntctaccacgttcctccgtcccccgttggtacttcggtttactttccccgaccgtaccggtcgggggacccgaaccgggtaaacccctagtaaccggtccccgttaccgttccctaccgaccgtacccctacccgaaccccgaaacggggcccctacgttccccgggttacccctttcccccccggtaggtacccccctaaccccctttcccgaaaccccgaaacggacccgtaccccgtaaccccggttcccggggaccgggggggggggtaaccccaaccccggggaaccgggcccccgggggtaccccggttccggggggtcccgtttcccggggtaccccggtttacgggggttaaacccgaaaccggggtttaaccccgtttaaacccctttaacccggttaaacgttaacccgtaaccggtttcccgaccggtttaacgggacggggttcccggggttccgttaaggggacccgtaaaggggccccgtaagttacgtaagcgng

SEQ ID NO: 406890 - DNA, 684 bp, Homo sapiens
  misc_feature: GZ8MTXP01BG9MQ.52.34.D01.1.454.CMB.2.raw
  modified_base (187)..(187): a, c, t, g, unknown or other
  modified_base (296)..(296): a, c, t, g, unknown or other
  modified_base (681)..(681): a, c, t, g, unknown or other
  modified_base (683)..(683): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaaggggctgggagtgggtctcatttancagtggtactggtggtagcacatactacgcagactccggtggaacgggccgttcaccatctaccaaagacaattccaagacacgcttagtatttacaaatgaacagccngagacgccgaggacacggcgtatacttactgtgtagaaagatcctccacgtctccgcccccgttgactggtttactttccgaccttcgtggggacccacgggaaacccttagtaacgcccgttctccctacacgccctacccgaccgaacgggcccacgttccgggtccctttacccccgtcggacccctaccccttccctacccgaaagccgcctacccgttcgggacggggggggaccacgaccggcccgggtcccgtcgggtccttcggccccgtggttaacccgaaacggtccttaacccgttcctacgttaacgtacgttccgtcggtagcggcggggttcccgaaggggaccgaaacgggttccggaacgacgtaacgngng

SEQ ID NO: 406891 - DNA, 637 bp, Homo sapiens
  misc_feature: GZ8MTXP01CM5WM.52.34.D01.1.454.CMB.2.raw
  modified_base (320)..(320): a, c, t, g, unknown or other
  modified_base (331)..(331): a, c, t, g, unknown or other
  modified_base (405)..(405): a, c, t, g, unknown or other
  modified_base (636)..(636): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccgagggaaggggctggagtgggtctcatttatcagtggtactggtggtagcacatactacgcagactccgtgaacgggccgttcaccatctaccaaaagacaattccaaagaacacgctgtatttacaaatgaacagcctgagagccgagacacggccgtatattacngtgtagaaagntcctccacgttctccgccccttggacttggttactttcccgactccgtgggccaggaaaccctagtcgccgtcncctcacgccctacacccgaacgggcccacgtccggtccttcccccgtggccctacccctcctacccaacgcgaccaccgtcggtcgggggggccacgacggccgggccccgtggggccttcggccgtcgggtaaccgaacggtacccttacctttcccgtaacgttaccggacttccggacgtcggttacgggcgggaccgttcgggacgtaacgggcgtcgacgtaagcng

SEQ ID NO: 406892 - DNA, 632 bp, Homo sapiens
  misc_feature: GZ8MTXP01A75KD.52.34.D01.1.454.CMB.2.raw
  modified_base (338)..(338): a, c, t, g, unknown or other
  modified_base (626)..(626): a, c, t, g, unknown or other
  modified_base (631)..(632): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgagggaaggggctggagtgggtctcatttatcagtggtactggtggtagcacatactacgcagactccgtgaagggccgttcaccatctaccaaagacaattcccaagaacacgcttagtaatttaacaaatgaaacagcctagagacgccgaggacacggccgtatattactgtgtagaaagntctccacgtctccgccccttggcttggttattcccgactcgtcggggccacgggaaaccctagtcgccgtctcctcacgcctaccaccgaacgggcccacgtccggtcccttcccccgtggacccaccccttccctaccgaacgcgaccaccgtcggtcggggggggccaacgtcgggcccggtcccggtgggcccttcggcccgttagggtaaccgaaacggtccttaaccgttcctaacgttacgtacgttccgcgtggacggttcgggctgggacgaaggccganagtgnn

SEQ ID NO: 406893 - DNA, 571 bp, Homo sapiens
  misc_feature: GZ8MTXP01D42S0.52.34.D01.1.454.CMB.2.raw
  modified_base (396)..(396): a, c, t, g, unknown or other
  modified_base (458)..(458): a, c, t, g, unknown or other
  modified_base (569)..(569): a, c, t, g, unknown or other
  modified_base (571)..(571): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctaccaaagcaattccaagaacacgctgtattacaaatgaacagcctgagagccgagacacggccgtatattactgtgtgaagtatctccacgtctccgcccccttgactgttacttccgactcgtgggcccacggaaacccctagtcgccgtcncctcacgccctcaaccgacggcccatccggtccttccccgtgcccacccttccaccaagacncacctcgcggggggcacgacgccgccgtggctcgccgtggtactaacgggtcttaccgtcgtacaccgtagttccgcgtagcggttcggccgtggcgaacggcgacagtgngn

SEQ ID NO: 406894 - DNA, 564 bp, Homo sapiens
  misc_feature: GZ8MTXP01BDIVR.52.34.D01.1.454.CMB.2.raw
  modified_base (181)..(181): a, c, t, g, unknown or other
  modified_base (490)..(490): a, c, t, g, unknown or other
  modified_base (501)..(501): a, c, t, g, unknown or other
  modified_base (506)..(506): a, c, t, g, unknown or other
  modified_base (541)..(541): a, c, t, g, unknown or other
  modified_base (543)..(543): a, c, t, g, unknown or other
  modified_base (545)..(545): a, c, t, g, unknown or other
  modified_base (551)..(551): a, c, t, g, unknown or other
  modified_base (553)..(553): a, c, t, g, unknown or other
  modified_base (559)..(560): a, c, t, g, unknown or other
  modified_base (563)..(564): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctggtccgccaggctccagggaagggctggagtgggtctcatttancagtggtactggtggtagcacatactacgcagactccgtgaagggccgttcaccatctccaaaagacaattccaaagaacacgctgtatttacaaatgaacagcctgagagccgaggacacggccgtatatactgtgtgaaagatctccacgtctccgcccccttggactggttatttccgactcgtggggccacgggaaacccctagtcgcccgtctccctcagccctccaccaaacgggcccacgtccggtccttccccctggcccacccctcctccaagacgccacctcgtcggggggggcaacgngccggtcccgngggcncgacctggtcaaggactcttcctaattcattccgngngngcgcgngngcgcgnntgnn

SEQ ID NO: 406895 - DNA, 549 bp, Homo sapiens
  misc_feature: GZ8MTXP01A3G8M.52.34.D01.1.454.CMB.2.raw
  modified_base (549)..(549): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttccgactctggggccaggggaaacccctagtaacgccgtctcctcagcctccaccaagggcccatcggtcttcccctgcaccctcctccaagacgcacctctggggggggcacgacgcggccctgggctgccctggtccaaggactacttcctattacgattcgctgagcgggctggcaaggcgcatgn

SEQ ID NO: 406896 - DNA, 772 bp, Homo sapiens
  misc_feature: GZ8MTXP01CGZ6D.52.34.D01.1.454.CMB.2.raw
  modified_base (770)..(770): a, c, t, g, unknown or other
  modified_base (772)..(772): a, c, t, g, unknown or other
tcagcgcagtacgacacgaccggtgctcgatttagatcgtctgtgttgggtttgggggaggcttggtaaaggcgggggggggtatctgagactctcctgttcagtctctggattcaccttaaataactatggcatgagctgggtccgccaggctccgaggggaaggggctgggaggtgggtctctatttatcagtggtactgggtggtagcacatactacgcagactccgtaggaacgggtccgtcaccatcctaccaaagacaataccaaagaacacgcttagtaattaacaaatgaacagccagagacgccgaggacacggactatattactgtgagaaagatcctaccacgtctcccgtccccgttggtacgttggtttactttcccgaccgtcggtcggggacccgaaccgggtaaaccccgtaggtccgcccgttacctccctacaccgtcccctacccgaacccggtaacccgggccctaccgttcccggttccccttccccccgtcggtacccctacccccttccctaacccgaacggtaccgacccgtacccgttccggggaccgggggggggggcccaaccgggaccggggccccggggtccccggttacgggggtcccgtcgggttacccggttaccggggtaaccgtaaaccgggttacccctttaaccctttaacccgtaacgttaccggtacgttccgggacgttcggggaccgggttccggggacggtcgggaccgaacgggccgagttagtaagngn

SEQ ID NO: 406897 - DNA, 614 bp, Homo sapiens
  misc_feature: GZ8MTXP01ETL7D.52.34.D01.1.454.CMB.2.raw
  modified_base (226)..(226): a, c, t, g, unknown or other
  modified_base (246)..(246): a, c, t, g, unknown or other
  modified_base (293)..(293): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctcgtgganatgctattcgaccaaacgtntatgtacttagtgtaccagcagacgccggcacggccctggtgttggnagtagtaataagacagtgagacgtccctagaggactccgagacgtccgtactcgtcgtcgccctaccggaaggtcgaacgggaaccgtaacggtctacgtacgtcggaccctagtacgaggtcggaacgtccgaggacgagggacggacgacggtgtacgtaacttagtttatacgttacaaactacgaaacgacgtaacctacgttaagttccggttaattacgtacgttcgtaacggtaacttggaccgttaaccgtacggtccgaccgttcgttcgggtaaccaccgaaccgaacgccccacctaacgttcgtaaccc

SEQ ID NO: 406898 - DNA, 686 bp, Homo sapiens
  misc_feature: GZ8MTXP01EC08V.52.34.D01.1.454.CMB.2.raw
  modified_base (294)..(294): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccaggggaaggggctgggagtgggtctcatttatcagtggtactggtggtagcacatactacgcagactccgtgaacgggccgttcaccatctaccaaaagacaattccaaagaacacgctagtatttacaaatgaacagcngagagccgaggacacggccgtatattactgtgtagaaagatcctccacgtctccgtccccttgactgttactttccgactcgtcgggccacggaaaccctagtcgccgtctcccgtcacgccctaccgacccgaacgggccctacgttcccggtccttccccccgtggacccctaccccttccctacccaaagccgacctacccgtccgggtacggggggggggaccaaccgccggcccgggccccgtcgggggccttcggcccgttcgggtaccaaacgggttacccttacccgttaaccccggtaacggttacggtaccggttcgtccggtagggaaccggttcggttccgttaacgggaccgaacgggtacccagttacgtaacgctcg

SEQ ID NO: 406899 - DNA, 653 bp, Homo sapiens
  misc_feature: GZ8MTXP01B1MPF.52.34.D01.1.454.CMB.2.raw
  modified_base (495)..(495): a, c, t, g, unknown or other
  modified_base (653)..(653): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgagggaaggggctggagtgggtctcatttatcagtggtactggtggtagcacatactacgcagactccgtgaacgggccgttcaccatcctaccaaaagacaattccaaagaacacgtctagtatttaacaaatgaacagcctagagacgaccggaaggacgaccggccgtaatacttactgtgtagaaagactcctccaccgttcctcccgtcccccttggtacgttggttactttccccgaccttccggtggggacccgaacggggtaaaccccttagtccgtcccgtccttccctcacgccctccaaccgacggccctacgtccggtccttcccccgnggccccacccctcctaccgaagacgcctaccgtcggtcgggggggaccacggacggcccggcccggtcggctcgccgtcgtacgaacgtccttactccccgtaagttacgcgttcggtcgtggacgttcggttcgtcggacgaacggctgactcgctn

SEQ ID NO: 406900 - DNA, 451 bp, Homo sapiens
  misc_feature: GZ8MTXP01CKHPF.52.34.D01.1.454.CMB.2.raw
  modified_base (307)..(307): a, c, t, g, unknown or other
  modified_base (349)..(349): a, c, t, g, unknown or other
  modified_base (442)..(451): a, c, t, g, unknown or other
tcagcgcagtacgacacgaccggtgctcgatttagatcgtctgtgttgggtttgggattcacgttgcagatgtaggtctgggtgcccaagctgctgaagggccggttcaccatctccaaagacaattccaagaacacgctgtatttacaaatgaacagcctgagagccgaggacacggccgtatattactgtgtagaaagatctccacgtctccgccccttggactggttattcgactccgtggggccagggaaccctagtagccgtctcctcacgcctccaccacggcccagtcggtcctcccccnggcccacccctcctccaagacgccacctcggtgggggcacgnggcccggcccgtggggctcgcctggtacaacggcctacgttcctaataccgaactcgcgtgacggccgggcgtggacgaagggcgacagtagnnnnnnnnnn

SEQ ID NO: 406901 - DNA, 782 bp, Homo sapiens
  misc_feature: GZ8MTXP01DEVRS.52.34.D01.1.454.CMB.2.raw
  modified_base (189)..(189): a, c, t, g, unknown or other
  modified_base (758)..(758): a, c, t, g, unknown or other
  modified_base (781)..(781): a, c, t, g, unknown or other
tcagcgcagtacgacacgaccggtgctcgatttagatcgtctgtgttgggtttgggggaggcttggtaaaggcggggggggtatctgagactctcctgttcagtctctggattcaaccttaaataactatggcatgagctgggtccgccaggctccgaggggaaggggctggagtgggtctctatttancaggtggtactggtggtagcacatactacgcagacctccggaggaacgggccgttcaccatccacaaagacaacttaccaaagaaccacgtcttagttaatttaacaaatacgaacagcctagagacgaccgagacgaccggactaattattacgtgtagtaagaaagtactcctacctacccgttcctccccgttacccccgttaggtacctttggtttacctttaccccggaccgttccggtcggggacccgaacggggtaaaccccttaggtcccgtcccgttaccctccctacgacccgtccccgtacccgaacccgaaccgggtacccctacgttccccgggttccccttcccccggtaccggacccctacccccgtaccctacccgaaacgacccgaccgtaccccgttccgggtcggggggggaacccaaccgggccggccccgggacccggtcgggccgttccggccgttacggtaccgtaacgtacccttaaccctttaaccgtaacgttcgtacgttcgtacggttaggaccgggttcggttaccggtggggaacccgngggtacccagttaacggtcgcgng

SEQ ID NO: 406902 - DNA, 655 bp, Homo sapiens
  misc_feature: GZ8MTXP01AUI5A.52.34.D01.1.454.CMB.2.raw
  modified_base (654)..(654): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattcccaaagaacacgctgtaatttacaaatgaacagcctgagagccgaggacacggcgtatattactgtgtagaaagatctccacgtctccgcccccttgacttggtactttccgactcgtcggggccacgggaaccctagtcgccgtctcctcacgcctaccaccgaacggcccacgtcgtcccttcccccgtggaccccaccccgtccctacccaacgacgtccaccgtcggtcggggggggcacgacggcccggtccgtcggggctcggccttcgggtaccgaacgggtaaccttaccgtttaaccttaacgttaccggtaacgttccgggtcctgggaaccgggttccgggggcccgttgggggcccggaaaggggcccgaacgttaaacggtgcgng

SEQ ID NO: 406903 - DNA, 665 bp, Homo sapiens
  misc_feature: GZ8MTXP01D5WZE.52.34.D01.1.454.CMB.2.raw
  modified_base (329)..(329): a, c, t, g, unknown or other
  modified_base (662)..(662): a, c, t, g, unknown or other
  modified_base (664)..(664): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaaattccaaagaacacgctagtaattacaaatgaacagcctgagagccgaggacacggccgtatatactgtgtgaaantctccacgtctccgccccttggacttggttactttcccgaccttcgtcggggaccacgggaaaccctagtcgcccgtcctcctcgacgccctaccacccgaacgggccctagtcccggtcccttcccccgtcggaccctacccctcctacccgaacgacgcctacccgtccggtcggggggggaccaccgtaccggccccgggtccccgtcggggcccttcggacccgttcggggtaccgtaaacgggtacccttaaccgtttcccctaaagttaccgtacgttccgccgttggacgggccggggactcgggacgaacgggccgagagtaagngng

SEQ ID NO: 406904 - DNA, 686 bp, Homo sapiens
  misc_feature: GZ8MTXP01A8A5H.52.34.D01.1.454.CMB.2.raw
  modified_base (309)..(309): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacacgccaccctcggtgtcagtcgtccccaggacagacggccaggatcacctgctcgtggagatgctagttcgaccaaacgtatatgtacttattcggtaccagacaggaacggcccgggaccacggcccctggtggttggtnactagtaataaagctagtaggaggacggccctaggaggtctcccgtggacgtccgtactttcgtcgtcggtaccgtaacccgaacgggtaacggaacggggaaccctaacgggtacctaacgtacggtttcgggaccctagtacgtaacgggtacggtacgtacccggaaggtaccggaagggaacgggacggacgggtcttaggtaaccttaagtttagttacgtaactaaagtaccaaacgacgacctaacgttaagttcgtaactttgtacgttcgtaacggtaacttggacccgttaacgtacgggtccaccggttcggttaccgggtaaccaccggtaaccccgacggaccccaacctcgttaaccgtaacc

SEQ ID NO: 406905 - DNA, 783 bp, Homo sapiens
  misc_feature: GZ8MTXP01DZWZE.52.34.D01.1.454.CMB.2.raw
  modified_base (223)..(223): a, c, t, g, unknown or other
  modified_base (243)..(243): a, c, t, g, unknown or other
  modified_base (303)..(303): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgagcctcctatgagctgacacagccaccctggtgtcagtcgtcccaggacagacgccaggatcacctgctcgtgganatgctattcgaccaaacgtntatgtacttagtcggtaccagcaggaacgccgggaccacggccccgttgtcggttggtanacgtagtaaataaacgactaagtacggaagacgggtccctacgaacgggtacctcccggtacggacggtacccgtaacttccgttcgtcggtacccgtaacccgggtaacgggtccgggaaacggggtaaacccgtaaacccggggttaccaaacgttacgggtaccgggtacccgtaaacgtaccgtaaggggttacgggaacgttacccggaagggaaccgtaacggggaaacgggaccgggtaagggacgttaacgggtaaactttaagttttaacgttaggttaaacctaaagttaacccgtaaaacgacgtaaaccctaaccgttaaagttttacggttaactttacgttacgtccggtttaaacgaaccgttacggaccgaaacccgtaacggtcccgttaacccggttcgttaccgggttaaccaacggtaaccccgaaacgtacccccgaacccctaacgttccgttaaccc

SEQ ID NO: 406906 - DNA, 707 bp, Homo sapiens
  misc_feature: GZ8MTXP01BWYR8.52.34.D01.1.454.CMB.2.raw
  modified_base (186)..(186): a, c, t, g, unknown or other
  modified_base (205)..(205): a, c, t, g, unknown or other
  modified_base (705)..(705): a, c, t, g, unknown or other
  modified_base (707)..(707): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccgaggggaaggggctgggagtgggtctcatttancaggtggtactggtggtancacatactacgcagacctccgtaggaacgggtccgttcaccatctaccaaagacaattccaaagacacgcttagtatttaacaaatgaacagcctagagacgccgagacacggctatattactgtagtagaaagtactcctacccgacgttcctaccccgtcccccgtttaggtaccttaggttttaccgtttccccgaccgttccggtacgggggacccctaacggggtaaaaccccttaggtaaccgtcccgttccctaccctccgacgtcccctacccgaaaccgaaccgggtccctacgttcccgtcccttcccccgtcggacccctacccctccctaccgaacgtacgaccaccgtcggtcgggggggaccaacggccggcccggcccgtgggccgtcgtccgtcgtacgtaacggtaccttaccgtctaacgttacgtacttcgaccgtggaccgggttcgggcgtaacgggacgtaacgggccgacgagtcgngn

SEQ ID NO: 406907 - DNA, 710 bp, Homo sapiens
  misc_feature: GZ8MTXP01EK4CZ.52.34.D01.1.454.CMB.2.raw
  modified_base (707)..(707): a, c, t, g, unknown or other
  modified_base (709)..(709): a, c, t, g, unknown or other
tcagcgcagtacgacacgaccggtgctcgatttagatcgtctgtgttgggtttgggggaggcttggtaaagcgggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaaagaacacgctagtatttacaaatgaacagcctgagagccgaggacacggccgtatattactgtgtagaaagatcctccacgtctccgccccttgactgttacttccgactcgtgggccagggaaaccctagtcgccgtctcctcacgccctccacccgaacgggccctacgtccggtccttccccccgtggcccctaccccttccctacccgaaacgacgacccgtaacccgtccggtcgggggggggggaccaaccggaacgggccccgggccccgttcggggccttcggtcccgtttcggggtaccgaaacggggttaacccttaacccgtttaaccccgttaaacgtttaaaccggaacgtttccggccgtttacgggaacggggttcccgggggaccgttaacgggggaccgaaaacgggggcccggtaccaagttaacgggngng

SEQ ID NO: 406908 - DNA, 716 bp, Homo sapiens
  misc_feature: GZ8MTXP01CR5E9.52.34.D01.1.454.CMB.2.raw
  modified_base (184)..(184): a, c, t, g, unknown or other
  modified_base (700)..(700): a, c, t, g, unknown or other
  modified_base (714)..(714): a, c, t, g, unknown or other
tcagcgcagtacgacacgaccggtgctcgatttagatcgtctgtgttgggtttgggggaggcttggtaaagcggggggggtatctgagactctcctgttcagtctctggattcaaccttaaataactatggcatgagctgggtccgccaggctcgagggaagggctggagtgggtctcatttancagtggtactgggtggtagcaacatactacgcaagacctccgtaggaacgggtccgttacaccatctaccaaagactaatccaaagacacgctagtaattacaaatgaacagctagagacgcgaggacacggtactatatactgtagagaaatctcctacgtaccgtcctcccgtcccgttagacttggtttactttcccccggacgtccggtcggggaacccgtacgggaaaaccccttagtccgcccgttcctccctacgaccgtcccctaaccgaacccgtaccgggaccctacgttcccggtcccttacccccgtcgacccctacccccttcgaacccgaacgaccgtccctaaccgtccgggtacggggggacccaacgccgggcccgggtcccgtcgggccgtccgtcccggtggtaccgtaaacggtaccttacccgttaaccgtaacggttacgtaccgttcgtcggtcgggaacggttcggttccgtaacggaccgaacgggacccngttacgtcgttccncg

SEQ ID NO: 406909 - DNA, 666 bp, Homo sapiens
  misc_feature: GZ8MTXP01AP720.52.34.D01.1.454.CMB.2.raw
  modified_base (181)..(181): a, c, t, g, unknown or other
  modified_base (224)..(224): a, c, t, g, unknown or other
  modified_base (243)..(243): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctggtntcagtcgtccccaggacagacgccaggatcactgctcgtgganatgctattcgaccaaacgntatgtacttagtggtacagcagaacgccggcacggccctgtagtgtgatagtaataagcagtggagacgccctagacggtactccgtgacgtccgtacttcgtcgtacggccttaaccgaggtcgaacgggacctaaacgggctaactagttcgacctagtacgaaggtcggacgaccgaggacgaagggaacgggaccgaggtaccgtaggtaacctttagttaagttcggtaaccttaaacgtacccaaacgtaaccgacctaaaccgttagttttaccgggttaaactttacgttcggttaccgttaacggaaacgttcggaccgttaaccgtaacggtcccgttaaccggttccgttacgggtaaccacccggtaaccccgaaaccggaccccttaaaccccgtcgttccgtaaccccg

SEQ ID NO: 406910 - DNA, 643 bp, Homo sapiens
  misc_feature: GZ8MTXP01EZ724.52.34.D01.1.454.CMB.2.raw
  modified_base (227)..(227): a, c, t, g, unknown or other
  modified_base (288)..(288): a, c, t, g, unknown or other
  modified_base (297)..(297): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgcattcgaccaaacgatatgcttatcggtaccagcagacgccggcacggccctgtgtgnatgtataanacacgtgacgacggccctagagggactcccgtgacgtccgtacttcgtcgttacggcctacccgtagggtcgaacggggaacctaacgggtcacgtacgttcgggccctaagtcgaggtggacgtacccgagggaccgagggaacggacggaggtactaggtaactttatttaggtttcgaactaaagttaccaaacaacgacctaaccttaagtttaccgttaagtttacgtcgttaccgttaacggtaacgttaggacccgttaaaccgacggttacccacccgttccggttcgggtaaccacccggaacccgtacgggacccccacccgtaacgttcgtcccc

SEQ ID NO: 406911 - DNA, 668 bp, Homo sapiens
  misc_feature: GZ8MTXP01A0MQK.52.34.D01.1.454.CMB.2.raw
  modified_base (185)..(185): a, c, t, g, unknown or other
  modified_base (203)..(203): a, c, t, g, unknown or other
  modified_base (268)..(268): a, c, t, g, unknown or other
  modified_base (665)..(665): a, c, t, g, unknown or other
  modified_base (667)..(667): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaagggctggagtgggtctcatttancagtggtactggtggtancacatactacgcagacctccgtgaagggtccgttcaccatctaccaaagacaattccaaagaacncgcttagtattacaaatgaacagcctgagacgcgaggacacggcgtatattactgtgtagaaagactcctccaccgttcctccgtccccgttgacgttgtttacttccgacctcgtcggggaccacgggaaacccttagtcgtcccgtctccctcacgcccctacgaacccgaacgggcccacttccggttacccttcccccgtgacccctacccctccctacccgaacgaccgaccctaccgtccggtacggggggggcctaacgaccggcccgggtcccgtcgggccgttccgccgtacggtaccgtaaacggtaccttacttaaccgtagttaccggtacttccggtacgtggaccgggccggttacgtcgggacgaacggccgacgaacgtgngng

SEQ ID NO: 406912 - DNA, 680 bp, Homo sapiens
  misc_feature: GZ8MTXP01BOZSP.52.34.D01.1.454.CMB.2.raw
  modified_base (185)..(185): a, c, t, g, unknown or other
  modified_base (297)..(297): a, c, t, g, unknown or other
  modified_base (678)..(678): a, c, t, g, unknown or other
  modified_base (680)..(680): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgagggaaggggctggagtgggtctcatttancagtggtactggtggtagcacatactacgcagactccgtgaagggtccgttcaccatctaccaaagacaattccaaagaacacgcttagtatttacaaatgaacagctgagngccgagcacggcgtatattactgtagtagaaagtatcctacctacgtctccgtcccccttggacttggttactttccgacctcggtcggggacccgacgggaaaaccccttggtcgcccgttacctccctaccacgcccctaccacccgaacggggcccctacgttcccggttcccttcccccgtcggacccctacccccttcccacccgaacgaccgcccgaacccgtccgggtacgggggggggccctacggacgggcccgggtcccgtggggcctccggtcccggtcggtaaccgaaccggtacttacccttaaccgttaacgttaccggtacgttcgccgtgggacgggcgggccgtgggacgaacggcgcacgtgngn

SEQ ID NO: 406913 - DNA, 700 bp, Homo sapiens
  misc_feature: GZ8MTXP01DLQOF.52.34.D01.1.454.CMB.2.raw
  modified_base (204)..(204): a, c, t, g, unknown or other
  modified_base (420)..(420): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaagggctgggagtgggtctcatttatcagtggtactggtggtancacatactacgcagacctccgtaggaacgggtccgttcaccctatcctaccaaagacaattaccaaagaacacgcttagtatttacaaatgaaacacgcctagagagaccgaggacacggccgtataatctgtgtagaaagtctcctccacgttctccgtcccccttgtactggttactttcccgactcgtggggaccacgggaaaccctaggtcnccgtctccctcaccgccctaccgacccgaacgggccctacgttcccggtcccttcccccgtaggcccctaacccctccgtaaccgaacgacgcccgtaccgttccgggaggggggggcccaacgggcgggcccggtcccgtgggcctacggtccccgttggtaaccgaaccggtaccttaccccgttccccggtaaacgttggtccggttacgtcggtcgggaaacggttcggttaccgtaacggaaccgtaacggggttacacggttacgtccgcgtcg

SEQ ID NO: 406914 - DNA, 639 bp, Homo sapiens
  misc_feature: GZ8MTXP01AWKRI.52.34.D01.1.454.CMB.2.raw
  modified_base (186)..(186): a, c, t, g, unknown or other
  modified_base (391)..(391): a, c, t, g, unknown or other
  modified_base (637)..(637): a, c, t, g, unknown or other
  modified_base (639)..(639): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaaggggctggagtgggtctcatttancagtggtactggtggtagcacatactacgcagactccgtgaacgggtccgttcaccatctaccaaaagcaattccaagaacacgctagtattaacaaatgaacagcctagagacgccgaaggaccacggtaccgtatattactgtgtagaaagtactcctccacgtcctcccgtcccccttggacttggttactttccgactcgnggggccacgggaaacctgtaacgccgtctcctcacgcgccctaccgaccgaccgacctcggttcccgttcccctcccgtaccgacccctcccctacccgaacgaacgcacccgtacgtcggggggcgaaccgcgcccgggccccgtccggtcggaccgtcccgtacggtcgtaaccgtacgtaccctttaacctaccgttaacgcgacgtccgtaggcggttcggcgtgcgaagacggcttagcgngn

SEQ ID NO: 406915 - DNA, 642 bp, Homo sapiens
  misc_feature: GZ8MTXP01A2HYV.52.34.D01.1.454.CMB.2.raw
  modified_base (338)..(338): a, c, t, g, unknown or other
  modified_base (450)..(450): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgagggaagggctggagtgggtctcatttatcagtggtactgggtggtagcacatactacgcagactccgtgaagggccgttcaccatctaccaaaagactaattacccaaagaaccacgtctagtatttaacaaatgaaacagcctagagagacgaggacacggcgtatatactgtgagaaagntctccacgtctccgtccccttgacttgttacttccgactcgcgggccacgggtaaccctagcgcctctcctcacgtcctccaaccgacggccctagtccgtccttcccccgngccctaccctcctaccaacgaccgcctaccgtcggacggggggggacaccgtacggcccggtcccgtcgggccgtacggtcccgttcgggtaccgaacggtacccttaccgttaacctaacgttacgtacgttcggtacgtggacgggttcggttcgtcgggaccgtaacgggcctacgttacgtcggctcg

SEQ ID NO: 406916 - DNA, 877 bp, Homo sapiens
  misc_feature: GZ8MTXP01C5QPC.52.34.D01.1.454.CMB.2.raw
  modified_base (228)..(228): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctcgtgganatgcattgaccaaaccgtatatgtacttagttcggtaaccagacaaggaaacggcccggggacccgaacgggtcccccgtggttggtttgggtacgtagttaggtaaagtaaaacgaccgtaaccgtaggaacggacgggtcccctacggaacggggtacttcccccgtaggaacgtccggtaacgtttcgtccgtacgggcccgtaaccccggtaaggggttaacccggaaacgggggtaaacccgaaaaccgggggttacccaaaccgttaacggtttaccggggacccctaagttacccgaaacgggttacggggaacgttacccggaaacggggaaccgtaaagggggaacggggtaacgggaacgggtaccgtaagggttaaaccctttaaagtttacggtttacgggttaaacctaaaagtttaccgaaaaccgaacggtaaaccctaacccgttaaagttttacggttaaaccgttttacgttacggtttacccgttaacccggggtaaaccttcgggaacccgaaccgttaaaccggggtcccttaccccgggttccgggttaccggggttaacccgacccgggtaaccccgaaaacggggtaccccccttaaaacccccgtaaccgttcgttaacccccg

SEQ ID NO: 406917 - DNA, 537 bp, Homo sapiens
  misc_feature: GZ8MTXP02JJDJS.52.34.D01.1.454.CMB.2.raw
  modified_base (536)..(537): a, c, t, g, unknown or other
tcagcgcagtacgacacgaccggtgctcgatttagatcgtctgtgttgggtttggggaggcttggtaaagcgggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttatttccgactcctggggccaggggaaccctagtgccgtctcctcagcctccaccaagggcccatcggtcttccccctcggcaccctcctccaagacgcacctctgggggcacagccggccctgggctgccctggtcaaggctactcctatacgactcgctgacgcggctgcaagcgcatacgnn

SEQ ID NO: 406918 - DNA, 511 bp, Homo sapiens
  misc_feature: GZ8MTXP02IXLLK.52.34.D01.1.454.CMB.2.raw
  modified_base (313)..(313): a, c, t, g, unknown or other
  modified_base (334)..(334): a, c, t, g, unknown or other
tcagcgcagtacgacacgaccggtgctcgatttagatcgtctgtgttgggtttggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtataaagacactgagaggccctnagggatccctgagccgattcnctggctccagtcagggacaacggtcacatgccatcagtgagtcagcagaggacgagctgactattattgtcaatcaaacagacacattggtacttatgtacttcggaaactgcgaaccaaaggttcaaccgtccttaggggcacgcccaaacggcccaaacccccaactcgtaaccc

SEQ ID NO: 406919 - DNA, 528 bp, Homo sapiens
  misc_feature: GZ8MTXP02INGJE.52.34.D01.1.454.CMB.2.raw
  modified_base (439)..(439): a, c, t, g, unknown or other
  modified_base (527)..(528): a, c, t, g, unknown or other
tcagcgcagtacgacacgaccggtgctcgatttagatcgtctgtgttgggtttggggaggcttggtaaagcgggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttgactggttatttccgactcctggggccagggaacccctagtgccgtctcctcagcctccaccaaggcccatcgtctcccctgcaccctctccaanagcacctctggggcacagcggcccctgggctgccctggtcaaggctacttccataccgatcgctgacgcggctggcaaggcgcatagnn

SEQ ID NO: 406920 - DNA, 530 bp, Homo sapiens
  misc_feature: GZ8MTXP02ICYQR.52.34.D01.1.454.CMB.2.raw
  modified_base (421)..(421): a, c, t, g, unknown or other
  modified_base (514)..(514): a, c, t, g, unknown or other
  modified_base (529)..(530): a, c, t, g, unknown or other
tcagcgcagtacgacacgaccggtgctcgatttagatcgtctgtgttgggtttgggggaggcttggtaaagcggggggtatctgagactctcctgttcagtctctggattcaccttaaataactatggcatgagctgggtccgccaggctccagggaagggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccagtctcgcccccttgactggtattccgactccgtgggccagggaaccctagtgccgtctcctcagcctccaccaggcccatcgtctccccngcaccctctccaagcgcacctcgtgggggcacagccggccctgggctgccgtggtacaaggactacgttcctatacgatcgctgacgcggtcnggcaaggcgcatagnn

SEQ ID NO: 406921 - DNA, 539 bp, Homo sapiens
  misc_feature: GZ8MTXP02HG1R8.52.34.D01.1.454.CMB.2.raw
  modified_base (522)..(522): a, c, t, g, unknown or other
  modified_base (535)..(535): a, c, t, g, unknown or other
  modified_base (538)..(539): a, c, t, g, unknown or other
tcagcgcagtacgacacgaccggtgctcgatttagatcgtctgtgttgggtttgggggaggcttggtaaagcggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctcaaagacaattccaagacacgctgtatttacaaatgaacagcctgagagccgaggacacggccgtatattactgtgtgaaagatctccacgtctcgcccccttgactggttattccgactcctggggccagggaaccctagtcgccgtctcctcagcctccaccaacgggcccactccggtccttccccctcggccacccctcctccaagcgcacctcgtcgggggcacgacgccggccctgggctgcctgcaggactactcatacgatcgctgacgcggcnggcaacggcgcanagnn

SEQ ID NO: 406922 - DNA, 554 bp, Homo sapiens
  misc_feature: GZ8MTXP02GYPTE.52.34.D01.1.454.CMB.2.raw
  modified_base (553)..(554): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttattccgactcctggggcagggaccctagtcgccgtctcctcacgcctccaccaacgggcccatccggtccttccccctggccaccctcctccaagacgcacctcgtcgggggcacgacgccggcccgtggctgcccgtgtcaaggactacttcctataccgctcgcgtcgacgcggcgtggcgacgacgacgacagnn

SEQ ID NO: 406923 - DNA, 539 bp, Homo sapiens
  misc_feature: GZ8MTXP02H1R7R.52.34.D01.1.454.CMB.2.raw
  modified_base (444)..(444): a, c, t, g, unknown or other
  modified_base (532)..(532): a, c, t, g, unknown or other
  modified_base (538)..(539): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaaggccggttcaccatctccaaagacaattccaagaacacgctgtatttacaaatgaacagcctgagagccgaggacacggccgtatattactgtgtgaaagatctccacgtctcgcccccttgactggttatttccgactcctgggccaggaccctagtgccgtctcctcagcctccaccaacggcccatcggtcctccccctgccacccctctccaagngccacctcgtgggggcacagcggcccctgggctgccctggtcaaggactacttccatacgactcgactgacgcggctgggcaaaggcncatcgnn

SEQ ID NO: 406924 - DNA, 529 bp, Homo sapiens
  misc_feature: GZ8MTXP02GO5UV.52.34.D01.1.454.CMB.2.raw
  modified_base (528)..(529): a, c, t, g, unknown or other
tcagcgcagtacgacacgaccggtgctcgatttagatcgtctgtgttgggtttgggggaggcttggtaaagcggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaaagaacacgctgtatttacaaatgaacagcctgagagccgaggacacggccgtatattactgtgtgaaagatctccacgtctcgcccccttggactggttattcgactcctggggccagggaccctagtcgccgtctcctcagcctccaccaaggcccatcgtctcccctgcaccctctccaagacgcacctctgggggcacagcggccctgggctgcctggtcaagctactccatacgactcgctgacgcggctgcaaggcgcacgtacgnn

SEQ ID NO: 406925 - DNA, 546 bp, Homo sapiens
  misc_feature: GZ8MTXP02GKE5L.52.34.D01.1.454.CMB.2.raw
  modified_base (545)..(546): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttattccgactcctggggccaggaccctagtgccgtctcctcagcctccaccaacggcccatcggtcctccccctgccaccctcctccaacgacgcacctctcgggggcacgacgccggcccgtgggctcgccgtggtcaaggctacttcctatacgactcgctcgacgcgggctggcaaggcgcgatagnn

SEQ ID NO: 406926 - DNA, 540 bp, Homo sapiens
  misc_feature: GZ8MTXP02HR75K.52.34.D01.1.454.CMB.2.raw
  modified_base (523)..(523): a, c, t, g, unknown or other
  modified_base (537)..(537): a, c, t, g, unknown or other
  modified_base (539)..(540): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaaagaacacgctgtattacaaatgaacagcctgagagccgaggacacggccgtatattactgtgtgaaagatctccacgtctcgcccccttggactggttatttccgactccgtggggccagggaacccctagtcgccgtctcctcagccctcaccaggccatcgtctcccctgcaccctcctcaagacgcacctcgtcgggggcacgagccggcccgtgggctgcctggtcaaggactacttcctatacgactcgctgacgcgggntggcaacggcgcanann

SEQ ID NO: 406927 - DNA, 549 bp, Homo sapiens
  misc_feature: GZ8MTXP02G0Z3C.52.34.D01.1.454.CMB.2.raw
  modified_base (430)..(430): a, c, t, g, unknown or other
  modified_base (548)..(549): a, c, t, g, unknown or other
tcagcgcagtacgacacgaccggtgctcgatttagatcgtctgtgttgggtttgggggaggcttggtaaagcggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattccaagaacacgctgtatttacaaatgaacagcctgagagccgaggacacggccgtatattactgtgtgaaagatctccacgtctcgccccctgactggttattccgactccgtggggccagggaaccctagtcgccgtctcctcagcctccaccaacgggcccatcggtcttcccccnggccaccctcctccaagacgccacctcgtgggggcacgacgccggccctgggctcggcctggtcaaggactacgttcctatacgactcgctcgacgcggctggcaacggcgcagtagnn

SEQ ID NO: 406928 - DNA, 540 bp, Homo sapiens
  misc_feature: GZ8MTXP02F78QF.52.34.D01.1.454.CMB.2.raw
  modified_base (534)..(534): a, c, t, g, unknown or other
  modified_base (536)..(536): a, c, t, g, unknown or other
  modified_base (539)..(540): a, c, t, g, unknown or other
tcagcgcagtacgacacgaccggtgctcgatttagatcgtctgtgttgggtttgggggaggcttggtaaagcggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaagacacgctgtatttaacaaatgaacagcctgagagccgaggacacggccgtatattactgtgtgaaagatctccacgtctcgcccccttgactggttattccgactccgtgggccaggaccctgtcgccgtctcctcagcctccaccaaggcccatcgtcctcccctgccacctcctccaagacgcacctcgtcggggcacacgccggccctcgggctgccgtggtcaaggacctacttcctagtacgacgtcgctgacgcggctggacaaggccanancgnn

SEQ ID NO: 406929 - DNA, 540 bp, Homo sapiens
  misc_feature: GZ8MTXP02F18IV.52.34.D01.1.454.CMB.2.raw
  modified_base (539)..(540): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagacacgctgtatttacaaatgaacagcctgagagccgaggacacggccgtatatactgtgtgaaagatctccacgtctcgcccccttgactggttattccgactccgtggggccagggaaccctagtacgccgtctcctcacgcctccacaaggcccatcggtcttccccctgcaccctctccagacgcacctcgtggggcacgagcggccctgggctcgccgtggtcaaggactacttccatacgacttcgctgacgcgggctggcaacggcgacagagnn

SEQ ID NO: 406930 - DNA, 556 bp, Homo sapiens
  misc_feature: GZ8MTXP02IX80L.52.34.D01.1.454.CMB.2.raw
  modified_base (550)..(550): a, c, t, g, unknown or other
  modified_base (553)..(553): a, c, t, g, unknown or other
  modified_base (555)..(556): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtattacaaatgaacagcctgagagccgaggacacggccgtatattactgtgtgaaaagatctccacgtctccgcccccttggacctggttatttccgactccgtggggccaggacccctagtcgccgtctcctcacgccctccaccaacgggcccatccggtccttcccccgtggccacccctcctccaacgacgcacctcgtgggggccacacgcggccctgggcctgcctggtcaaggactacttccatacgactcgctcgacgcggctgcaaggccganacngnn

SEQ ID NO: 406931 - DNA, 580 bp, Homo sapiens
  misc_feature: GZ8MTXP02H6YKR.52.34.D01.1.454.CMB.2.raw
  modified_base (238)..(238): a, c, t, g, unknown or other
  modified_base (284)..(284): a, c, t, g, unknown or other
tcagcgcagtacgacacgaccggtgctcgatttagatcgtctgtgttgggtttggggctgtgggtccaggaggcagaactctgggtgtctcaccatggcctggatccctctacttctcccctcctcactctctgcacaggctctgaggcctcctatgagctgacacagccaccctcggtgtcagtgtcccaggacagacggccaggatcacctgctctggagatgcattgccaaacgntatgcttattggtaccagcagaagccggccaggcccctgtgttggngatgtataaagacactgagacggcctcagggactccctgagccgattcctctggctccaggtcaaggggacaaacgggtcactattggcccatacgagttgggagtcccgaggcaggaggacgagggctaggactaagtttattagtacaaatcaaacgacgacaaccgtattggttacttagtcgttactttacgggaaacttcggacgtaaacccgaaaggttcccgaacccgttccgtcggggttaaccaccgggacccaaacgggaccccaaacccccgtactccggtaccc

SEQ ID NO: 406932 - DNA, 570 bp, Homo sapiens
  misc_feature: GZ8MTXP02GLYYI.52.34.D01.1.454.CMB.2.raw
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattccaagaacacgctgtatttacaaatgaacagcctgagagccgaggacacggccgtatattactgtgtagaaagatctccacgtctcgcccccttgactggttattccgactccgtggggccagggaaccctagtcgccgtctcctcacgccctccaccaaacgggcccacgtccggtccttccccctcggccacccctcctaccaacgacgccacctcgtcgggggcacgcgccggccctcgggctcgcctggtcaaggctactcccgacgtcgacgtgcgtgacgtcggtctcggacacggactcgacgtcgctcg

SEQ ID NO: 406933 - DNA, 576 bp, Homo sapiens
  misc_feature: GZ8MTXP02GHP3W.52.34.D01.1.454.CMB.2.raw
  modified_base (575)..(576): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctgggagtgggtctcatttatcagtggtactggtggtagcacatactacgcagactccgtgaagggccgttcaccatctaccaaagacaattccaagaacacgctgtatttacaaatgaacagcctgagagccgaggacacggccgtatattactgtgtagaaagatctccacgtcctccgcccccttgactggttacttccgactccgtggggccagggaaccctagtcgccgtctcctcacgcctccaccaacggcccactccggtccttccccctcgcccacccctccctaccaacgacgccacccgtcgtcgggggccacgacgccggcccgtcgggctcgccgtggtcaacggtactaccttactacgtacgactcgctgacgcggctggcgaacggcgacagcgnn

SEQ ID NO: 406934 - DNA, 571 bp, Homo sapiens
  misc_feature: GZ8MTXP02HUKMO.52.34.D01.1.454.CMB.2.raw
  modified_base (322)..(322): a, c, t, g, unknown or other
  modified_base (340)..(340): a, c, t, g, unknown or other
  modified_base (461)..(461): a, c, t, g, unknown or other
  modified_base (570)..(570): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaaagaacacgctgtatttacaaatgaacagcctgagagccgaggacacggccgtatattactgtgngaaaagatctccacgtcncgcccccttgactggttattccgactccgtgggccagggacccctagtcgccgtctccgtccacgccctccaaccaacggcccactcggtccttcccctcgccacccctcctccaacgacncatctcgtcgggcacgcggccgccgtcggctcgcgtgtacgaacgtacttacttacctactacgactccgcgtacgcggcggcgtcggacgacggccgtacgacgacgng

SEQ ID NO: 406935 - DNA, 621 bp, Homo sapiens
  misc_feature: GZ8MTXP02HOX8S.52.34.D01.1.454.CMB.2.raw
  modified_base (324)..(324): a, c, t, g, unknown or other
  modified_base (620)..(620): a, c, t, g, unknown or other
tcagcgcagtacgacacgaccggtgctcgatttagatcgtctgtgttgggtttgggggaggcttggtaaagcggggggtatctgagactctcctgttcagtctctggattcaccttaaataactatggcatgagctgggtccgccaggctccagggaaggggctggagtgggtctcatttatcagtggtactggtggtagcacatactacgcagactccgtgaaggccggttcaccatctccaaagacaattccaagaacacgctgtattacaaatgaacagcctgagagccgaggacacggccgtatattactgtgtgaaagntctccacgtctcgccccttgactgttattccgactctggggccaggaccctagtcgccgtctcctcagccctccaccaacggcccatcgtccttccccctgaccaccctcctcccaagacgccacccgtcgtcgggggccacgacggccggccccgtggggcctcggcccgtcgggtaccaaacgggaccttaacctttaccccttaagttacccggaacgtttccggaccgttcgggaacggtcccgggggcgttcggggaccgaaaacggggccggaccaaacgttacggacgng

SEQ ID NO: 406936 - DNA, 525 bp, Homo sapiens
  misc_feature: GZ8MTXP02JBBJI.52.34.D01.1.454.CMB.2.raw
  modified_base (377)..(377): a, c, t, g, unknown or other
  modified_base (484)..(484): a, c, t, g, unknown or other
  modified_base (488)..(488): a, c, t, g, unknown or other
  modified_base (500)..(500): a, c, t, g, unknown or other
  modified_base (524)..(524): a, c, t, g, unknown or other
tcagcgcagtacgacacgaccggtgctcgatttagatcgtctgtgttgggtttggggaggcttggtaaagcggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctcaaagcaattccaagaacacgctgtatttacaaatgaacagcctgagagccgaggacacggccgtatattactgtgtgaaagatctccacgtctcgcccctgactgtattcgactcctgggcaggaccctgtgcctcncctcagcctcaccaaggcccatcgtctcccctagccaccctctccaagacgcacctctcgggggcacagcggccctgggctgcctaggtccaaggactacttcctanacgngtcgcgtcgagnggcctgcgacggccgacacgcgcnc

SEQ ID NO: 406937 - DNA, 551 bp, Homo sapiens
  misc_feature: GZ8MTXP02HJ3W0.52.34.D01.1.454.CMB.2.raw
  modified_base (328)..(328): a, c, t, g, unknown or other
  modified_base (550)..(551): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattccaaagaacacgctgtatttacaaatgaacagcctgagagccgaggacacggccgtatattactgtgtgaaaagntctccacgtctcgcccccttggactggttattccgactccgtggggccagggaaccctagtacgccgtctcctcacgcctccaccaaggcccatccgtctcccctgccaccctcctccaagacgcacctcgtgggggcacgacgccggccctgggcctggcctggtcaacggtactacgttccatccgatcgctcgacgtcggctcggcaacggcgcatagnn

SEQ ID NO: 406938 - DNA, 525 bp, Homo sapiens
  misc_feature: GZ8MTXP02HQOHR.52.34.D01.1.454.CMB.2.raw
  modified_base (412)..(412): a, c, t, g, unknown or other
  modified_base (416)..(416): a, c, t, g, unknown or other
  modified_base (438)..(438): a, c, t, g, unknown or other
  modified_base (440)..(440): a, c, t, g, unknown or other
  modified_base (484)..(484): a, c, t, g, unknown or other
  modified_base (499)..(499): a, c, t, g, unknown or other
tcagcgcagtacgacacgaccggtgctcgatttagatcgtctgtgttgggtttggggctgtgggtccaggaggcagaactctgggtgtctcaccatggcctggatccctctacttcctcccctcctcactctctgcacaggctctgaggcctcctatgagctgacacagcccaccctcggtgtcagtctccccaggacagacggccaggatcacctgctctggagatgcattgaccaaaccgatatgcttattggtaccagcagaagccggcaggcccctgtgttggtgatgtaataaagacactgagaggccctagagggactccctgacgccgattctctggctccgaggtccgaagggacaacggtcacagttcgaccattcaaggttggatccgaaggcagaggacgngtcngactagttatgtacaatacaananacactattgtactatgtacttacggaacttgacagaaacccgtnacccgtcgtggaacngacccacggacccaacccacgtctcc

SEQ ID NO: 406939 - DNA, 609 bp, Homo sapiens
  misc_feature: GZ8MTXP02F2SSE.52.34.D01.1.454.CMB.2.raw
  modified_base (481)..(481): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattccaagacacgctgtatttacaaatgaacagcctgagagccgaggacacggccgtatattactgtgtgaaagatctccacgtctccgcccccttgactggttattccgactcctggggccagggaaccctagtcgccgtctccgtcacgcctccaccaaacgggcccatcggtccttccccctggcccaccctcctaccaacgacgccaccctcgtcgggggccaacgngtccggccctcggggctcggcccgtggtaccaaacgggtaccttacttacccgtaacgttacggaacgtcgcgttcggaacggccggggtccttgggaccgaacgggacccgacgaacgtacggcgcg

SEQ ID NO: 406940 - DNA, 602 bp, Homo sapiens
  misc_feature: GZ8MTXP02IXFMN.52.34.D01.1.454.CMB.2.raw
  modified_base (602)..(602): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctaccaaagacaattccaagaacacgctgtatttacaaatgaacagcctgagagccgaggacacggccgtatattactgtgtgaaagatctccacgtcctccgtccccttgacctggttactttccgactccgtgggaccaggggaaccctagtacgccgtctcctcacgccctaccacccgacggcccacgtccggtcccttcccccgtcgaccctcccccgtccctacccgaaacgacacccaccgtccgtgggggcccacgacggccggcccgtgggcctcgccgtcggtaccgaaggtacctacttccgtagtaccgactcgctgacgcggcgtcggccgaaggccgacgacgtcgcn

SEQ ID NO: 406941 - DNA, 607 bp, Homo sapiens
  misc_feature: GZ8MTXP02FMZ92.52.34.D01.1.454.CMB.2.raw
  modified_base (244)..(244): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgntatgcttattggtaccagcagaacgccggcaggcccctgtgttggtgatgtataaagacactgagacggccctcgagggactccctgacgccgtattcgtctcggcttccgaggtcgacgggactaaaccgggtcaacgtagttcgggaccctagtccgaaggttggaaacgtccgaaggccgaaggaacgggacggaggaccgtagtaaaccttagttacttgtaacaaatacaaaacacgaaccaacctaagtttcggttaacttaagttgtacgtttacggaactgaccgaaccgtaaacggtccgtaaccgtccgttggaacgacgacccgaaccggacccctaacccacgtcgtaccc

SEQ ID NO: 406942 - DNA, 588 bp, Homo sapiens
  misc_feature: GZ8MTXP02HJTQS.52.34.D01.1.454.CMB.2.raw
  modified_base (266)..(266): a, c, t, g, unknown or other
  modified_base (289)..(289): a, c, t, g, unknown or other
  modified_base (588)..(588): a, c, t, g, unknown or other
tcagcgcagtacgacacgaccggtgctcgatttagatcgtctgtgttgggtttgggggaggcttggtaaagcggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaaattccaagaacacgntagtaattaacaaatgaacagcngagagcgagacacgctatattactgtgagaaagatctccacgtctccgcccctgactgttattccgactccgtgggaccacggacctagtcgccgtctcctcacgcctaccaacccgaacggcccacgtccgtcccttcccctcgccctaccctcctaccaagacgcctaccgtcgtcgggggcacgacggccgggtcccgtcggcctcgccgtacggtacgaaacggtactaaccttacctaactacgactacgtacgtcgacggcgggcgtcggacgaacggacgacgacgtacgan

SEQ ID NO: 406943 - DNA, 654 bp, Homo sapiens
  misc_feature: GZ8MTXP02HBQZJ.52.34.D01.1.454.CMB.2.raw
  modified_base (286)..(286): a, c, t, g, unknown or other
  modified_base (326)..(326): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccaggggaaggggctgggagtgggtctcatttatcagtggtactggtggtagcacatactacgcagactccgtgaagggtccgttcaccatctaccaaagacaatccaaagacacgctagtattacaaatgaacngctgagagccgagacacgccgtatatactgtgtagaaagntctccacgtctccgccccttggacttggttacttccgactcgtcgggaccacggacccttagtcgccgtctcctcgacgccctaccgaaccaacgggcccacgttcccggtcccttcccccgtcggaccctacccccttccacccgaaacgacgccacccgttccggcgggggaccacgacggccggcccgtcgggcttcggaccctggaccgaaaggtacccttacccgttacccgtaacgttacggacgtccggtacgttacggaacgggtccggtccgttaacgggaccgtaaaacgggccccggtaaacgtacgtaccgtgtcg

SEQ ID NO: 406944 - DNA, 544 bp, Homo sapiens
  misc_feature: GZ8MTXP02GEAET.52.34.D01.1.454.CMB.2.raw
  modified_base (514)..(514): a, c, t, g, unknown or other
  modified_base (528)..(528): a, c, t, g, unknown or other
  modified_base (541)..(541): a, c, t, g, unknown or other
  modified_base (543)..(544): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtgtagcacatactacgcagactccgtgaagggccggttcaccatctccaaagacaattcccaagaacacgctgtatttacaaatgaacagcctgagagccgaggacacggccgtatattactgtgtgaaagatctccacgtctcgcccccttggactggttattccgactcctggggccagggaccctagtgccgtctcctcagcctccaccaaacgggcccatcggtcttcccccgtggccacccctcctccaagacgcaccctctgggggcacgagccggccctggggctgccctggtcaaggactactctatacgntcgctgacgcggcnggcaacggcgcanann

SEQ ID NO: 406945 - DNA, 632 bp, Homo sapiens
  misc_feature: GZ8MTXP02JGQ1Z.52.34.D01.1.454.CMB.2.raw
  modified_base (631)..(631): a, c, t, g, unknown or other
tcagcgcagtacgacacgaccggtgctcgatttagatcgtctgtgttgggtttggggaggcttggtaaagcgggggggtatctgagactctcctgttcagtctctggattcaccttaaataactatggcatgagctgggtccgccaggctccagagaaggggctggagtgggtctcatttatcagtggtactggtggtagcacatactacgcagactccgtgaaggccggttcacatctccaaagcaattccaagaacacgctgtatttacaaatgaacagcctgagagccgaggacacggccgtatattactgtgtgaaagatctccacgtctcgccccttgactggttactttcgactccgtgggccagggaaccctgtacgccgtctcctcacgcctccaccaacggcccagtcggtccttcccccgtggcccaccctccctaccaacgacgccacctcgtcgggggccacgacggccggcccccgtgggccttcggcccgttcgggtccgaaacgggtacccttacccgtttacccgtaacttaccgggtaacttcccggccgttacgggaacgggcccggggaaccgttcggggaccgaaaacggggcccgaccgtacgtaacggng

SEQ ID NO: 406946 - DNA, 549 bp, Homo sapiens
  misc_feature: GZ8MTXP02JB4XF.52.34.D01.1.454.CMB.2.raw
  modified_base (545)..(545): a, c, t, g, unknown or other
  modified_base (548)..(549): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattccaagaacacgctgtatttacaaatgaacagcctgagagccgaggacacggccgtatattactgtgtgaaaagatctccacgtctcgccccccttggactggttatttccgactcctggggccagggaacccctagtgccgtctcctcagcctccaccaagggcccatcggtcttccccctggccacccctcctccaagcgcacctcgtgggggccacacgcggccctgggctgccctggtcaaggctacgttcctataccgatcgctcgacgcgggctggcaaggcgcanagnn

SEQ ID NO: 406947 - DNA, 569 bp, Homo sapiens
  misc_feature: GZ8MTXP02JCWSM.52.34.D01.1.454.CMB.2.raw
  modified_base (449)..(449): a, c, t, g, unknown or other
tcagcgcagtacgacacgaccggtgctcgatttagatcgtctgtgttgggtttggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagaacacgctgtatttacaaatgaacagcctgagagccgaggacacggccgtatattactgtgtgaaagatctccacgtctcgcccccttggactggttattccgactcctggggccagggaaccctagtagccgtctcctcagcctccaccaacggcccatcgtcttccccctgccaccctcctccaagacncacctcgtgggggcacgacgcggccctgggctgcctggtcaacggactaccttcccgtacgtacgacgtcgtctggaacgtcgggtctcggaccgaacgggccgacgtacgtacggctcg

SEQ ID NO: 406948 - DNA, 621 bp, Homo sapiens
  misc_feature: GZ8MTXP02H3RHI.52.34.D01.1.454.CMB.2.raw
  modified_base (327)..(327): a, c, t, g, unknown or other
  modified_base (462)..(462): a, c, t, g, unknown or other
  modified_base (620)..(620): a, c, t, g, unknown or other
tcagcgcagtacgacacgaccggtgctcgatttagatcgtctgtgttgggtttggggaggcttggtaaagcgggggggtatctgagactctcctgttcagtctctggattcaccttaaataactatggcatgagctgggtccgccaggctccgaggggaaggggctggagtgggtctcatttatcagtggtactggtggtagcacatactacgcagactccgtgaagggccgttcaccatctaccaaagacaattcaaagaacacgctagtaattaacaaatgaacagcctgagacgcgagacacgctatattactgtagagaaaanctcctccacgtctcccgtccccgttaggtacttggttactttcccgaccttccggtcggggaccaacggggtaccctagccgtcccgttctcctcacgtcccaccaacgaacgcccagttccgtcccttccccgngtacccaccctccaccaacgcgaccaccgttcggcggggacaacgcggccgccggtgaccgtcgccgtgaaccgagtaccctaccgttaccgaaacgttcggaactcggttcgacggtacgccggttcgtcggaaccgaacgggcccagaacgtcgcnc

SEQ ID NO: 406949 - DNA, 606 bp, Homo sapiens
  misc_feature: GZ8MTXP02GIWIH.52.34.D01.1.454.CMB.2.raw
  modified_base (605)..(606): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaaagaacacgctgtattaacaatgaacagctgagagcgagacgacgcgtatatactgtgtagaagatctccacgtctccgccccttggactggttatttccgactccgtcgggccgacgggaaccctagtcgccgtctcctcacgccctaccacccgaaacgggcccagtcccggtcccttccccctcggcccacccctccctacccaacgaccgcctacccgtcggtccgggggcaccgacggccgggcccgtcgggccgtcgcccgtggtaccgaacggtaccttaccttcccgtaatacgacttccgcgtggacgccgggcgtggacgaacgggcgacgactagnn

SEQ ID NO: 406950 - DNA, 582 bp, Homo sapiens
  misc_feature: GZ8MTXP02HHXNI.52.34.D01.1.454.CMB.2.raw
  modified_base (581)..(582): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctaccaaagacaattccaagaacacgctgtatttacaaatgaacagcctgagagccgagacacggccgtatattactgtgtagaaagatctccacgtctccgcccccttgactggttattccgactccgtggggccacgggaaccctagtcgccgtctcctcacgcctccaccgaacgggcccacgtccggtcccttcccccgtgcccacccctcctacccaacgacgccacctcgtcgggggccacgacggccggcccgtgggcctcgccgtggtcaacggtactacgttcctaagtacgactccgctcgacgcgggctgggacaacggccgacacgagnn

SEQ ID NO: 406951 - DNA, 557 bp, Homo sapiens
  misc_feature: GZ8MTXP02ILBKF.52.34.D01.1.454.CMB.2.raw
  modified_base (556)..(557): a, c, t, g, unknown or other
tcagcgcagtacgacacgaccggtgctcgatttagatcgtctgtgttgggtttggggaggcttggtaaagcgggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagcaattccaagaacacgctgtatttacaaatgaacagcctgagagccgaggacacggccgtatattactgtgtgaaaagatctccacgtctcgcccccttgactggtattccgactcctgggccagggaccctagtgccgtctcctcacgcctccaccaacggcccatccggtccttccccctcggccaccctcctcccaacgacgcacctcgtggggcacgacgcggcccctgggcctcgccgtcggtcaacgggactaccttcctactacgacttcgacttcgacgcgggctggcaaacggcgacactagnn

SEQ ID NO: 406952 - DNA, 584 bp, Homo sapiens
  misc_feature: GZ8MTXP02G5YHO.52.34.D01.1.454.CMB.2.raw
  modified_base (243)..(243): a, c, t, g, unknown or other
  modified_base (451)..(451): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttatggaccagcagaagccggcaggcccctgtgttggtgatgtaataaagacactgagacgggccctgagggatcccgagagccgtattcctcgtggctcgaggtcgagggacaacggtcactagttcggacctatcgaggtcggaacgtcccgaagggcaggacggacgagggctagtactatttagtgtacaataccaaanagaacctaacctagttacggtattaagtcgtacttacggaaacttggaccgtaaccaaacggtcctaaccgtccgttaggggtaaccacggacccccgaaacgggaccccaaccccgtacgtacgttaacccg

SEQ ID NO: 406953 - DNA, 625 bp, Homo sapiens
  misc_feature: GZ8MTXP02IN6TH.52.34.D01.1.454.CMB.2.raw
  modified_base (624)..(624): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctcaaagacaattccaagaacacgctgtattacaaatgaacagcctgagagccgaggacacggccgtatattactgtgtgaaaagatctccacgtctcgccccctgactggttatttccgactccgtgggccacgggaaccctgtacgccgtctcctcacgcctccaccaacgggcccagtccgtccttccccctgccacccctcctccaacgacgcaccctcgtagggggccaacgcgccgggcccccgtgggggcctcggcccgttcgggtaccgtaaacggggtaaccttaccctttaccccgtattaacccggaactttcccgacgtgggacggtccggggccgttgggacccgaaaggggccggtaccacgtacggcgng

SEQ ID NO: 406954 - DNA, 565 bp, Homo sapiens
  misc_feature: GZ8MTXP02HN5ZV.52.34.D01.1.454.CMB.2.raw
  modified_base (564)..(565): a, c, t, g, unknown or other
tcagcgcagtacgacacgaccggtgctcgatttagatcgtctgtgttgggtttggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaagaacacgctgtatttacaaatgaacagcctgagagccgaggacacggccgtatattactgtgtagaaagatctccacgtctcgccccttgactggttattccgactctgggcaggaaccctgtcgccgtctcctcacgcctccaccaacggcccagtccgtcctccccctgccaccctcctccaagcgcacctcgtgggggcacgacggccggcccgtgggcctgacctcggtacaacgggtacctacttacccgtagttacgacttccggcttgacggcggctggacaacgggtccacgacgtcgnn

SEQ ID NO: 406955 - DNA, 569 bp, Homo sapiens
  misc_feature: GZ8MTXP02HPWSZ.52.34.D01.1.454.CMB.2.raw
  modified_base (550)..(550): a, c, t, g, unknown or other
  modified_base (562)..(562): a, c, t, g, unknown or other
  modified_base (566)..(566): a, c, t, g, unknown or other
  modified_base (568)..(569): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaaggccggttcaccatctccaaagacaattccaagaacacgctgtatttacaaatgaacagcctgagagccgaggacacggccgtatattactgtgtagaaagatctccacgtcctcgccccttggactggttatttccgactccgtggggccaggaaccctagtacgccgtctcctcacgcctccaccaacggcccatccggtccttccccctcggccacccctcctaccaacgacgccacctcgtcgggggcacgacgccggccctggggcctcggccctggtacaacggacttacttcctagtacgactcgctcgacgcggtcnggcaaggccganacgngnn

SEQ ID NO: 406956 - DNA, 596 bp, Homo sapiens
  misc_feature: GZ8MTXP02IMAYY.52.34.D01.1.454.CMB.2.raw
  modified_base (144)..(144): a, c, t, g, unknown or other
  modified_base (329)..(329): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccnccaggctccagggaagggctggagtgggtctcatttatcagtggtactggtggtagcacatactacgcagactccgtgaagggccgttcaccatcctaccaaagacaattccaagaacacgctagtatttacaaatgaacagcctgagagaccgagacacggaccgtatatactgtgtgaaaagntctccacgtctccgccccttggactggttacttcgactcctggggccacgggaccctagcgcctctcctcgacgtcctccaccgaacggcccacgtcgtccttccccgtgccacccctcctaccgaacgacgccacccgttcgtcgggggacacgacggccggcccgtgggcctggtacccgtggtacgaacggtacctactttcccgtagtacgcgtacggcgtacgacggtcgtcgtcggaccgacggaccgtagacgtacgcgc

SEQ ID NO: 406957 - DNA, 594 bp, Homo sapiens
  misc_feature: GZ8MTXP02JHTNX.52.34.D01.1.454.CMB.2.raw
  modified_base (593)..(594): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaaggccggttcaccatctaccaaagacaattccaagaacacgctgtattacaaatgaacagcctgagagccgaggacacggccgtatattactgtgtagaagatctccacgtctccgccccctgctggttacttccgactccgtcgggccgaggtaaccctagtcgccgtctccgtcacgccctaccaccaacgggcccagtccgtcccttccccgtgcccacccctcctacccaagacgccacccgtccggtgggggacccacgacgcccgggtccctgggggcctgcccgttagggcaaacggtccttaccttcctaagtaccacgtccgccgtggacggcgggtcgcggaccaggcgtacagtacgnn

SEQ ID NO: 406958 - DNA, 601 bp, Homo sapiens
  misc_feature: GZ8MTXP02GHB8E.52.34.D01.1.454.CMB.2.raw
  modified_base (601)..(601): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctctatttatcagtggtactggtggtagcacatactacgcagactccgtgaagggccggttcaccatcctaccaaagacaattccaaagaacacgctagtatttaacaaatgaacagcctgagagaccgaggacacggccgtatattactgtgtagaaagatctccacgtctccgccccttgactgtttattccgacgtccgtgggccgacggaaccctagtcgccgtctcctcacgccctccaccgacggcccacgtccgtcccttcccccgtgccctacccctcctaccaagacaccacccgtcggtcggggcacgcggcccggcccgtgggcctcgccgtcggacaacggacttaccttcctagtaccgtactccgcgtacggacggtccgggtcgtaacggacgaacggccgacgactagcn

SEQ ID NO: 406959 - DNA, 560 bp, Homo sapiens
  misc_feature: GZ8MTXP02GJU5C.52.34.D01.1.454.CMB.2.raw
  modified_base (144)..(144): a, c, t, g, unknown or other
  modified_base (182)..(182): a, c, t, g, unknown or other
  modified_base (200)..(200): a, c, t, g, unknown or other
  modified_base (282)..(282): a, c, t, g, unknown or other
  modified_base (325)..(325): a, c, t, g, unknown or other
  modified_base (449)..(449): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccnccaggctccagggaagggctggagtgggtctcatttancagtggtactggtggtancacatactacgcagactccgtgaaggccgttcaccatctaccaaagacaattccaaagacacgctgtatttacaaatgaacngcctgagagcgagacacgccgtatattactgtgtgaaagatcncacgtcctcgccccttgactggttattccgactcgtgggccaggaacccttgcgccgtctcctcacgtcctccaccgaacggcccactcggtcctcccccgtggcctacccctctaccaagacnccacctcgtggggcacgcgccgccctggctcgccgtcggtcaacgggtactaccgttcccgacgtcgacgtcgcgtgacgtcgtcctgacacggaccagtacgccgtctcg

SEQ ID NO: 406960 - DNA, 589 bp, Homo sapiens
  misc_feature: GZ8MTXP02HJOG0.52.34.D01.1.454.CMB.2.raw
  modified_base (588)..(589): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattcccaagaacacgctgtatttacaaatgaacagcctgagagccgaggacacggccgtatattactgtgtagaaaagatctccacgtctcgcccccttgactggttattccgactccgtgggccaggaccctagtcgccgtctcctcacgccctccaccaacgggcccagtccggtccttcccccgtcggcccacccctcctacccgaacgacgccacctcgtcgggggccacgacgccggcccgtgggcctcggacccgtggtaccgaacggtactacctttaccgtataccgacttccgcctggacgcgggcgtcggcgaacggcgacacgtcgnn

SEQ ID NO: 406961 - DNA, 588 bp, Homo sapiens
  misc_feature: GZ8MTXP02IX7WE.52.34.D01.1.454.CMB.2.raw
  modified_base (225)..(225): a, c, t, g, unknown or other
  modified_base (486)..(486): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttcctccccctcctcactctctgcacaggctctgaggcctcctatgagctgacacagcccaccctcggtgtcagtcgtcccaggacagacgcaggatcacctgctctgganatgcattcgaccaaacgtatatgtcttagttcggaaccagacaagaacggcccgggaccacggccccgttggtgttggtagattagtaataaaagacacgtaggaagacggccctagagggactcccgtaggacgaccgtattcctcgtcggcctaccgaggtcgagggactaacggtacactagtcggacagtcgagtacggacgtaccgaaggcgaggaaggacgtaggctagtaacttattagtagtacaatacaaanagaacactagttagtacttagtcgtacgtacgaactgaacgactaaacggtcctaacgtcgcgtaaccgacgaccgaaccgacccaaccctacgtacgtacc

SEQ ID NO: 406962 - DNA, 564 bp, Homo sapiens
  misc_feature: GZ8MTXP02FI3MY.52.34.D01.1.454.CMB.2.raw
  modified_base (339)..(339): a, c, t, g, unknown or other
  modified_base (560)..(560): a, c, t, g, unknown or other
  modified_base (563)..(564): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactcgtgaaggccgttcaccatctaccaaagacaattccaaagaacacgctgtatttaacaaatgaacagcctgagagccgaggacacggccgtatattactgtgtgaaagatctccacgtcncgcccccttgactggttattccgactcctggggccagggaaccctagtacgcccgtctcctcagcctccaccaagggcccagtccggtccttcccccgtggcccacccctcctaccaaacgacgcccacctcgtgggggcacgacgcgggccctgggctcgccgtaggtacaaggtactacttcctatacgctcgcgcgacgcggcgcgacgacgcgacanagnn

SEQ ID NO: 406963 - DNA, 603 bp, Homo sapiens
  misc_feature: GZ8MTXP02FNBKH.52.34.D01.1.454.CMB.2.raw
  modified_base (599)..(599): a, c, t, g, unknown or other
  modified_base (601)..(603): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaaagaacacgctgtatttaacaaatgaacagcctgagagccgaggacacggcgtatattactgtgtagaaagatcctaccacgtcctccgtcccccttggactggtttattccgactccgtggggccacgggaaccctagtcgccgtctcctcacgcctaccacccgtaacgggccctacgtccggttcccttccccccgtcgacccaccccctccctaccaaacgacgcctacccgtcggtcgggggccacgacggcccggcccgtcgggctcggccgtcggtacgaaggtacctaccttacctagtaccgactcgctggacgcgggctggacgaggcganannn

SEQ ID NO: 406964 - DNA, 584 bp, Homo sapiens
  misc_feature: GZ8MTXP02HW8HM.52.34.D01.1.454.CMB.2.raw
  modified_base (451)..(451): a, c, t, g, unknown or other
  modified_base (559)..(559): a, c, t, g, unknown or other
  modified_base (583)..(584): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctgggagtgggtctcatttatcagtggtactggtggtagcacatactacgcagactccgtgaaggccgttcacatctaccaaagacaattccaagacacgctgtattacaaatgaacagctgagagccgaggacacggccgtatattactgtgtagaagatctcacgtctccgcccctgactgttattccgactccgtgggccaggaccctagtcgccgtctcctcacgccctaccaccgacggcccacgtccgtccttcccccgtgccacccctcctccaacgacncctaccgtcgtcgggggcacgacggccgggcccgtgggccgtcggccgtcggtacgaacggtaccttaaccttcctaagtaccggtactcgaccgtgacggccggggngtcgggacgacggcgacacgtcgnn

SEQ ID NO: 406965 - DNA, 547 bp, Homo sapiens
  misc_feature: GZ8MTXP02H92NG.52.34.D01.1.454.CMB.2.raw
  modified_base (185)..(185): a, c, t, g, unknown or other
  modified_base (263)..(263): a, c, t, g, unknown or other
  modified_base (313)..(313): a, c, t, g, unknown or other
  modified_base (389)..(389): a, c, t, g, unknown or other
  modified_base (399)..(399): a, c, t, g, unknown or other
  modified_base (402)..(402): a, c, t, g, unknown or other
  modified_base (429)..(429): a, c, t, g, unknown or other
  modified_base (448)..(448): a, c, t, g, unknown or other
  modified_base (474)..(474): a, c, t, g, unknown or other
  modified_base (477)..(477): a, c, t, g, unknown or other
  modified_base (544)..(544): a, c, t, g, unknown or other
  modified_base (546)..(546): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccgagggaaggggctggagtgggtctcattttancagtggtactggtggtagcacatactacgcagactccgtgaacgggccgttcacatctacaaagacaatcaaagaacncgctgttaattacaaatgaacagcagagacgccgagacacgctatattangagtagaaagtctccaccacgttcctccgtcccctgtacgtgttacttcccgactcgtcgggacacggtacctgcnccgtctcctnacncaccacgacgcacgttcgtcctcccgngcctaccctcaacacgacnccgacgtggcggacacgcgccgccgngcncgcgtacgacgtacgtctacgtcacgtagctcgcgacgacgtcgcgaacgacgacggacatacgtcncnc

SEQ ID NO: 406966 - DNA, 581 bp, Homo sapiens
  misc_feature: GZ8MTXP02JF7JO.52.34.D01.1.454.CMB.2.raw
  modified_base (325)..(325): a, c, t, g, unknown or other
  modified_base (580)..(581): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagcaattccaagacacgctgtatttacaaatgaacagcctgagagcgaggacacggccgtatattactgtgtagaaagntctccacgtctccgcccccttgactggttattccgactccgtgggaccacgggaacctagtcgccgtctcctcacgccctccaaccgaacgggcccagtcccggtcccttcccccgtcgcctacccctcctacccaagacgccacctcgtcgggggcacgacggcccggcccgtgggcctcgacccgtggacgaacggaccttacttcctataccgactcgctcgacgcgggctcggacgaacggcacgagacgnn

SEQ ID NO: 406967 - DNA, 574 bp, Homo sapiens
  misc_feature: GZ8MTXP02HOT6L.52.34.D01.1.454.CMB.2.raw
  modified_base (431)..(431): a, c, t, g, unknown or other
  modified_base (555)..(555): a, c, t, g, unknown or other
  modified_base (567)..(567): a, c, t, g, unknown or other
  modified_base (573)..(574): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaagaacacgctgtattacaaatgaacagcctgagagccgagacacggccgtatatactgtgtgaaagatctccacgtctcgccccctgactggttattccgactccgtcgggccacggaccctagtcgccgtctcctcacgcctccaccacggcccatccggtccttcccccgngcccacccctcctccaaacgcgccacccgttcggacgggggccacgacggcccggcccgtgggcctcgcccgtggtaccaacggtactaccgttcctaacgtaccgactcgctggacgccggcncggcaacggcanacgagnn

SEQ ID NO: 406968 - DNA, 540 bp, Homo sapiens
  misc_feature: GZ8MTXP02GILME.52.34.D01.1.454.CMB.2.raw
  modified_base (514)..(514): a, c, t, g, unknown or other
  modified_base (525)..(525): a, c, t, g, unknown or other
  modified_base (537)..(537): a, c, t, g, unknown or other
  modified_base (539)..(540): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcacatctccaaagacaattccaagaacacgctgtatttaacaaatgaacagcctgagagccgaggacacggccgtatattactgtgtgaaagatctccacgtctcgcccccttgactggttattccgactccgtgggccagggaaccctagtacgccgtctcctcagcctccacaaacggcccatcggtcctcccctgccaccctccctaccaagacgcaccctcgtcgggggcacgagccggccctgggctgcctggcaaggctacttccactacgatcnctgacgcggcnggcaaggcgcanann

SEQ ID NO: 406969 - DNA, 553 bp, Homo sapiens
  misc_feature: GZ8MTXP02HRVX1.52.34.D01.1.454.CMB.2.raw
  modified_base (241)..(241): a, c, t, g, unknown or other
  modified_base (282)..(282): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttatgtacagcagagccggcaggcccctgtgtggtnatgtataagacactgagaggcctgagggatccccgtgacgcgtacttctcgtaggctccgaggtcgagggacacggtcacagttgcccatcaggtggagtccgaggcaggaggacggaggctagacgttattattgtacaatacaaacagaaccaccgtattaggttacttagtgttacgtttacggaacttcgacggtacctaaacggtctacccgtaccgcggttaaccgacggaccccgaacggacccaaaaccccgcgtacgtaccc

SEQ ID NO: 406970 - DNA, 605 bp, Homo sapiens
  misc_feature: GZ8MTXP02HC0OO.52.34.D01.1.454.CMB.2.raw
  modified_base (328)..(328): a, c, t, g, unknown or other
  modified_base (331)..(331): a, c, t, g, unknown or other
  modified_base (603)..(604): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctaccaaagacaattccaagaacacgctgtatttacaaatgaacagcctgagagccgaggacacggccgtatatactgtgtagaaagntcnccacgtctcgcccccttgactggttattccgactccgtggggccacgggaaccctagtcgccgttctcctcacgccctaccacccgaacgggcccacgtccggtcccttcccccgtggcccacccctccctacccgaagtacgccacccgtcgtgggggcctacgacgccggcccgtgggcctcggcccgtggtaccaacgggtactacctttcctacgtacgactccgcgtcgacggccgggtacgtcggaccgaacggcgacgatacggnng

SEQ ID NO: 406971 - DNA, 666 bp, Homo sapiens
  misc_feature: GZ8MTXP02HD9O2.52.34.D01.1.454.CMB.2.raw
  modified_base (664)..(664): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctacaaagacaattccaagaacacgctagttattaacaaatgaacagcctgagacgccgaggacgacggccgtatattactgtgtagaagatcctaccaccgtcctcccgtcccccgttggtaccttggtttacttccccgtacctccgtcggggaccgacgggtaaccctaggtcggcccgttctccctcacgccctacccaacccgaccggggccctacgttcccggtcccttcccccgcgcccctacccctccctacccaaagccgcctacccgtcggtcgggggacaccgcgggcccgggtcccgtgggcctcggacccgtggtaccgaacggtaccttacccgttaccgacgttacgacgttcggacgttacgggacggtccggttcgtcgggaacgacgggaccgtacgacgtcgcncg

SEQ ID NO: 406972 - DNA, 633 bp, Homo sapiens
  misc_feature: GZ8MTXP02IOU3E.52.34.D01.1.454.CMB.2.raw
  modified_base (470)..(470): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccgagggaaggggctggagtgggtctcatttatcagtggtactggtggtagcacatactacgcagactccgtgaacgggccgttcaccatctacaaagacaattccaagaacacgctgtatttacaaatgaacagctgagagccgaggacacggccgtatatactgtgtagaaagatctccacgtcctccgcccccttgacttggttacttccgacctccgtcggggccacggaaccctagtcgtcctctcctcacgcctaccaccgacggcccacgttccggtcccttcccccgtgcccacccctcctacccaagacnccaccctcggtcgggggcacgacgccgggtccccgtgggcctcggtcccgtacggtccaaacgggtccttaaccgtttccccggaaccgtacggaacggttcgcggttacggacgtccgtacgttcggacccgaacgggtaccctaggtacgtaccgtcctcg

SEQ ID NO: 406973 - DNA, 589 bp, Homo sapiens
  misc_feature: GZ8MTXP02F3LVR.52.34.D01.1.454.CMB.2.raw
  modified_base (588)..(588): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcattttatcagtggtactggtggtagcacatactacgcagactccgtgaagggccgttcacatctaccaaagacaattccaaagaacacgctgtatttaacaaatgaacagcctgagagccgaggacacggccgtatattactgtgtagaaaagatctccacgtcctccgtcccccttggactggttacttccgactccgtgggccagggaccctagtcgccgtctaccgtcacgcctccaccgaacggcccatccggtcctcccccgtgcccaccctcctaccaacgacgccaccgttcgcgggggaccacgacgccggcccgtcggggctcgccgtcggtacaacggtaccttacgtcccgaacgtcgacgtcgctaggacgtcggctgacgacggaccgagtactcgcnc

SEQ ID NO: 406974 - DNA, 575 bp, Homo sapiens
  misc_feature: GZ8MTXP02HK80H.52.34.D01.1.454.CMB.2.raw
  modified_base (439)..(439): a, c, t, g, unknown or other
  modified_base (572)..(572): a, c, t, g, unknown or other
  modified_base (574)..(575): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaagaacacgctgtattacaaatgaacagctgagagccgaggacacggccgtatattactgtgtagaaagatctccacgtctccgcccccttgactgttacttccgactccgtgggccacggaccctagtcgccgtctcctcacgtcctccaccgaacggcccatcccggtcccttcccccgngacccaccctcctaccgaagacgccaccgtcggtcgggggcacacggcggccccgtgggcctcgccgtggaccgaagtctaccttctacgtacgacttccgctacgacggcggcgtggcgaacggcgctaagngnn

SEQ ID NO: 406975 - DNA, 580 bp, Homo sapiens
  misc_feature: GZ8MTXP02JUEKS.52.34.D01.1.454.CMB.2.raw
  modified_base (482)..(482): a, c, t, g, unknown or other
  modified_base (578)..(578): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactgggtgtagcacatactacgcagactccgtgaagggccggttcaccatctaccaaaagcaattccaaagaacacgctgtatttacaaatgaacagcctgagagccgaggacacggccgtatattactgtgtagaaagatctccacgtctcgccccttggactggttatttccgactccgtgggccaggaccctgtcgccgtctcctcagcctccaccgaaggtcccatccgtccttccccctgccaccctcctccaagacgcacctcgtcggggcacgacgccggcccgngggtccgtcgccgtcgtacgaacggtactaccgttcccgaacgttcgacgtcgtaccgtgacgtcggtcgtggaccgaacgggctacgacgtcgcncg

SEQ ID NO: 406976 - DNA, 652 bp, Homo sapiens
  misc_feature: GZ8MTXP02HEEGV.52.34.D01.1.454.CMB.2.raw
  modified_base (650)..(650): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaaggggctggagtgggtctcatttatcagtggtactggtggtagcacatactacgcagactccgtgaacgggccgttcaccatctaccaaagacaattccaaagacacgctagtattaacaaatgaacagcctgagagccgaggacacggccgtatattactgtgtagaaagatctccacgtcctccgccccttgactggttatttcccgactccgtcgggaccacggaaccctagtcgccgtctcctcacgccctccaaccgaacgggccctacgtcccggtcccttcccccgtcggccctacccccgtccctacccgaaacgccgaccgaacccgtccggttcgggggaccaccggaccggcccgggtccccgtcggggtcctcggtacccgtcgggtacctaaacggtaccttaaccttaccgtaactaccgtacgtccgaccgtggacggccgggcgcggaacgaacggccgacgtaacggacgcncg

SEQ ID NO: 406977 - DNA, 691 bp, Homo sapiens
  misc_feature: GZ8MTXP02IYYEA.52.34.D01.1.454.CMB.2.raw
  modified_base (333)..(333): a, c, t, g, unknown or other
  modified_base (342)..(342): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgagggaaggggctggagtgggtctcatttatcagtggtactggtggtagcacatactacgcagactccgtagaacgggccgttcaccatctaccaaagacaattccaaagaacacgctgtaattacaaatgaacagcctagagacgaccgaggacgacggaccgtatattactgtgtanaaagactcncctacgtcctcccgtcccccttggtacctggtttattccccgacctccggtcgggaccgacgggtaaccccttaggtcgcccgttctccctccgtacgccctaccacccgaacggcccagttcccggtcccttcccccgtgaccctccccgtcctaccacgacgccacccgtcggtcggggcaacgccggcccggcccgtcggggcctcgggtaccgcgggttaccgaaacgggacccttacccgtttacccgaacggtttacgggaccgttcggtaccgttcgggaaaccggtacggtcccgttaacggaccgtacggggaaaccccgtgtaacggtccgtaccctcg

SEQ ID NO: 406978 - DNA, 634 bp, Homo sapiens
  misc_feature: GZ8MTXP02JDFNG.52.34.D01.1.454.CMB.2.raw
  modified_base (632)..(632): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccaggggaaggggctggagtgggtctcatttatcagtggtactggtggtagcacatactacgcagactccgtgaagggccgttcaccatctaccaaagacaattccaaagacacgctgtattaacaaatgaacagcctgagagccgaggacacggccgtatattactgtgtagaaaagactctaccaccgtctcccgtcccccgttggaccttggtttacttcccgacctccggtcggggaccgacggggtaaccctgtaccgcccgttctccctaccacgtccctaccgacccgaacggccctacgtccggtcccttccccgtcgcccacccctcctaccaacgtacgcctacccgtcggtcggggaccacgacggtccggcccgtgggcctcgtccgtgaccgaacgtacctaccttccgtacgtcgacgtcgcgtcggacggtcggtacgtcggacgaacggtccgacgagtacgcncg

SEQ ID NO: 406979 - DNA, 614 bp, Homo sapiens
  misc_feature: GZ8MTXP02H0LRB.52.34.D01.1.454.CMB.2.raw
  modified_base (325)..(325): a, c, t, g, unknown or other
  modified_base (454)..(454): a, c, t, g, unknown or other
  modified_base (612)..(613): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaagaacacgctgtattacaaatgaacagctgagagcgaggacacggccgtatattactgtgtagaaaantcctccacgtcctccgtcccccgttggtactggttactttccgactccgtcggggcctagggaccctagtcgccgttctcctcactccctccaccaacggcccacgtccgtcccttcccccgcgacccnccctccctaccaacgacaccgacctccggtcggggaccaccgacgcccgggcccgtggccttcggcccgtcggtaccgaacggtaccttaccttacccgtacttaccggacttccgtcgtcggacgccgggccgtaacggcgaacggcgaccacgcgnng

SEQ ID NO: 406980 - DNA, 606 bp, Homo sapiens
  misc_feature: GZ8MTXP02FIN4K.52.34.D01.1.454.CMB.2.raw
  modified_base (183)..(183): a, c, t, g, unknown or other
  modified_base (365)..(365): a, c, t, g, unknown or other
  modified_base (606)..(606): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttancagtggtactggtgtagcacatacacgcagactccgtgaagggccgttcaccatctccaaagacaattccaagacacgctgtattacaaatgaacagcctgagagccgaggacacggccgtatattactgtgtgaaagatctccacgtctccgcccccttggactggttattccgactccgnggggccagggaccctagtcgccgtctcctcacgcctccaccaacgggcccactccggtccttcccccgtcggtcccacccctcctacccaacgacgccaccctcgtcgggggcacgacgccgggccccgtcggggcctcgcccgtcggtaccgaaacgggtacctaacctttccctaactaccggaactccgcgtacgaacggccggggtcgtcgggacgaaacggccggacaacgacgcn

SEQ ID NO: 406981 - DNA, 650 bp, Homo sapiens
  misc_feature: GZ8MTXP02GBIY9.52.34.D01.1.454.CMB.2.raw
  modified_base (284)..(284): a, c, t, g, unknown or other
  modified_base (327)..(327): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccaggggaaggggctggagtgggtctcatttatcagtggtactggtggtagcacatactacgcagactccgtgaagggccgttcaccatctaccaaagacaattccaagacacgctgtattacaaatgaacngctgagagccgaggacacggccgtatattactgtgtagaaagntcctccacgtcctccgtcccccttggactggtttactttcccgactccgtcggggccacggaaccctagtcgccgtctcctcacgccctccaccgaacgggcccacgtcccggtccccttcccccgtcgcccctaccccctcctacccgaacgaccgacctacccgtccggtcgggggaccacggacgcccgggcccgtgggccgtcgccgtcggtaccgaaacgtaccttacccgttacccgtacggtacgtaccggtcgtccggtagggtaacgtcggttaccgtcggaaccgaacgggtacccgagtaacgtccgtactc

SEQ ID NO: 406982 - DNA, 624 bp, Homo sapiens
  misc_feature: GZ8MTXP02JLY6W.52.34.D01.1.454.CMB.2.raw
  modified_base (331)..(331): a, c, t, g, unknown or other
  modified_base (502)..(502): a, c, t, g, unknown or other
  modified_base (623)..(623): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgagggaaggggctggagtgggtctcatttatcagtggtactgggtggtagcacatactacgcagactccgtggaacgggtccgttcaccatctaccaaagacaatccaaagacacgctagtattaacaaatgaacagcctgagacgcgaggacacggcgtatatactgtgtagaagntctaccacgtcctcccgtcccccgtggtacttaggtttacttccccgtaccgtccggtacggggaccgtacgggtaaccctagtccgtcccgtctacctcgacgtccctaccaccgaacggccctacgttcccgtcccttccccgcgccctacccctcctaccgaacgacncctaccgtcggtacggggactacgacggccggccgtggcgtcgccgtggtacaacgtactacctccgtacgcgacgtcgacgtacgacggtcggtctggacgtacggacgtcgacgtcgcnc

SEQ ID NO: 406983 - DNA, 615 bp, Homo sapiens
  misc_feature: GZ8MTXP02HH4K0.52.34.D01.1.454.CMB.2.raw
  modified_base (328)..(328): a, c, t, g, unknown or other
  modified_base (574)..(574): a, c, t, g, unknown or other
  modified_base (615)..(615): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaagacaattccaagaacacgctgtatttacaatgaacagcctgagacgccgaggacgacggccgtatattactgtgtagaaagntctccacgtcctcgccccctgacctggttattccgactccgtcggggaccgacgggtaaccctgtacgcccgtctacccgtcacgccctacccacccgaacggggccctactccgggtcccttcccccgtcggccacccccgtcctacccgaagacgccaccgttcggacgggggccaacgcggccggccccgtgggccctgcccgtaggtcaacgggtctacttccagttaccgacgtccgtcgnggaccggcggccgtaagggacaacggggcacaacgtaggcn

SEQ ID NO: 406984 - DNA, 696 bp, Homo sapiens
  misc_feature: GZ8MTXP02IBGFX.52.34.D01.1.454.CMB.2.raw
  modified_base (265)..(265): a, c, t, g, unknown or other
  modified_base (267)..(267): a, c, t, g, unknown or other
  modified_base (282)..(282): a, c, t, g, unknown or other
  modified_base (286)..(286): a, c, t, g, unknown or other
  modified_base (324)..(324): a, c, t, g, unknown or other
  modified_base (695)..(696): a, c, t, g, unknown or other
tcagcgcagtacgacacgaccggtgctcgatttagatcgtctgtgttgggtttgggggaggcttggtaaagcggggggtatctgagactctcctgttcagtctctggattcaaccttaaataactatggcatgagctgggtccgccaggctccgaggggaaggggctggagtgggtctcatttatcagtggtactgggtggtagcacatactacgcagacctccgtgaagggccggttcaccatctacaaagacattccaagacncntgtattacaatgaanagcngagagccgagacacgccgtatatactgtgtagaaagtntcctccaccgtcctcccgtcccccgttgactggtttactttcccgacctccggtcggggaccgaacggggtaacccttaggtacgtcccgttcctccctaccaccgtccctaccaacccggaaaccgggtcccaacgttcccgggtccccctttccccccgtacggtaccccctacccccgttccctacccgaaaacggaccgcccaacccgttccgggtaccgggggaccaaccggacgggccccgggtccccgtcgggggcctcggcccgttaggtaccgaaacgggtacccttacccgtttacctaacgtaccggtacgttccgcgttaggacgggtccggacgtgggacaacgggccaagacgtcgnn

SEQ ID NO: 406985 - DNA, 738 bp, Homo sapiens
  misc_feature: GZ8MTXP02JYXYI.52.34.D01.1.454.CMB.2.raw
  modified_base (193)..(193): a, c, t, g, unknown or other
  modified_base (737)..(738): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaaggggctgggagtgggtctctatttatcaggnggttttttttacggggtggtagcacatacctacgcagaccgtccgtaggaacgggtccgttcaaccatcctaaccaaagaactaacttaccgaaagaaccacgtctagttaactttaaacaaagtacgaaacgacgccgtaggaacgacggaccggaaggtaccgaacggtaccgtaattaattacgtgtagaagaaaagtctcctccgtacgtcctcccgtccccgttggtacgttcggttttacttcccgaccgttccgggtacggggacccgtaacgggaacccttaggtccggtccccgttccttacccacgaccgtcccccgtacccgaacccggaaccgggccctacggttcccccggttccccctttcccccggccgtacccctacccccttccgaacccgaaacgccgtacccacccggttcggggcggggaccacggcggcccggtccgtcggcgtccggtccgtacggacgaacgtccttaccgttcagtaccgacgtcgcgtgacggcggtcgaacggcgacggcatacgcgnn

SEQ ID NO: 406986 - DNA, 620 bp, Homo sapiens
  misc_feature: GZ8MTXP02GKR88.52.34.D01.1.454.CMB.2.raw
  modified_base (617)..(617): a, c, t, g, unknown or other
  modified_base (619)..(619): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaaagaacacgctgtaatttaacaaatagaacagcctgagagccgaggacacggccgtatattactgtgtagaaagatctccacgtctccgcccccttgactgttatttccgactccgtggggccacggaaccctagtgccgtctcctcacgccctccaaccgaacggcccacgtcggtcccttccccctgcccacccctcctacccaagacgacctacccgtcggtcgggggcacgacggcccggccccgtggggcctcgccgttaggtaccgaaaggtaccgttaccttacccgtaacgtacgtacgtcggtcgtacggacgcgggtacgtaacggaccgaaacggccgacgacgtaccncnc

SEQ ID NO: 406987 - DNA, 742 bp, Homo sapiens
  misc_feature: GZ8MTXP02HS1LP.52.34.D01.1.454.CMB.2.raw
  modified_base (318)..(318): a, c, t, g, unknown or other
  modified_base (328)..(328): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccgagggaaggggctgggagtgggtctcatttatcagtggtactggtggtagcacatactacgcagactccgtgaagggccgttcaccatctacaaagacaattccaagacacgctagtattaacaaatgaacagcctgagagcgagacacggccgtatattactgngtagaaagtntctctacgtctccgtccccttgactggtttacttccgacctccgtcgggaccgaacggggtaacccttaggtcctcccgttctccctcgaacgtccccctaaccgaacccgaaacgggcccccaacgttcccggttcccctttccccccgtcggtaccccctacccccttacccctaacccgaaaacggaccgaccccgtaacccgtccgggttcgggggacccacggacggccccggggccccgtcggggaccgtccggtaaccccgtcgggttaacccgaaaacggggttaacccttaaaccccgtttcccgtaaaacgtaccgtaacgtccggtccgttacgggaaccggtccggggtcgttaaccgggaaccggaaaacggggtccccgaacgtaaacggtacgtacgcg

SEQ ID NO: 406988 - DNA, 550 bp, Homo sapiens
  misc_feature: GZ8MTXP02GW957.52.34.D01.1.454.CMB.2.raw
  modified_base (234)..(234): a, c, t, g, unknown or other
  modified_base (549)..(550): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttnaccatctccaaagacaattccaagaacacgctgtatttacaaatgaacagcctgagagccgaggacacggccgtatattactgtgtgaaagatctccacgtctcgcccccttggacctggttatttccgactcctggggccagggaaccctagtcgccgtctcctcagccctccaccaaacgggcccatcggtccttccccctggccacccctcctcccaaagacgcacctcgtgggggcacgagccggccctgggcctgcctggtcaaggactacttctatcgatcgctgacgcggctggcaaggcgacatagnn

SEQ ID NO: 406989 - DNA, 574 bp, Homo sapiens
  misc_feature: GZ8MTXP02HR1WW.52.34.D01.1.454.CMB.2.raw
  modified_base (144)..(144): a, c, t, g, unknown or other
  modified_base (234)..(234): a, c, t, g, unknown or other
  modified_base (329)..(329): a, c, t, g, unknown or other
  modified_base (440)..(440): a, c, t, g, unknown or other
  modified_base (482)..(482): a, c, t, g, unknown or other
  modified_base (573)..(574): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccnccaggctccagggaaggggctggagtgggtctcatttatcagtggtactggtggtagcacatactacgcagactccgtgaagggccgttnaccatctaccaaagacaattccaaagaacacgctgtatttacaaatgaacagcctgagagccgaggacacggcgtatattactgtgtagaaaagntctccacgtctccgccccttgactggttacttccgactccgtggggtccaggaccctagtcgccgtctcctcagcctccaccgaacgggcccagtccggtccttcccccgngcccaccctctacccaagacgccacctcgtcggggaccacgngcccggcccgtggggctcgccgtggtacacggtactcttacctatacggactcgctcggacgcggggcctggacgaacggcgactactcgnn

SEQ ID NO: 406990 - DNA, 584 bp, Homo sapiens
  misc_feature: GZ8MTXP02JD34O.52.34.D01.1.454.CMB.2.raw
  modified_base (452)..(452): a, c, t, g, unknown or other
  modified_base (459)..(459): a, c, t, g, unknown or other
  modified_base (468)..(468): a, c, t, g, unknown or other
  modified_base (583)..(584): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctaccaaagacaattccaagaacacgctgtattacaaatgaacagcctgagagccgaggacgacggccgtatattactgtgtagaaagatctacctacgtcctccgtcccccttggacgttggttatttcccgacgtccgtcgggaccgacggaaccctagtcgccgtctcctcacgcctccaccgacgccacgtccgtcctccctcgccnccctccnccgaagacnctaccgtcgtcggggacacgacgccggccgtcggcctcggccgtcggacgacgtactaccttcctactaccgactcgactcggacggcgggcgtcggacgacggcgtcacgacgnn

SEQ ID NO: 406991 - DNA, 574 bp, Homo sapiens
  misc_feature: GZ8MTXP02HSSBW.52.34.D01.1.454.CMB.2.raw
  modified_base (574)..(574): a, c, t, g, unknown or other
tcagcgcagtacgacacgaccggtgctcgatttagatcgtctgtgttgggtttgggggaggcttggtaaagcggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctaccaaagacaattccaagaacacgctgtattacaaatgaacagcctgagagccgaggacacggccgtatattactgtgtgaaaagatctccacgtctcgcccccttgactgttattccgactcctgggcagggaccctagtcgccgtactcctctacgcctccaccaacggcccatccgtccttccccctggccaccctcctccaacgacgccacctcgtcgggggaccacgacgccgggcccctggggcctgcccgtgggtaccaacggaccttaccttccgacgttaccggacttcgcctagacgtcgggctgggcaaggcgacacgtagcn

SEQ ID NO: 406992 - DNA, 585 bp, Homo sapiens
  misc_feature: GZ8MTXP02GRTNJ.52.34.D01.1.454.CMB.2.raw
  modified_base (265)..(265): a, c, t, g, unknown or other
  modified_base (287)..(287): a, c, t, g, unknown or other
  modified_base (434)..(434): a, c, t, g, unknown or other
  modified_base (439)..(439): a, c, t, g, unknown or other
  modified_base (454)..(454): a, c, t, g, unknown or other
  modified_base (582)..(582): a, c, t, g, unknown or other
  modified_base (584)..(584): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgagggaaggggctgggagtgggtctcatttatcagtggtactggtggtagcacatactacgcagactccgtgaagggccgttcaccatctaccaaagacaatccaaagacncgctgtattaacaaatgaacancctgagagccgaggacacggccgtatattacgtgtgtagaaagatcctccacgtctccgcccctgactgttacttccgactcgtgggaccacggaccctagccgcctctcctcacgcctaccacgacgcccagtccgtccctccccngcccnccctcctccaagacnccaccgtcgcggggccagacggccggcccgtggcctagccgtacgtcgaacgtacctaccttacctactacggacttcccgggactacgggcggtccgggctcggacgaaacgggccataacggacgngng

SEQ ID NO: 406993 - DNA, 700 bp, Homo sapiens
  misc_feature: GZ8MTXP02IMIWK.52.34.D01.1.454.CMB.2.raw
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccgagggaaggggctggagtgggtctcatttatcagtggtactggtggtagcacatactacgcagactccgtgaacgggccgttcaccatctacaaagacaattccaagacacgctgtatttaacaaatgaacagcctgagagccgaggacacggccgtatatactgtgtagaaagatctccacgtctccgtcccccttgactggtttacttcccgactccgtcggggaccacggaaccctagtcgtccgtctcctcacgccctaccgaacccgaacgggccctacgttcccgggtccttccccccgtgggaccccacccccttccctacccgaaagaccgtcccgacccgttcgggacgggggcccaaccgaccgggcccgggtccccgtcgggggtcctacggtcccgttacgggtaccgtaaaccgggtacctaaccccgtttacccggaacgggttcggaaccgggttcgccggttagaaaccggttcggtaccgttaacggaacccgtacggggtacccgtacggtaccgtaccggtcctaccg

SEQ ID NO: 406994 - DNA, 680 bp, Homo sapiens
  misc_feature: GZ8MTXP02JZBVT.52.34.D01.1.454.CMB.2.raw
  modified_base (265)..(265): a, c, t, g, unknown or other
  modified_base (330)..(330): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctaccaaagacaattccaagaacncgctgtattacaaatgaacagcctgagacgccgaggacacggccgtatattactgtgtagaaagntcctccgacgtctccgtcccccttggactggttattccgactcgtcggggccagggaccctagtcgcccgttctcctcacgccctacccaaccgaacggggcccaacgttcccgggtcccttcccccgtcggaccccaccccctacccgttacccgaaacgtaccgaccctaacccgtccggtacgggggcccaaaccgcggtcccgggtccccgtcgggtccgtcggtacccgttgggtaccgtaaacggtaacccgttacctttacccgtaacgttacggaacttccggcgttacggacggacggggttccggtaacgggaccggaacggcgtacgtacgtacgcgcg

SEQ ID NO: 406995 - DNA, 584 bp, Homo sapiens
  misc_feature: GZ8MTXP02HTG6Q.52.34.D01.1.454.CMB.2.raw
  modified_base (338)..(338): a, c, t, g, unknown or other
  modified_base (490)..(490): a, c, t, g, unknown or other
  modified_base (522)..(522): a, c, t, g, unknown or other
  modified_base (548)..(548): a, c, t, g, unknown or other
  modified_base (568)..(568): a, c, t, g, unknown or other
  modified_base (579)..(579): a, c, t, g, unknown or other
  modified_base (581)..(581): a, c, t, g, unknown or other
  modified_base (583)..(584): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaaggggctgggagtgggtctcatttatcagtggtactggtggtagcacatactacgcagactccgtgaagggccgttcaccatctaccaaagacaattccaaagaacacgctagttaacttacaaatgaacagcctgagacgcgaggacacggccgtatattactgtgtacgaaaagntcctccacgttcctccgcccccttggtacctggttatttcccgactccgtggggaccgaggaaccctagtcgccgtcctcctcactccctaccacccgaacggcccagtccggtccccttcccccgtggcccacccctcctaccaaacggcncaccgtgtcggggcacgcgccggccgtgggcncgccgtgacaggacctcgttacctanacactcgactgacgcggtgngacaggcgtanancnn

SEQ ID NO: 406996 - DNA, 741 bp, Homo sapiens
  misc_feature: GZ8MTXP02JIZDR.52.34.D01.1.454.CMB.2.raw
  modified_base (284)..(284): a, c, t, g, unknown or other
  modified_base (521)..(521): a, c, t, g, unknown or other
tcagcgcagtacgacacgaccggtgctcgatttagatcgtctgtgttgggtttggggaggcttggtaaagcgggggggtatctgagactctcctgttcagtctctggattcaccttaaataactatggcatgagctgggtccgccaggctccagggaagggctggagtgggtctcatttatcagtggtactggtggtagcacatactacgcagactccgtggaacgggccggttcaccatctaccaaagacaattccaagacacgctagtattacaaatgaacngctgagacgacgagacacgtcgtatatacgtgtgagaagactccaccgtacgttccgtccccggtcccccgttaggtacgttacggtttacttaccgtacccgtccggtacgggaccgtaacggtaacccgttagtccggtccgttcctccgtacaccgccctacccgaaccggaaccgccctacgtcccggtcccttcccccgtggaccccctacccgtcctacccgaagggaccncccgtaaccgttcggggacgggggacccaacgaccgggacccgggtcccggttcggggcctaccggtcccgtttacggaaacgtaaacccgggttccttaacccgtttaaccgtaacgtttacggaaaccgtttcccggtaagtccgggtaacggggccccgggttgtaaacccggggaacgtaaacccggggcccgggaacttacggtaaacggcgtcg

SEQ ID NO: 406997 - DNA, 710 bp, Homo sapiens
  misc_feature: GZ8MTXP02GSBJY.52.34.D01.1.454.CMB.2.raw
  modified_base (187)..(187): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaaggggctggagtgggtctcattttancagtggtactgggtggtagcacatactacgcagactccgtaggaacgggtccgttcaccatctaccaaagacaattccaaagaacacgctagtattaacaaatgaacagctgagacgacggagacgacggtacgtatattacgtgtagtaagaaagtctcctaccgtaccgtcctcccgtcccccgttaggtaccgttggtttacttccccgtccgtccgggtcggggaccgaacgggtaaccctaggtccgtccgtactcctacgaccgccctaccgaacccgaaacgggccctacggttcccgttacccccgttcccccgcgtaccctacccccgtacctaacccgaacgaccgcccgtacccgtcggggtaaccgggggccaacgccgggcccggtcccggtcggtctccggcgttacgggaccaacggtacccttacccgttaccgtaacgtacggtacgtccggtacgtacgggaccgttcggacggtaacgaccggaacggacctagacgtcgctcg

SEQ ID NO: 406998 - DNA, 639 bp, Homo sapiens
  misc_feature: GZ8MTXP02J0S0Q.52.34.D01.1.454.CMB.2.raw
  modified_base (235)..(235): a, c, t, g, unknown or other
  modified_base (330)..(330): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccaggggaaggggctggagtgggtctcatttatcagtggtactgggtgtagcacatactacgcagactcgtgaagggccgttnaccatctacaaagacaattccaagacacgctgtattacaaatgaacagcctgagacgccgaggacacggccgtaatattactgtgtagaaaacgntcctccacgtctccgccccttgacctggttattccgactccgtggggccagggaccctagtcgccgtctcctcacgccctaccaacccgaacgggcccagtcccggtcccttcccccgtcgccctaacccctcctacccgaacgacgtacctaccgtcgtcgggggcaacgcggccggcccgtgggccttcggccccgtggtaccaagggtacctaaccgttcccgaaacggtcgacggtccggttacgacggaacggtcggtaccggttaacggaccggacgggacccgtagtacgtacggtactccg

SEQ ID NO: 406999 - DNA, 771 bp, Homo sapiens
  misc_feature: GZ8MTXP02I09I1.52.34.D01.1.454.CMB.2.raw
  modified_base (290)..(290): a, c, t, g, unknown or other
  modified_base (292)..(292): a, c, t, g, unknown or other
  modified_base (770)..(771): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccgagggaaggggctggagtgggtctcatttatcagtggtactggtgtagcacatactacgcagactccgtgaacgggccgttcaccatctaccaaagacaacttccaaagaacacgctagtaatttaacaaatgaacncnctagagacgacgagacgacggtaccgtattatacgtgtagtaagaaagtctcctacccgtaccgttcccgtccccgtaccccccggttaggttaccgttacggttttaccgtttaccccgtaccccgttcccggggtacggggaccccggtaaacccgggtaaaccccgttaacgggtccgtcccccgttccctcccgtaccgacccgtcccctaccccgaaccggtaaacccgggcccttaccggtttccccgtcccccttccccccggtcgtaccccctacccccgttacccaccgaaacgccgtcccgtaacccgggttccggggtaccgggggacccaaccggcccgggtcccgggtcccggttcggggccctaacggtccggtaacggtaacgtaacggtacctttacccgttactacgtaaacgtcgtccgaggtcggacggcggtacggaagaccggacgccgatacgcgnn

SEQ ID NO: 407000 - DNA, 745 bp, Homo sapiens
  misc_feature: GZ8MTXP02GSRSA.52.34.D01.1.454.CMB.2.raw
  modified_base (187)..(187): a, c, t, g, unknown or other
  modified_base (344)..(344): a, c, t, g, unknown or other
tcagcgcagtacgacacgaccggtgctcgatttagatcgtctgtgttgggtttgggggaggcttggtaaagcggggggggtatctgagactctcctgttcagtctctggattcaaccttaaataactatggcatgagctgggtccgccaggctccgaggggaaggggctggagtgggtctcatttancagtggtactggtggtagcacatactacgcagacctccggtaggaacgggtccgttcaccatcctaccaaagacaattaccaaagaacacgcttagtaatttaacaaatgaacagcctagagacgccgagaccgacgactatatactgtagtagaanctcctccacgtcctccgtccccgtagtacgttacggtttacttccccgacgttccggtacggggaccgtaaacgggtaacccttaggtaccggtcccgttacctaccgtaccgaccgtaccccgtaccgaaacccggtaacccggggacccttaaccggtttcccgggttcccccctttacccccggacgtaccccctaacccccgttaccctaaccgaaacgacccgtccctaaacccggttcggggaccgggggacaaccgtcgggccccggggtcccgtcggggtccctccggtaccgttcgggaaacgtaaccggtacccttaacccgttccgtaaacgtcgtacggtcgtcggtacgacggtccgacgtaacgacggacgtaccagtacgctcacg

SEQ ID NO: 407001 - DNA, 569 bp, Homo sapiens
  misc_feature: GZ8MTXP02IWVJQ.52.34.D01.1.454.CMB.2.raw
  modified_base (284)..(284): a, c, t, g, unknown or other
  modified_base (482)..(482): a, c, t, g, unknown or other
  modified_base (551)..(551): a, c, t, g, unknown or other
  modified_base (563)..(563): a, c, t, g, unknown or other
  modified_base (568)..(569): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccggttcaccatctccaaagacaattccaagacacgctgtatttacaaatgaacancctgagagccgaggacacggccgtatattactgtgtagaaaagatctccacgtctccgtccccctgacctggttatttccgactccgtggggccacgggaaccctagtcgccgtctcctcacgccctccaccaacgggcccagtccgtccttcccccgtgccacccctcctccaagacgcacctccgtgggggccacncggcggccccgtggggcctggcctggtctaaacggctacgttcctataccgtactcgctgacggtcggntggcgaaggccnatcgnn

SEQ ID NO: 407002 - DNA, 924 bp, Homo sapiens
  misc_feature: GZ8MTXP02JC6EX.52.34.D01.1.454.CMB.2.raw
  modified_base (187)..(187): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccaggggaaggggctgggagtgggtctctatttancagtggtactggtggtagcacatactacgcagactccgtggaacgggccggttcaccatcctacaaagactaattaccaaagaacacgtctagtaatttaacaaatagaacagcctagagacggccgaggacacggccgtaattacttacgtggtacgtagaaaagtcttacctccctacccggttcctcccggtccccccgtttgggtaccgtttggttttaactttcccgtaccctccggttcggggaccccgtaacggggtaaacccccttaggtaccggtcccgttccgtcccttacgaccgtcccctaccgaacccgaaccgggtcccccacgttcccggtcccctttcccccgtcgggtaccccctaacccccttccccgtacccgaaacggtacccgacccgtaccccgttacccggggttaccggggggaccctaacccgggtaaccggggccccccggggtacccccgggttccgggggacccggttacccgggtcccccgggttacggggttaaaccccggtaaaccggggtttaaacccccggttaacccccggtttaacccccggttacccgggttaaacccgggtaacccggttccgggttaccgggttacggggtaaaacccggggtttcccgggttacccggtttaaccggggtaacccgggaaaacccgggggttaccccggtacggtttaaaacccggaccggggttcctttaaccccgg

SEQ ID NO: 407003 - DNA, 707 bp, Homo sapiens
  misc_feature: GZ8MTXP02GQQ29.52.34.D01.1.454.CMB.2.raw
  modified_base (184)..(184): a, c, t, g, unknown or other
  modified_base (202)..(202): a, c, t, g, unknown or other
  modified_base (330)..(330): a, c, t, g, unknown or other
  modified_base (706)..(706): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttancagtggtactggtggtancacatactacgcagactccgtgaagggccgttcaccatctaccaaagacaattccaagaacacgcttagtaatttaacaaatgaaacagcctgagacgccgaggacacggccgtatatacgtgtgtanaaagatcctccaccgtctccgtcccccttgactggtttacttccgactccgtcggggaccacggggaaccccttagtaccgtcccgtctccctacaccgtccctacccacccgaaacggggccccctaacgttcccgggttccccctttcccccccggttggaccccctacccccttcccgtaaccccaaacggaaccgccctaacccgttccgggtagggggaccccaacgacgggtccccgggtcccgtcggggtcctcggacccgtcggttaaccaacggtaccttaaccgtttcctaacgttacgacgtccgtaccgtgggaaaccggtcgggaccgttggggaaccgaacggggccgactaacgtacggcng

SEQ ID NO: 407004 - DNA, 687 bp, Homo sapiens
  misc_feature: GZ8MTXP02FQDZV.52.34.D01.1.454.CMB.2.raw
  modified_base (285)..(285): a, c, t, g, unknown or other
  modified_base (290)..(290): a, c, t, g, unknown or other
  modified_base (328)..(328): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccaggggaaggggctggagtgggtctctatttatcagtggtactggtggtagcacatactacgcagactccgtggaagggccggttcaccatctaccaaagacaattccaagaccacgtctgtattaacaatnaacanctgagagccgagacgacgcgtatatactgtagtagaanatctccacgtcctcccgtcccccttggtacgttgtttacttcccgtaccgtccggtcgggaccgaacgggtacccttagtccgtccgtcctccgtaccaccgccctacccaacccgaaccgggtccctacgttcccgggttcccccttacccccgttcgaccccctaccccgttaccaacccgaagaccgacctcccggtccggcgggggaccaacggccggtcccggggtcccgtcggggcctcggacgtcggtacgaaccggttaccttacccgttacccggtaaccggtggtaccgtcggacggttaggaacggtccgttacgccgacgaaccgggacccgtgaaccgtcgtctcc

SEQ ID NO: 407005 - DNA, 596 bp, Homo sapiens
  misc_feature: GZ8MTXP02G5I5W.52.34.D01.1.454.CMB.2.raw
  modified_base (287)..(287): a, c, t, g, unknown or other
  modified_base (292)..(292): a, c, t, g, unknown or other
  modified_base (328)..(328): a, c, t, g, unknown or other
  modified_base (474)..(474): a, c, t, g, unknown or other
  modified_base (595)..(596): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgagggaaggggctgggagtgggtctcatttatcagtggtactggtggtagcacatactacgcagactccgtagaacgggccgttcaccatctaccaaagacaattaccaagaacacgctagtattaacaaatnaacanctgagagcgagacacgcgtatatactgtgtagaaantcctccacgtcctccgtcccccttggtactggtttacttccccgactccgtcgggaccgaacggaaccctagtcgccgtctcctcacgcctaccaccgacgccctacgtccgtccctcccgtcgcccacccctcctaccaagaccnccaccgtcgaggggcacgcgcccggccgcgggtctcgccgtacgtacgaaacggtacttaccgttactacgtacgacgtccgcgtaggacggccggacgtggacgaacggccgagatacgnn

SEQ ID NO: 407006 - DNA, 663 bp, Homo sapiens
  misc_feature: GZ8MTXP02GBOF8.52.34.D01.1.454.CMB.2.raw
  modified_base (144)..(144): a, c, t, g, unknown or other
  modified_base (200)..(200): a, c, t, g, unknown or other
  modified_base (322)..(322): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccnccaggctccagggaagggctggagtgggtctcatttatcagtggtactggtggtancacatactacgcagactccgtgaaggccgttcacatctaccaaagacaatccaagaacacgctagtattaacaatgaacagcctgagagccgaggacacggcgtatatactgtgtagaaagntctaccacgtctccgtcccccttaggtacttggtttaactttcccgaccgttccgtacggggtccaacggggaaccccttagtacggcccgtctacctcgacgtccctaccgacgaacgggccctagtccggtcccttacccccgtgtcccaccccttcccacgaaacgacgcctaacccgttcggacggggcaaccgacggcccggtcccgcggggtcctcggtacccgttagggaccaaacgggtaccttacccttaccccgtaagtaaacccggtagttacccggacgtacggacgtcggtacgtaacggaccgaacggacgtacgacgtacgacgcg

SEQ ID NO: 407007 - DNA, 799 bp, Homo sapiens
  misc_feature: GZ8MTXP02JQW8Q.52.34.D01.1.454.CMB.2.raw
  modified_base (206)..(206): a, c, t, g, unknown or other
  modified_base (285)..(285): a, c, t, g, unknown or other
  modified_base (294)..(294): a, c, t, g, unknown or other
  modified_base (798)..(798): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgagggaaggggctggagtgggtctcatttatcagtggtactggtggtagcanatactacgcagactccggtaggaacgggtccgttcaccatcctaccaaagacaatccaagaacacgctagttaacttanaaatgaacngctagagacgcgagacacgcgtatattactgtgtagaaagtactcctaccacgtcctccgtccccttaggtaccttagggtttaactttcccggaccttcccggtacggggaaccccgtaaacggggtaaaccccttaggtaccgggtccccgtttaccgttacccgttaccgacccggttaccccttaaccccggaaacccggtaaaccgggggtccccctaacgtttccccggggttaccccctttccccccggtacccgggtcccctaaccccccgttaccccgtaacccgtaaacggacccgtacccgtaaccccggttccggggtaccgggggaccaacggacccgggtccccgggtacccgtcggggcccgttcggcccggttacgggtaaccgaacgggttacccttaaaccgtttaccgtaacgttaaccgtacgtccggtacgttacgggaccgggccggttcgaacgggacgtaacggccgagtacgtacgcgng

SEQ ID NO: 407008 - DNA, 597 bp, Homo sapiens
  misc_feature: GZ8MTXP02JU0LB.52.34.D01.1.454.CMB.2.raw
  modified_base (284)..(284): a, c, t, g, unknown or other
  modified_base (595)..(597): a, c, t, g, unknown or other
tcagcgcagtacgacacgaccggtgctcgatttagatcgtctgtgttgggtttgggggaggcttggtaaagcggggggggtatctgagactctcctgttcagtctcgggattcaccttaaataactatggcatgagctgggtccgccaggctccgaggggaaggggctgggagtgggtctcatttatcagtggtactggtggtagcacatactacgcagactcgtgaagggccggttcaccatctaccaaagacaattccaagaacacgctgtattacaaaatnaacagctgagagccgaggacacggcgtatattactgtgtagaagatctccacgtcctccgtccccttggactggttactttcgacccttccgtggggcccacggggaaccctaggtacgtcccgtctccctcacgcctcccaaccgacgggcccacgtcccggttccttcccccgtggcccacccctcccgtccaacgacgccaccgtcgcgggggcacgacggcgcccgtgggcctcgccgttggacaagggtaccttacttccctaagtaccgtatcgcgtggacgcgggcgcggcgacgcgacagcgnnn

SEQ ID NO: 407009 - DNA, 621 bp, Homo sapiens
  misc_feature: GZ8MTXP02IMADY.52.34.D01.1.454.CMB.2.raw
  modified_base (257)..(257): a, c, t, g, unknown or other
  modified_base (277)..(277): a, c, t, g, unknown or other
  modified_base (620)..(620): a, c, t, g, unknown or other
tcagcgcagtacgacacgaccggtgctcgatttagatcgtctgtgttgggtttggggaggcttggtaaagcgggggggtatctgagactctcctgttcagtctctggattcaccttaaataactatggcatgagctgggtccgccaggctccagggaagggctggagtgggtctcatttatcagtggtactggtggtagcacatactacgcagactccgtgaagggtccgttcacatctacaaagacattcaagacncgctatattacaaatgaacngcctgagagccgaggacacggccgtatacgttactgtgtagaaaactatcctacccagtccctccgcccccgttgactcggtttatttcccgacttccgtggggaccaggggtaaccccctagtccgaccgttcctcctcgaccgccctaccaccgaaccggcccacgtccgtccttccccgtcgacccacccgtccctaccaacgcgacctaccgtcgtcggggacacaccggccgggtccctcggggccttcggccgtcggtaccgaacggtacctaacgtttccaagttaccgacgttcgcgtacgacgtcggacgtcgacgacgggcctacgactacgnc

SEQ ID NO: 407010 - DNA, 601 bp, Homo sapiens
  misc_feature: GZ8MTXP02JH00E.52.34.D01.1.454.CMB.2.raw
  modified_base (187)..(187): a, c, t, g, unknown or other
  modified_base (304)..(304): a, c, t, g, unknown or other
  modified_base (337)..(337): a, c, t, g, unknown or other
  modified_base (450)..(450): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaaggggctgggagtgggtctcatttancagtggtactggtggtagcacatactacgcagactcgtgaagggccgttcaccatctacaaagacaattccaagaacacgctagtattaacaaatgaacagctgagacgcgaggacncggcgtatatatgtgagaaagctctccacgtcnccgtccccgtgtactggtttacttccgaccttccggtcgggaccgaacggggtaaccctggtacgtcccgtctcctcgacgcctaccaccgacggcctagtccgtcctcccgngccctaccctcctaccgaagtcgcctaccgtcggtcggggcacgcggccggcgtcggctcgcgtcggtacacgtacttacccgtacgtacgtgtaccgtcgcggttacgacggtccgtacgtcggacgtacggaccctaagtcgcgtctcg

SEQ ID NO: 407011 - DNA, 609 bp, Homo sapiens
  misc_feature: GZ8MTXP02F3CP7.52.34.D01.1.454.CMB.2.raw
  modified_base (183)..(183): a, c, t, g, unknown or other
  modified_base (201)..(201): a, c, t, g, unknown or other
  modified_base (608)..(609): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttancagtggtactggtggtancacatactacgcagactccgtgaagggccgttcaccatctaccaaagacaattccaaagaacacgctgtatttaacaaatgaacagcctgagagccgaggacacggccgtatattactgtgtagaaagatctccacgtctaccgtcccccttgcttgttattccgactccgtgggaccagggaaccctagtcgccgtcctcctccgacgtccctaccaaccgtaaaccggccctacgttcccggtcccttcccccgtggcccctacccctcccgtaccaacgacgacctacctcggtcgggggcaaccgcggccggcccgtggtcgtcgcccgtgtacgaacggtactaccttacctataaccggctcgcgtacgacggcggacgcggacgaacggcgacgagacgnn

SEQ ID NO: 407012 - DNA, 651 bp, Homo sapiens
  misc_feature: GZ8MTXP02FJH88.52.34.D01.1.454.CMB.2.raw
  modified_base (202)..(202): a, c, t, g, unknown or other
  modified_base (374)..(374): a, c, t, g, unknown or other
  modified_base (444)..(444): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtancacatactacgcagactccgtgaaggccgttcaccatctaccaaagacaattccaaagaacacgctagtatttacaaatgaacagcctgagagccgaggacacggccgtatattactgtgtagaaagatctaccacgtctccgtccccttgacttgtttattccgactccgnggggccacgggaccctagtcgccgtctcctcagccctcaccgaacggcccagtccggttccttcccccgnggtacccaccccttccctaccgtaacgacgcccgaaccttccggtacgggggaccaaccgtacgggcccgggtccccgtggggtccctacggtccgtcgggtacaaacgggtaccttaacccgtttaccgtaaagttaccgtactccggacgttcgggaacggtccgggtacgtcggacgaacgggtacccgctaaacgtaggcgcg

SEQ ID NO: 407013 - DNA, 670 bp, Homo sapiens
  misc_feature: GZ8MTXP02G8PHY.52.34.D01.1.454.CMB.2.raw
  modified_base (444)..(444): a, c, t, g, unknown or other
  modified_base (487)..(487): a, c, t, g, unknown or other
  modified_base (669)..(669): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccgaggggaaggggctgggagtgggtctcatttatcagtggtactggtggtagcacatactacgcagacctccgtgaagggtccgttcaccatcctaaccaaagacaacttaccaaagaacacgctagttaatttaacaaatagaacagccgtagagacgaccggaaggaccgacggtaccgtatattacgtgtagtagaagtactctccaccgtctcccgtccccgtgtacgtggtttactcccgtacgtccgtcggggccgaacggtaaccgtagtcgccgtactcctcnccgaccctccgaaccgaccgtccctacgtccgtccctccccgngcccaccctccacgaaacgcgcctaccgtcggacggggcctacgaccggcccgggtccgtcgggtcctaccggtcccgtagggtcccgtaaacggtacccttacccggttaccgtaacgtcggtaccgtcggcgtacgggaccggtcgggtccaagggaaccgtacggaccgcgtaagcgcnc

SEQ ID NO: 407014 - DNA, 667 bp, Homo sapiens
  misc_feature: GZ8MTXP02G3SP6.52.34.D01.1.454.CMB.2.raw
  modified_base (230)..(230): a, c, t, g, unknown or other
  modified_base (249)..(249): a, c, t, g, unknown or other
tcagcgcagtacgacacgaccggtgctcgatttagatcgtctgtgttgggtttgggggctgtgggtccaggaggcagaactctgggtgtctcaccatggcctggatccctctacttcctccccctcctcactctctgcacaggctctgaggcctcctatgagctgacacacgcccacccgtggtgtcagtcgtccccaggacagacggccaggatcacctgctcgtgganatgctagtcgaccaaacgntatcgtcttattcggtacagacaaggacggcccggaccaccggtcccctggttggttggtagtattacgtaaagtaaacgactacgtaggacggacggtcccgtacgacggggtacctccgtaggacgtaccgtacttccgtcgtcggccgttaccggaggtacccgggaacgggtaaccgtaaccgggtactaaccgttacgttaccgggacctacgtagtacggtggaccgtaccgaggacgagggaacgacggagaccgtagtacttaagtttatacgtacaaactacgaacgaacgacctactagttacgttattacgtcgttacgtacgacgttcgacccgtaacggtcggtaccgtaccgtccgtacggaaccgaccgtaacccgaccggaccccaaccgtactcgtaaccc

SEQ ID NO: 407015 - DNA, 619 bp, Homo sapiens
  misc_feature: GZ8MTXP02INS96.52.34.D01.1.454.CMB.2.raw
  modified_base (617)..(617): a, c, t, g, unknown or other
  modified_base (619)..(619): a, c, t, g, unknown or other
tcagcgcagtacgacacgaccggtgctcgatttagatcgtctgtgttgggtttgggggaggcttggtaaagcgggggggtatctgagactctcctgttcagtctctggattcaccttaaataactatggcatgagctgggtccgccaggctccgagggaaggggctggagtgggtctcatttatcagtggtactggtggtagcacatactacgcagactccgtgaagggccgttcaccatctaccaaagacaattaccaagaacacgctgttattaacaaatgaacagcctgagagccgaggacacggccgtatattactgtgtagaaggatctccctacgtcctccgtcccccttgacttggttactttccgacctccgtcggggccacgggaacccttagtgccgttctcctccacgcctccaaccgacggccacgtccgtccttcccccgtgcccacccctcctccaacgacgcctaccctcggtaccgggggacctaccgaggcccgggccccgtcggggcctacggtccgttacggtccgaaaacgggtctaccgtttacctacgtacggactcgactcgacggcggtcgcgcgaacggcgtacgagtacgngn

SEQ ID NO: 407016 - DNA, 684 bp, Homo sapiens
  misc_feature: GZ8MTXP02HU37P.52.34.D01.1.454.CMB.2.raw
  modified_base (540)..(540): a, c, t, g, unknown or other
  modified_base (646)..(646): a, c, t, g, unknown or other
  modified_base (683)..(684): a, c, t, g, unknown or other
tcagcgcagtacgacacgaccggtgctcgatttagatcgtctgtgttgggtttgggggaggcttggtaaagcggggggggtatctgagactctcctgttcagtctctggattcaccttaaataactatggcatgagctgggtccgccaggctccagggaaggggctggagtgggtctcatttatcagtggtactggtggtagcacatactacgcagactccgtggaagggccgttcaccatcctaccaaagacaacttcaaagaacacgctagttattacaaatgaacagctgagagaccgaggacacggccgtatattaacgtgtagtagaaagtactcctaccacgttccctcccggtcccccgttaggtacctttagggtttactttcccccggaccgttcccggtcggggacccgaacggggtaaacccctaggtccggcccgttacctccctccgacgccccctaccgaaccggaaccgggccctaccgttcccgttccctcccccgtgcccctaccccttccacccaaggaccnccgtaccgttcggtccggggacaccgcggcccgggtcccgtgggcctacggccgtacggtaccgaaaggtacccttacgttacctaagtaccgtaactccggtacncgggacggcgggtcaagggcgaacggcctagactcgnn

SEQ ID NO: 407017 - DNA, 541 bp, Homo sapiens
  misc_feature: GZ8MTXP01D5FUR.10.34.D01.1.454.CMB.2.raw
  modified_base (417)..(417): a, c, t, g, unknown or other
  modified_base (433)..(433): a, c, t, g, unknown or other
  modified_base (439)..(439): a, c, t, g, unknown or other
  modified_base (445)..(445): a, c, t, g, unknown or other
  modified_base (448)..(448): a, c, t, g, unknown or other
  modified_base (451)..(451): a, c, t, g, unknown or other
  modified_base (453)..(453): a, c, t, g, unknown or other
  modified_base (455)..(455): a, c, t, g, unknown or other
  modified_base (457)..(457): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaagtgtccagtgtgaggtgcagctggtggagtcgtgggggagtcttaggtaaagccgtgggggtcccttagactctcctgtgcagcctctggattcactttcaagtaacgcctggatgaacgtgggtccgccaggcctccgaggggaagggcgtggaggtgggtgcaataataaaatcaaagctagagtcggtagggaacaagagagacacgctgaccacccgtagaaagcagatcagcatcanagagatagatacaaanaacgangtagtntanaananananacgacgaacgaaacgagacacacgaacgtagttatacgttgtcgaccacgacgacgaacgtattaagttgttgttagtgttgtg

SEQ ID NO: 407018 - DNA, 549 bp, Homo sapiens
  misc_feature: GZ8MTXP01E3OTC.10.34.D01.1.454.CMB.2.raw
  modified_base (348)..(348): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtggggggtcccttagactctcctgtgcagcctctggattcactttcagtaacgcctggatgaactgggtccgccaggctccgaggggaagggcgtggagtgggttgccataattaaancaaagctgagtggtagggacaacgagagcacgctgcacccgtgaaaggcaagatacagcatctacaagagatagaattaacaaaagtacgactagtactctagaacatagaacacgactaagaaacgagacacagcgtgttatacgttgtcgccacgttcgacggtaacctattaacgttgtcttagtaagttcggtaacg

SEQ ID NO: 407019 - DNA, 558 bp, Homo sapiens
  misc_feature: GZ8MTXP01DLTXS.10.34.D01.1.454.CMB.2.raw
  modified_base (302)..(302): a, c, t, g, unknown or other
  modified_base (507)..(507): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccattgagtttgggctgagctggattttccttgctgctattttaaaaggtgtccagtgtgaggtgcagctggtggagtcgtgggggaggcttggtaaagccgtgggggtcccttagactctcctgtgcagcctctggattcactttcagtaacgcctggatgaactgggtccncaggctccgagggagggctgggagtgggttgccaataataaatcaaagctagatggtgggacaacagagcacgctgccacccgtagaaaggcagacttcagcatctacaagagatagtaattaacaaaaagtacgtactagtatactagaaacatagaacagaccgtaagaaaccggaggaccacgacgccgtagttattaacgngtcgccacgttcgaacgtaaccgtattaagttgtattgtaagttggtaacg

SEQ ID NO: 407020 - DNA, 726 bp, Homo sapiens
  misc_feature: GZ8MTXP01EJ3R9.10.34.D01.1.454.CMB.2.raw
  modified_base (315)..(315): a, c, t, g, unknown or other
  modified_base (501)..(501): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggtatttttccttgctgcttaattttaaaaggtgtccagtgtgaggtgcagcgtggtggaggtcgtgggggagtcgttaggtaaacggccgtcgggggtcccttagactctcctgtgcagcctctgacttcacttcagtaacgcctaggatcgaacgtcgggtccnccgaggccgtaccggagggggaacgggcgtagggagggttggggttcggacctaagttaaatttaaaaacgtaccgaaaagtcgtaggagtggggtacgggaaacaaacgaggacgaaccgaacggctacgacccgaacccggtaaggaaaacggcgaagtacttacgacgtacaactaccgtaanaaaggtaaagtaagttaaggaaactttaaaaccgaaaaaacgttaccgtacgttagttaaacttacgtaaggaaaacctagtaaacgaaaccgtaacggaaaccggtaaaacggaaaacgggtaaccggaaacgaaaccgaacggtaaccgttaaggttaacttacgttacgcgaaccttacgttcgaacgtaactattaagttgtcgttagtaagttcggtaag

SEQ ID NO: 407021 - DNA, 573 bp, Homo sapiens
  misc_feature: GZ8MTXP01EAJWG.10.34.D01.1.454.CMB.2.raw
  modified_base (303)..(303): a, c, t, g, unknown or other
  modified_base (340)..(340): a, c, t, g, unknown or other
  modified_base (349)..(349): a, c, t, g, unknown or other
  modified_base (353)..(353): a, c, t, g, unknown or other
  modified_base (363)..(363): a, c, t, g, unknown or other
  modified_base (393)..(393): a, c, t, g, unknown or other
  modified_base (406)..(406): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggtattttccttgctgcttaattttaaaaggtgtccagtgtgaggtgcagcgtggtggagtcgtgggggaggcgttaggtaaagccgtgggggtcccttagactctcctgtgcagcctctgattcactttcagtacgctggatgaactggtccncaggctcgagggaggctggagtggtgacataataaancaagctagngtgnggacagagancacgctgacctaccgagaaacgcagatcanacatacagaaganatagtaataaacgaaagtcacttagtagtactaagaacaagtacgaaacgacgaacgtaaaggaaacggacgaacacgacgtaacgtagttacgttacgttcgtaccgaaccttacgttcggaacgtaactagtttaacgtttacgtgttaggtaacgttcggtaag

SEQ ID NO: 407022 - DNA, 596 bp, Homo sapiens
  misc_feature: GZ8MTXP01CKSTB.10.34.D01.1.454.CMB.2.raw
  modified_base (313)..(313): a, c, t, g, unknown or other
  modified_base (332)..(332): a, c, t, g, unknown or other
  modified_base (529)..(529): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggatttccttgctgctatttaaaggtgtccagtgtgaggtgcagctggtggagtcgtgggggaggcttggtaaagccgtggggggtcccttagactctcctgtgcagcctctgattcacttcagtaacgcctggatgactggtccgcaggctcgagggagggcnggagtgggtgcatataaancaaagctgagtggtaggacaacgagagcacgctgccacccgtgaaagcagatcagcatctacaagagtatagaacttaacgaaaaagtccgattaggttaatcgttaacggaaacctagtaacgaaaccacggtacccgtaaagggaaaaccgggtacgggaaccacaacgggtaacccgttagttactttaaccgngttaccgaccgttaccgttcggaacggtaacccgtaatttgttcgttcgagtaagttcggttaaccg

SEQ ID NO: 407023 - DNA, 683 bp, Homo sapiens
  misc_feature: GZ8MTXP01ENMLA.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgcttaattttaaaaggtgtccagtgtgaggtgcagctggtggaggtcgtgggggaggcgttaggtaaagccgtggggggtcccttagactctcctgtgcagcctctggattctacttcagtaacgcctggatgaacgtcgggtcccgccgaggctccggaggggacgggcgtgggagtgggtggacctaattaaattaaaagtacaaaagtctaggtagtgggtaggaacaacgagacgacacgctagaccgacccgtaggaaacggtcgaagtacttacgaagtctaactactaacgaaaggtaagtaaattaggtaaacttaaacgaaaaaacgtacgtaacgttagttaactacgttaagaaaccaagtacgaaaactacggaaccgtaaacgggaaaacggaacgaaccaacgtaacggtaaccggttaagttacttacgttcgtacgtacccgttaacgttacgaaccggtaaccgtatttaacggttcgttacgttaggtaacgttgggtaacg

SEQ ID NO: 407024 - DNA, 612 bp, Homo sapiens
  misc_feature: GZ8MTXP01AJ1O9.10.34.D01.1.454.CMB.2.raw
  modified_base (353)..(353): a, c, t, g, unknown or other
  modified_base (385)..(385): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggtattttccttgctgcttattttaaaaggtgtccagtgtgaggtgcagctggtggagtcgtgggggaggcttaggtaaagccgtgggggtcccttagactctcctgtgcagcctctgattcactttcagtaacgcctggatgaactcgggtccgccgaggctccgaggggagggcgtggaggtgggttgccaattaattaaancaaagctgagtggaggacaacgagagcacgcngccaccgtagaaagcagactcagcatctacaagagatagaacttaacgaaaagtcgtactagtactcgtaagaaactaacgtagaaacgtacgaccgaaagggaaaacggtaaggaaccaacgtacggtaacccgttagttaacgttacgttacggtactacccgttacgttaccgaacgggtaacccgtagttaagtttacggttcgttagtaacgttgggtaacg

SEQ ID NO: 407025 - DNA, 555 bp, Homo sapiens
  misc_feature: GZ8MTXP01DOD6W.10.34.D01.1.454.CMB.2.raw
  modified_base (345)..(345): a, c, t, g, unknown or other
  modified_base (368)..(368): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgcttattttaaaaggtgtccagtgtgaggtgcagctggtggagtcgtggggggaggcgttaggtaaagccgtgggggtcccttagactctcctgtgcagcctctgattcacttcagtacgctggatgaactggtccgccaggctccgaggggagggctgggagtgggtgcattaataaatnaaagctgatggaggacaacaganccacgctgcccacccgtagaaagcaagacttcagctatctacaaagagatagaattaacaaaagtacgactagtatactagaaacagtagaacagaccgtaaaggaaaacggagaacacgagccgtagttattacttgtcgccacgttcaacggaacctataacgtttgtcttgtaagttcggtaag

SEQ ID NO: 407026 - DNA, 548 bp, Homo sapiens
  misc_feature: GZ8MTXP01AX6TH.10.34.D01.1.454.CMB.2.raw
  modified_base (299)..(299): a, c, t, g, unknown or other
  modified_base (335)..(336): a, c, t, g, unknown or other
  modified_base (340)..(341): a, c, t, g, unknown or other
  modified_base (348)..(348): a, c, t, g, unknown or other
  modified_base (354)..(354): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagcgtgggggtcccttagactctcctgtgcagcctctggattcacttcagtaacgcctggatgaactgggtccncgaggctcgagggaggctggagtggtgcatataaannaagnngatcggnggacanagagacacgctgcacccgtagaaggcagatcagcatcacaagaagatagaattaacaaaagtacgacttagtatactagaaacagtacgaactagaccgtaaggaaacggacgaacacgagccgtagttattacttcgtacgtaccgacttcgacggaaccgtattaagtttcggtacttgtaagttggtaacg

SEQ ID NO: 407027 - DNA, 666 bp, Homo sapiens
  misc_feature: GZ8MTXP01ECUM0.10.34.D01.1.454.CMB.2.raw
  modified_base (305)..(305): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggtattttccttgctgacttattttaaaaggtgtccagtgtgaggtgcagcgtggtggagtcgtggggagcgttaggtaagccgtgggggtcccttagactctcctgtgcagcctctgattctacttcagtaacgctggatcgaacgtcggtccncgaggctacgaggggagggcgtggaggtgggtcgactattaaataaagtcaaagtcgtagagtagggtaggaacaacgagacgaccacgcgtcgacccgtaacccgggtagaaacgggcaaggtacttacgagactaataccgtaacgaaagtaaggtatagtaaacgttaaacgaaaaacgtccgtacttagttaactacgtaacgaaactagtaacgaaaccaacggtaacccgaaaggaaaaccggtacgaaccgaacgtacggtaaccgtttaagttaacgttaccgttagtaccgaccgttaacgttacggacgtaaccgtattaacgtttgtacgttagtaacgttgggttaacg

SEQ ID NO: 407028 - DNA, 674 bp, Homo sapiens
  misc_feature: GZ8MTXP01APPE5.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcttggtaaagccgtgggggtcccttagactctctgtgcagcctctggattcactttcagtaacgcctggatgaactgggtccgcaggctccgaggggaagggcgtgggaggtgggttggcctaattaattaaaatcaaaagcgtagagttgggtagggaacaacgagacgacacgctcggaccgaaccccggtaggaaaacggcaaggtacttacgaagacctatcctaacgaagaagatacgtaaatttaaacgaaaaaacggttacgacgttaggtacttacgtaaggaaacctaagttaacgaaaccgacgtaccgtaaaggaaaaccgggtaggaaaccacgaacggtaacccggttaagttaacgtttaacccgttggttaaccggccccaacgttcgaacgggtaacccgtatttaaccgtttggttccttacggtcgttaagggttaaccg

SEQ ID NO: 407029 - DNA, 688 bp, Homo sapiens
  misc_feature: GZ8MTXP01D6JDN.10.34.D01.1.454.CMB.2.raw
  modified_base (313)..(313): a, c, t, g, unknown or other
  modified_base (368)..(368): a, c, t, g, unknown or other
  modified_base (472)..(472): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggtattttccttgctgtcttaattttaaaaggtgtcagtgtgaggtgcagcgtggtggagtcggtgggggaggtcgttagggtaaacgccggtgggggtcccttagactctcctgtgcacgcctctgattcactttcaagtacgctgactgaacgtcgggtccncgaggctccggaggggagggcgtgggaggtgggttgacctaattaaacttaaaancaaagcaggagtgggagggaacaaacgaggacgacccacgcgtacggacccgtaaccccggtaaggaaaaggcctaaaggtacttaccgagtactaactactanaaaggtaagattaaggtaaacttaaacgaaaaacgtactacgttagtaaactcgtaagaaaccttagaagaaaccgtaggtaaccgaaagggaaaacggtacggaaacaacggtcggtaaccgttagttaacgttcgttaggtactacccgttaacgttccggaacgggtaacccttaagtttcgttagttacgttaggtaacgttggttaaccgg

SEQ ID NO: 407030 - DNA, 740 bp, Homo sapiens
  misc_feature: GZ8MTXP01BTN5P.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggtatttttccttgctgcttattttaaaaggtgtccagtgtgaggtgcagcgtggtggaggtcgtgggggaggtcgttaggtaaagccgttgggggtcccttagactctcctgtgcagcctctggattcactttcagtaacgcctggatgaacgtcgggtcccgccgaggctccggagggggaaggggcgtgggaggttggggttcggacctaagttaatttaaaaatcgaaaaggtctaggagtgggtaggggaacaaacgaggacgaccaacggcgtacggacccgaaccccgggtaggaaaacgggctaaagggtaacttacgaacggtacctaatacctaaccggaaaagaacggtaagttaagtaaactttaaacgaaaaaaacggttccgtaacttaggttaacttaacgtaacggtaaaaccaagttaacgaaaccgtaacggaaccgttaaacggggaaaaaccgggtaggaaaccaaccggacggtaacccggttagttaactttaaccgttgtaccgtacccacgttacgaaccggtaaccgtattaacgtttggttccgttaggtaagttcgggttaacg

SEQ ID NO: 407031 - DNA, 781 bp, Homo sapiens
  misc_feature: GZ8MTXP01B3LXF.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggtattttccttgctgtcttaatttaaaggtgtccagtgtgaggtgcagcgtgggtggaggtcggtggggggaggtcgtttagggtaaacggccggttcggggggttcccttagaccttctccgtgtgcacgcctcgtggtattctacttacgacgtaaccgccgtaggatacggaacgtcgggtcccgaccgacggccgtaccgggagggggaacgggtcggtggggtagggttcgggggtacggtaccctaaagtttaaaagtttaaaaacgtacgaaaagtcgtagggtaagtacgggggtacggaaacaaacgagaaccgacgaaccggctacggaccgaaccccggtaaggaaacggacaaggtacttacgagactataccgtacgaaagagtaagtacggtaaacttaaaacggtaaaaaacggtccgtaagttacggtaacttacgtaagtaaacccgtaagaacgaaaccgtacggaaacccggtaaagggaaaaccggtaacgaaccgaaccggtaccggtaacgtttaacggttaacttacggttcgtaccggtacccaaccgttacgaaccggttaaccgttagtttaagtttccggtacgttacgtggttaacggtaacg

SEQ ID NO: 407032 - DNA, 686 bp, Homo sapiens
  misc_feature: GZ8MTXP01CY3X2.10.34.D01.1.454.CMB.2.raw
  modified_base (626)..(626): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagcgtggtggagtcgtgggggagcttaggtaagcgtgggggtcccttagactctcctgtgcagcctctggattctactttcagtaacgcctggatgaacgtgggtcccgccgaggccgtaccgagggggaacggggcgtgggaggttggggtcggacctaatttaaataaaactacgaaaagtcgtaggagttcgggtacgggaacaacgaaggacgaccaacggctacggacccgtaacccgggtaggaaacggcaaggtacttcaacgtcaagtcctaacgaaagaagtataaggtaaactttaaacgaaaaaacgttccgacgtttaggttaacttcgtaaaggtaaacctagtaacgaaaccgtacggaccgtaaaagggaaaaccgggtacggaaccaacgtacggtcccggtaagttaacttcgngtaccgccttaccgttcgaacggtccgtaattcgttgttagttgtaacgttgggttaacg

SEQ ID NO: 407033 - DNA, 597 bp, Homo sapiens
  misc_feature: GZ8MTXP01C3TUS.10.34.D01.1.454.CMB.2.raw
  modified_base (489)..(489): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtggggagcttggtaaagcgtgggggtcccttagactctctgtgcagctctgattcacttcagtaacgcctggatgaactgggtccgccaggctaccgaggggaacggctggagtgggttggaccaattaataaaagtcaaaagcgtagagtagggtcgggaaacaacgaggacgaaccaacgctagacccgaacccggtagaaaaggcaagagttaccagacactctagaaagaagatagtaaattacaaaaaagtcgtactacgtagtactagaaactanagaacgacgacgaacgaaacggaacgacgacgacgaacgtcgttagttacttgtacgccacgttcttacggaacgtaactaacgttgttacgttagtgttggtaacgg

SEQ ID NO: 407034 - DNA, 723 bp, Homo sapiens
  misc_feature: GZ8MTXP01EAWLD.10.34.D01.1.454.CMB.2.raw
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggtattttccttgctgtcttaattttaaaaggtgtccagtgtgaggtgcagctggtggaggtcgtgggggagtcgttaggtaacgtccggttcgggggtcccttagaccttctccgtgtcgctagcctctggtacttctactttcgaagtaacgccgtaggatcgaacgtcgggtcccgccgaggccgtaccggagggggaacgggtcgtaggggtaggttgggggttacggacctaaagtttaaacgttaaaacgtacgaaaaggtcgtaggtaaggttacggggtacgggaaacaaacgagacgaccacgcgtcgaccgtacccggtaagaaacggcaagtactacagtacatacacgaaagtagtattaagtaacttaaacgaaaaacgtccgtattaagttactacgtaagaaactagtaacgaaacgtacgaaccgtaaaggaaacgtacggaactaccgacggtaacgttagttacgttacgttacgtaccgtaaccttacgttacgaaccgggttaacctaatttaacgtttaccggttacgttacggttgggttaacggttaacg

SEQ ID NO: 407035 - DNA, 615 bp, Homo sapiens
  misc_feature: GZ8MTXP01CC2ZX.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttggtaaagccgtgggggtcccttagactctcctgtgcagcctctggattcactttcagtaacgcctggatgaacgtgggtccgccgaggctccgaggggaggggctgggagtgggtggccataattaaaatcaaagctagagtggtagggacaacaggagacgaaccgctcgacccacccggtagaaacggcagtacttacagcatctacgaagaagatagaattacgaaaaagtacgacgtgtaagtctaagaacagtagaacgacgaccgtaaagggaaaaccggaggaaccacgacggcccgttagttattaccgttgtacgcccttaccgttcggaacggtaacccgggtaatttaacgtttcgttccgttacggtaagttcgggttaacgg

SEQ ID NO: 407036 - DNA, 690 bp, Homo sapiens
  misc_feature: GZ8MTXP01BQTHX.10.34.D01.1.454.CMB.2.raw
  modified_base (309)..(309): a, c, t, g, unknown or other
  modified_base (332)..(332): a, c, t, g, unknown or other
  modified_base (350)..(350): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgcttattttaaaaggtgtccagtgtgaggtgcagctggtggagtcgtgggggaggcgttagggtaaaggccgtcggggggtcccttagactctcctgtgcagcctctggattctacttcgagtaacgcctggatgacgtggtccncgaggctcgaggggaggcgtggnggtggtgcaataataaancaagctagagtggtaggacaacgagagacacgcgtacgacccgtacccggtaggaaacggcgaaaggtacttaccgaagacccaattccgaaacgaaaggaaacgttaacgttaagggtaaaactttaaaaccggaaaaaaacggttcggtaccgtttaaggttaacttacgttaaacggaaaacctaaggttaaacgaaaccgacgtaaccgtaaaacgggaaaacgggtaacgaaccgaacgtacggtaaccgtttagttacttaacgttcgtacgacccttaacgttacgaacggtaacctatttaacgttcggttacttaggtcgttaacggttcg

SEQ ID NO: 407037 - DNA, 746 bp, Homo sapiens
  misc_feature: GZ8MTXP01DSXCE.10.34.D01.1.454.CMB.2.raw
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggtatttttccttgctgacttaattttaaaaggtgtccagtgtgaggtgcagcgtggtggagtcgtgggggagcgttaggtaagccgtgggggtcccttagactctcctgtgcagcctcgtgattctactttcagtaacgctggatagaacgtcggtccgccgaggcctaccggagggggaacggggcgtggggaggttggggttacggacctaagtttaaacgttaaaaacgtacgaaaagtcgtaggaacgttgggtacggggaaacaaacgaggacgaaccgaacgtccgtacggacccgtaaaccccgggtaaggaaaacggcgtaaacgtaactttaccgaagtacctaacttaccgtaacgaaaaggtaaagtaagttaaggtaaactttaaaaccggaaaaaaacgttccgtaaccgttaggttaacttaacgttaaaggaaacctaagtaaacgaaacgtaacggaaccgtaaaacggaaaccgggtaagaacccaacgacggtaaccgttaagttacttacgttcgtaccgtaccttacgttacgaacggtaactagtttaacgttgtattgtaagttcgggttaag

SEQ ID NO: 407038 - DNA, 748 bp, Homo sapiens
  misc_feature: GZ8MTXP01EUQBC.10.34.D01.1.454.CMB.2.raw
  modified_base (304)..(304): a, c, t, g, unknown or other
  modified_base (364)..(364): a, c, t, g, unknown or other
tcagcatagtagtgcacgaccggtgctcgatttagatcgtctgtgttgggttgggggggagaggagccccagccttgggattcccaagtgttttcattcagtgatcaggactgaacacagaggactcaccatggagtttgggctgagctggattttccttgctgcttattttaaaaggtgtccagtgtgaggtgcagctggtggagtcgtgggggagcgttggtaaagccgtgggggtccttagactctcctgtgcagcctctggattcactttcagtaacgcctaggatgaactcgggtcccnccgaggcctaccgaggggagggcgtgggaggtcgggttgggacctaagttaaattaaaanacgaaaagtctaggagtacggtagggaaacaacgagagaacctacgctcggaccgaacccgggtacggaaaacggaccgaaggtaacttacgaacggtcctaaacgttaccttaacgaaaaggtaagtaaacgtttaaggtaaaactttaaaaaccgaaaaaacgggttacctaccgttaggttaacttacgggttaaacgaaacctaaagttacggaaaacccgttaacggaacccggttaaaaccgggaaaaaccggggtaaccgggtaacctaacgaaacggtcccgttaagttactttaacgttcgttacggccccttaacgttcgaaccgggtaacctaagttaacgtttcggttattaggtaaccgttgggtaaccgg

SEQ ID NO: 407039 - DNA, 748 bp, Homo sapiens
  misc_feature: GZ8MTXP01CTHRQ.10.34.D01.1.454.CMB.2.raw
  modified_base (329)..(329): a, c, t, g, unknown or other
  modified_base (333)..(333): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggtattttccttgctgacttattttaaaaggtgtccagtgtgaggtgcagcgtgggtggaggtcggtggggggaggtcgtttagggtaaacggccggttgggggggttcccttaggaccttctcctggtcgcagcctctggtacttctactttcagtacgctggatgacgtcgggtccnccgnggctccggaggggacgggcgtggggaggtggggtagacctaatttaataaaatcgaaagctagagtcgggtaggacaagagtacgaccgacgctacggacccgacccgggtagaaacggcaaggtacttacgagacactacgtaacgaagaagtagtagtaaacgtttaaacgaaaaacgttacgtaccgttaagttaacttacgtaaacgtaaaccgtaacgttaacgaaaacccgaacggtaaccggtaaaacggggaaaaccgggtaacggaaacccgtaacgacgggttaacccgtaaaggttaccgttaaccgttggttacccggtacccaacccggttaccggaaaccgggttaaccgttaaagtttcgtttccgggttacgttacggtaagggttcgggtttaaccgg

SEQ ID NO: 407040 - DNA, 736 bp, Homo sapiens
  misc_feature: GZ8MTXP01ED12I.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgcttaattttaaaaggtgtccagtgtgaggtgcagcgtggtggagtcgtgggggagcgttaggtaaagccgtgggggtcccttagactctctgtgcagcctctggtacttctactttcagtaacgcctaggatgaacgtcgggtcccgccgaggctccggaagggggaacggggctggggaggttgggggttacggacctaaagtttaaactttaaaaagaccgaaaaggtcgtaggtaaggttcggggtacgggaacaaacgaggacgaccgaaccgtcgtacggaccctaaccccggggtagaaaacgggcgaacgtacgttaccgaagtaccaacgtacgtaaccaaaggaagtaacgttaggtaaaactttaaaccgaaaaaacgttacggtacttaggttaaacttacgtaacggaaacctaagtacgaaacgtaccggaacgtaaacgggaaaacggtaacgggaacaaccgaacgggtaaccgtagttaacgtttaccgttaggtccacccgttacgttcgaacgggtaacctattaagtttcggtacttagtaagttcggtaacg

SEQ ID NO: 407041 - DNA, 713 bp, Homo sapiens
  misc_feature: GZ8MTXP01CFFOO.10.34.D01.1.454.CMB.2.raw
  modified_base (376)..(376): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggtatttttccttgcttgcttaattttaaaaggtgtccagtgtgaggtgcagcgtggtggaggtcgtgggggaggtcgttaggtaaaggccgttggggggtcccttagacctctcctgtgcagcctctggacttctactttcagtaacgcgtggatgaaccgtggtcccgccgaggccgtcggaggggacgggcgtgggaggttgggttggactaattaaattaaanacgaaagctagagtcggaggaacaacgagacgaccacgcgtacgacccgtacccggtaagaaaacggtcgaagtacttaccgaacgtacctaataccgtaagaaaaggaaggtaattaaggttaaacttaaaccgaaaaaacggttacgtacgttaagttactaacgttaaggaaacctaagtaacggaaaccctaacggtaaccccgtaaaagggaaaaaccgggtaacgaacctaaaccggtaaggtaacccgttagtttaaactaaccgttgtaccgaccttaccgttacgaaccggtaacgttattgtttcgttacgagtaacgttggtaacg

SEQ ID NO: 407042 - DNA, 599 bp, Homo sapiens
  misc_feature: GZ8MTXP01CTYJ8.10.34.D01.1.454.CMB.2.raw
  modified_base (306)..(306): a, c, t, g, unknown or other
  modified_base (328)..(328): a, c, t, g, unknown or other
  modified_base (545)..(545): a, c, t, g, unknown or other
  modified_base (555)..(555): a, c, t, g, unknown or other
  modified_base (557)..(557): a, c, t, g, unknown or other
  modified_base (560)..(560): a, c, t, g, unknown or other
  modified_base (592)..(592): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgcttattttaaaaggtgtccagtgtgaggtgcagctggtggagtcgtgggggaggcttaggtaaagccgtgggggtcccttagactctcctgtgcagcctctggacttctactttcagtaacgctggatcgaactcgggtccncgagctaccgaggggagggcgnggaggtgggttgaccaagttaaataaaatacgaaaagtcgtagagtagggtacgggaaacaacgaaggagaacctaacgcgtacgacccgaaacccggtagaaaacgggcaagtacgttcagactaactctacgaaagaagtaatagaattaacgaaaaagttcgtacgtagtactacgtagaaacagtagaaacagactaaggaaacgagacagancgtattatcngnccncgcacggaaccgtatcgttgtcttagtaacgnggtaacg

SEQ ID NO: 407043 - DNA, 347 bp, Homo sapiens
  misc_feature: GZ8MTXP02I0V7O.10.34.D01.1.454.CMB.2.raw
  modified_base (344)..(347): a, c, t, g, unknown or other
tcagcatagtagtgcacgaccggtgctcgatttagatcgtctgtgttgggtttgggggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtctgggggaggcttggtaaagcctgggggtcccttagactctcctgtgcagcctctggattcactttcagtaacgcctggatgaactgggtccgccaggctccaggggaaggggctggagcgggctggcaaggcgcatagnnnn

SEQ ID NO: 407044 - DNA, 560 bp, Homo sapiens
  misc_feature: GZ8MTXP02JBW5A.10.34.D01.1.454.CMB.2.raw
  modified_base (418)..(418): a, c, t, g, unknown or other
tcagcatagtagtgcacgaccggtgctcgatttagatcgtctgtgttgggtttgggggagaggagccccagccttgggattcccaagtgttttcattcagtgatcaggactgaacacagaggactcaccatggagtttgggctgagctggatttccttgctgctatttaaaggtgtccagtgtgaggtgcagctggtggagtctgggggaggcttggtaaagcctggggggtcccttaggactctcctgtgcagcctctggattcactttcagtaacgcctggatgaactgggtccgccaggctccagggaaggggctggagtgggttggccatattaaaatcaaaagctagatgggtaggggacaaacgagagcacgctgcacccgtgaaaaggctaagattcagcatctacaaganatagataacaaaagtcgatagtatactagaacatagaacagacaaggaaaacggagaacacgacgtacgtagtaacttacgtcgtacgaccacgtacgaacggaaccgtattacgttacgttacgtacgtacgtacggtacg

SEQ ID NO: 407045 - DNA, 537 bp, Homo sapiens
  misc_feature: GZ8MTXP02F2UJP.10.34.D01.1.454.CMB.2.raw
  modified_base (364)..(364): a, c, t, g, unknown or other
tcagcatagtagtgcacgaccggtgctcgatttagatcgtctgtgttgggtttgggggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcttggtaaagccgtgggggtcccttagactctcctgtgcagcctctggattcactttcagtaacgcctggatgaactgggtccgccaggctccgagggaagggctggagtgggttggccatataaatcaaagctgatggtaggacaacgngagcacgctgacacccgtagaaagcagatcagcatctacaagagatagaattacaaaaagtacgactagtatctagaacatagaaacagaccgtaggaaaacggaggaacacgacgccgtagtattactcggtcaccacgtcacggaaccgtatacttgtactgagtcggtag

SEQ ID NO: 407046 - DNA, 560 bp, Homo sapiens
  misc_feature: GZ8MTXP02JVYRX.10.34.D01.1.454.CMB.2.raw
  modified_base (344)..(344): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtggggggtcccttagactctcctgtgcagcctctggattcactttcagtaacgcctggatgaactgggtccgccaggctccgagggagggctggagtgggtggccatattaaancaaagctgatggtagggacaacagagcacgctgcacccgtagaaaggcagatcagcatctacaagagatagtaattacgaaaaagtcgactagtaatctagaaactagtacgaaacacgacctaaggaaaaccggaggaacaacgacgtccgtagtacttaacgtgtacgaccactcgaggaaccgtattaagttcgttacgtgtacgtgggtacg

SEQ ID NO: 407047 - DNA, 599 bp, Homo sapiens
  misc_feature: GZ8MTXP02JCZMR.10.34.D01.1.454.CMB.2.raw
  modified_base (427)..(427): a, c, t, g, unknown or other
tcagcatagtagtgcacgaccggtgctcgatttagatcgtctgtgttgggtttgggggagaggagccccagccttgggattcccaagtgttttcattcagtgatcaggactgaacacagaggactcaccatggagtttgggctgagctggattttcctgctgctatttaaaaggtgtccagtgtgaggtgcagcgtggtggagtcgtggggaggcgttggtaaagccgtgggggtccttagactctctgtgcagcctctggattcactttcagtaacgcctggatgaacgtggtccgcgaggctccgaggggagggcgtggaggtgggtggacctaagtaattaaaatacgaaagctagagtgggtaggaacaacgagacgacacgcgtcgaccaacccggtagaaacgcaagtactcagcatcganaaagagtaagtagtaaattaaacgaaaaacgtcgtacgttagtactactaacgaaactagtacgaaacgacgtaccgaaaggaaaacggacgaacacgacgtaccgtagtactacgtgacgccaacgtcaaacggtaacctaagttacgttgtacgtagtacgtacggtacg

SEQ ID NO: 407048 - DNA, 542 bp, Homo sapiens
  misc_feature: GZ8MTXP02FPZE8.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcttggtaaagccgtgggggtcccttagactctcctgtgcagcctctggattcactttcagtaacgcctggatgaactgggtccgccaggctccgaggggaagggctggagtgggttggccatataaaatcaaagctagatggtggacaacgagagcacgctgcacccgtagaaaggcaagattcagcatctacaaagagatagaattacaaaaagtacgactagtatactagaacatagaacagactaagaaaacggagaacacgagaccgtagtattacgtgtacgacctactcgacgaaccgtatacttgtctagatacggtag

SEQ ID NO: 407049 - DNA, 579 bp, Homo sapiens
  misc_feature: GZ8MTXP02HPEVG.10.34.D01.1.454.CMB.2.raw
  modified_base (470)..(470): a, c, t, g, unknown or other
  modified_base (473)..(473): a, c, t, g, unknown or other
  modified_base (475)..(475): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtgggggtcccttagactctcctgtgcagcctctggattcactttcagtaacgcctggatgaacgtgggtccgcaggctccgaggggaacgggcgtgggaggtgggttggccaagttaattaaaatcgaaaagctgagtggtagggacaacgagagccacgctcgcacccgtagaaaggcaagtatcgagcatacctagaagagtatagaattaacaaaaagtacgactagtatacgtaanaananagaacgacgacgaacggaaacggaacgaacgacgacgtacgtacgtatacgtcgtacgaccacacgacgtaacgtactacgttacgtacgtacgtacgtagtcg

SEQ ID NO: 407050 - DNA, 513 bp, Homo sapiens
  misc_feature: GZ8MTXP02GZQ2X.10.34.D01.1.454.CMB.2.raw
  modified_base (349)..(349): a, c, t, g, unknown or other
  modified_base (352)..(352): a, c, t, g, unknown or other
  modified_base (366)..(366): a, c, t, g, unknown or other
  modified_base (372)..(372): a, c, t, g, unknown or other
  modified_base (391)..(395): a, c, t, g, unknown or other
  modified_base (397)..(397): a, c, t, g, unknown or other
  modified_base (399)..(399): a, c, t, g, unknown or other
  modified_base (401)..(401): a, c, t, g, unknown or other
  modified_base (403)..(403): a, c, t, g, unknown or other
  modified_base (405)..(405): a, c, t, g, unknown or other
  modified_base (409)..(409): a, c, t, g, unknown or other
  modified_base (417)..(417): a, c, t, g, unknown or other
  modified_base (421)..(421): a, c, t, g, unknown or other
  modified_base (424)..(424): a, c, t, g, unknown or other
  modified_base (426)..(426): a, c, t, g, unknown or other
  modified_base (428)..(428): a, c, t, g, unknown or other
  modified_base (430)..(430): a, c, t, g, unknown or other
tcagcatagtagtgcacgaccggtgctcgatttagatcgtctgtgttgggtttgggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtggggggtcccttagactctcctgtgcagcctctggattcactttcagtaacgcctggatgaactgggtccgccaggctccaggggaagggctggagtcgggtgcgataagtaatcaaancgnatggtggacacagncacgcngcaccgtgaaaggcagatnnnnnanananananatanaagacatntatntananananacacgacgagaacgagacgacacgacgtagtatactcgtacgacacacgacgaacgtactacgttacgtcgtacgtagtagtg

SEQ ID NO: 407051 - DNA, 548 bp, Homo sapiens
  misc_feature: GZ8MTXP02GXFYB.10.34.D01.1.454.CMB.2.raw
  modified_base (299)..(299): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggagcttggtaaagccgtggggggtcccttagactctcctgtgcagcctctggattcactttcagtaacgcctggatgaactgggtccnccaggctccgagggagggctggagtggtgcatataaatcaaagctgatggtagggaacaacagagcacgctgacacccgtagaaaggcagatcagcatctacaagagatagaattaacaaaaagtcgactagtaatctagaacatagaacagacctaagaaaacggagaacacgacgaccgtagtaattacgtgtacgaccactacgaacggaaccgtagttaagttcgttactacgtaagtcggtacg

SEQ ID NO: 407052 - DNA, 586 bp, Homo sapiens
  misc_feature: GZ8MTXP02IYPYL.10.34.D01.1.454.CMB.2.raw
  modified_base (299)..(299): a, c, t, g, unknown or other
  modified_base (494)..(494): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtctgggggaggcttggtaaagcctggggggtcccttagactctcctgtgcagcctctggattcactttcagtaacgcctggatgaactgggtccnccaggctcaggggagggctggagtgggttgccatattaaaatcaaagctagatgggtaggacaacgagagcacgctcgccaacccgtagaaaggcaagattcagctatctacgaaagagatagtaattaaccaaaaaggtcacttagtaactacgtacaaactagtacgaaacgagaccgtaaggaaaaacgggnggaaacacgacggtaccgtagttaaacttacgtgtcgaccctaacgtcgaaacggtaaccgtattaagttcgttactagtagtcggggtacg

SEQ ID NO: 407053 - DNA, 724 bp, Homo sapiens
  misc_feature: GZ8MTXP02GH2HX.10.34.D01.1.454.CMB.2.raw
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttcctgctgctatttaaaggtgtccagtgtgaggtgcagctggtggagtcgtgggggaggcttggtaaagccgtgggggtccttagactctcctgtgcagcctctggattcacttcagtaacgcctggatgaacgtcggtccgccgaggcctaccgaggggaacggggcgtgggtaggtgggttcgggacctaagtaaattaaaaacgtacaaaagcgtaggtagtggggtacgggaacaaacgaggagaccgaacgcgtacgacccgtaacccggaaggaaacgggacaaaggtacttacgaacgacctaattaccctaacgaaagtaaaggattaaaggttaaactttaaaaccgaaaaaaaaggttacccgtaacgtttaacggttaaattacccggttaaaacgtaaaacgtaaacgtaaacgaaaaccgtaacggtaaaccggtaaaacgggaaaacggaacggaaaccgtaacgtaacggtacgttagttaacgttacgtacgtaccgacctacgtacgaacgtaacgttagttacgttacgttacgtacgtacgtcggtacg

SEQ ID NO: 407054 - DNA, 565 bp, Homo sapiens
  misc_feature: GZ8MTXP02I8KQ6.10.34.D01.1.454.CMB.2.raw
  modified_base (347)..(347): a, c, t, g, unknown or other
  modified_base (417)..(417): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtggggggtcccttagactctcctgtgcagcctctggattcactttcagtaacgcctggatgaactgggtccgcaggctccaggggaagggctggagtgggtggccataagttaaaancaaaagctagatggtgggacaacagagcacgctgcacccggtagaaaggcagatcagcatctacaaaganatagtaattaacgaaaaagtcgactgtaatactagaacatagaaacagacctaaggaaaacggaggaacacgacgccgtagtattaacgtgtacgacctacgtaccaacgggaacctagttaatttcggttactaggacgtacggtcg

SEQ ID NO: 407055 - DNA, 620 bp, Homo sapiens
  misc_feature: GZ8MTXP02JO0JG.10.34.D01.1.454.CMB.2.raw
  modified_base (354)..(354): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttaggtaaagccgtggggggtcccttagactctcctgtgcagcctctggattcactttcagtaacgcctggatgaactgggtccgccgaggctccgaggggagggcgtgggagtgggttggcctataattaaaancaaagctaggagtgggtaggaacaaacgagacgacacgcgtcgacctaaccccgggtagaaacgggacaggtattaccgacgactatcctacgaaaggagtaatagtaaacttaaacgaaaaacgtacgtacttagtaatactagaaactatacgaaacacgaccgtaaaggaaaacggaggaaccagacggtacgtagtacgttaacgtggtacacccacgtacgaacggtaacgtattacgtttcgtcgtagtaggtcggtacg

SEQ ID NO: 407056 - DNA, 622 bp, Homo sapiens
  misc_feature: GZ8MTXP02GHBRU.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggagcttggtaaagccgtgggggtcccttagactctcctgtgcagcctctggattcactttcagtaacgcctggatgaacgtcggtccgcaggctccgaggggagggcgtggaggtgggttggaccattaattaaactagaaagcgtagagtggtaggacaagagagcgacgcgtcgacgacccggtagaaacggcagacttcagacctatctaacgaaagagagtaagtaaattaaccgaaaaagttcgtacttagtaaacttcgtaagaacagtacgaaaccgtagaccggtaaaggaaaacggaaggacacgtaacgtccgttaggttaacttaccggtgacgtaccctacgtacgaacggtaacccgtaagttttacgttacggttcgtacggtacggtacggtacg

SEQ ID NO: 407057 - DNA, 514 bp, Homo sapiens
  misc_feature: GZ8MTXP02JWBDJ.10.34.D01.1.454.CMB.2.raw
  modified_base (211)..(211): a, c, t, g, unknown or other
  modified_base (249)..(250): a, c, t, g, unknown or other
  modified_base (252)..(252): a, c, t, g, unknown or other
  modified_base (256)..(256): a, c, t, g, unknown or other
  modified_base (273)..(273): a, c, t, g, unknown or other
  modified_base (275)..(275): a, c, t, g, unknown or other
  modified_base (300)..(300): a, c, t, g, unknown or other
  modified_base (302)..(302): a, c, t, g, unknown or other
  modified_base (305)..(305): a, c, t, g, unknown or other
  modified_base (322)..(322): a, c, t, g, unknown or other
  modified_base (329)..(329): a, c, t, g, unknown or other
  modified_base (331)..(331): a, c, t, g, unknown or other
  modified_base (336)..(336): a, c, t, g, unknown or other
  modified_base (340)..(340): a, c, t, g, unknown or other
  modified_base (342)..(342): a, c, t, g, unknown or other
  modified_base (366)..(367): a, c, t, g, unknown or other
tcagcatagtagtgcacgaccggtgctcgatttagatcgtctgtgttgggtttgggggagaggagccccagccttgggattcccaagtgttttcattcagtgatcaggactgaacacagaggactcaccatggagtttggctgagctggattttcctgctgctattttaaagtgtccagtgtgaggtgcagctggtggagtcgtggggagnttggtaaagccgtgggggtcccttagctctcctgtgcnncntgtntctctcagtacgcgtgngngacgtcggcgcgcgcgcgaggaggngnggngtggtgcgatataatanagagtgngngaganagangngagcgcgcgacgacgagacgagannagacactacagagagagagtagtaagtaacgagtatatatactagagagagacgagacgaacgaacgagacgacgacgtacgtagtagtacgtacgtacgacgacgtacgacgtaacgtagtacgtacgtacgtacgtacgtagtcg

SEQ ID NO: 407058 - DNA, 587 bp, Homo sapiens
  misc_feature: GZ8MTXP02IMHHG.10.34.D01.1.454.CMB.2.raw
  modified_base (304)..(304): a, c, t, g, unknown or other
  modified_base (359)..(359): a, c, t, g, unknown or other
  modified_base (370)..(370): a, c, t, g, unknown or other
  modified_base (381)..(381): a, c, t, g, unknown or other
  modified_base (406)..(406): a, c, t, g, unknown or other
  modified_base (416)..(416): a, c, t, g, unknown or other
  modified_base (426)..(426): a, c, t, g, unknown or other
  modified_base (447)..(447): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggtattttccttgctgctattttaaaaggtgtccactgtgaggttcaactggtggagactggaggaggctggatccgagccgtgggggtccctgagactctcctgtgcagcctcgtggtcagcatcagtacgactacatcgaccgtcgggcccncgacggcctcgaggggaagggctagggagttcgggtctacgtagttatagaaacngatgacactanattattatctnactcgtagacgggtccgtcaccctntccagacacncttaccaaanactatctatactcttacactntagacactaatctagacgtacggtcgaacgaccgtaccggacctaacctttactagttcggtacgaccggacgtacgtacgtacgaccgttaacgtactacgtaaacgtttcggaccggggaccgaacgggggtaccccg

SEQ ID NO: 407059 - DNA, 609 bp, Homo sapiens
  misc_feature: GZ8MTXP02HPX69.10.34.D01.1.454.CMB.2.raw
  modified_base (350)..(350): a, c, t, g, unknown or other
  modified_base (367)..(367): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttggtaaagccgtgggggtcccttagactctcctgtgcagcctctggattcactttcagtaacgcctggatgaacgtgggtccgccgaggctccgaggggagggctggagtggtgcatataaatcaaagcngatggtagggacaacgngagcagctgacaccgagaaagcagatcgagcagtctacgaaagagtatagaacttaaacgaaaaaggttccagttagttaataccgttaagaaactagtaacgaaacaacggtaccgtaaaaggaaaacgggagaacctaacgaccgtaccggttagttaaacgtttaccgagtaccgacccgtacgtaaccgaacggtaaccgttaagtttacgtttcgtacgtacggtacggtcggtacg

SEQ ID NO: 407060 - DNA, 583 bp, Homo sapiens
  misc_feature: GZ8MTXP02GWQEP.10.34.D01.1.454.CMB.2.raw
  modified_base (323)..(323): a, c, t, g, unknown or other
  modified_base (348)..(348): a, c, t, g, unknown or other
  modified_base (390)..(390): a, c, t, g, unknown or other
  modified_base (414)..(414): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtgggggtcccttagactctcctgtgcagcctctggattcactttcagtaacgcctggatgaactgggtccgccaggcctccgaggggagggcnggagtgggtgcatataaatcaaagntgatggtaggacaacagagcacgctgcaccgtagaaacgcanagttcacgtcaatcacaaaggaanatagaactaacgaaaacgtcgtagtagtactactaagaactagtagaaacacggacgtaaacggaaaacggacgaactacgacggtacgttagttaacttacgtacgtacgacctaacgtacgaacggtaaccgttagttacgttacgttacgtacgtacgtcggtacg

SEQ ID NO: 407061 - DNA, 608 bp, Homo sapiens
  misc_feature: GZ8MTXP02GV1Y3.10.34.D01.1.454.CMB.2.raw
  modified_base (546)..(546): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttaggtaagccgtgggggtcccttagactctctgtgcagcctctggattcactttcagtaacgcctggatgaacgtgggtcccgaccaggcctccgaggggacgggctgggagtggggttgacctataattaaaatcaaagctaggagtggtaggaacaagagacgacacgcgtacgaccacccgtagaaacggcaagactacgagccatctacaagagatagaattaacgaaaagtcgactagtaactcgtaagaacagtacgaaacgacgaaccctaaggaaaacggacgaacaacgacgtaccgtagttaacttacgtagtacnccgtaacgtcgaacgggtaacctacgttaagttccgttacgtacggttacgttgggtaaccg

SEQ ID NO: 407062 - DNA, 566 bp, Homo sapiens
  misc_feature: GZ8MTXP02IYVU8.10.34.D01.1.454.CMB.2.raw
  modified_base (502)..(502): a, c, t, g, unknown or other
  modified_base (519)..(519): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggagcttggtaaagccgtgggggtcccttagactctcctgtgcagcctctggattcactttcagtaacgcctggatgaactggccgccaggctcgaggggagggctggagtggtgccatataaatcaaagctagatggtagggacaaacgagagcacgctgaccaccccggtagaaacgggcaaggtacttacaagcctaatactacaaagaaggtataggtaacttaaacgaaaaaagtcgactagttaatctagaactatacgaacagacctaagaaaacggagaacanacgacgtgtaattacgngtacgaccaactacgaggaaccgtattaattcgtatagagtcggtag

SEQ ID NO: 407063 - DNA, 574 bp, Homo sapiens
  misc_feature: GZ8MTXP02FTBVC.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtgggggtcccttagactctcctgtgcagcctctggattcactttcagtaacgcctggatgaactggtccgccaggctccgaggggaagggctggagtgggttggccatattaaaatcaaagctgatggtgggacaacagagcacgctgacacccggtgaaaggcaagattcagcatctacaaagagatagaattaacgaaaaaagtacgacttagtaactactagaaacatagaaacacgacctaaggaaaaccggaggaacacgaagtccgtagtaacttacgtacgtacgaccctactcgaacgggaaccgtagttaacgttgttacgtagtacgtggtacg

SEQ ID NO: 407064 - DNA, 578 bp, Homo sapiens
  misc_feature: GZ8MTXP02F05DU.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcttaggtaaagccgtggggggtcccttagactctcctgtgcagcctctggattcactttcagtaacgcctggatgaacgtggtccgccaggctccgaggggagggctggagtggtgcatataaatcaaagctagatggtggacaacgagagcacgcgtgccaacccgtagaaaggcaagattcagcatctacaagaagatagtaattaacgaaaaaagtcgacttagtaatacgtagaactaagtacgaaacgacgaccgtaaggaaaacggagaacacgacgtaccgtagttattacgtacgtacgacccgtaactccgaacggtaaccgtaagttatttacgtacgtagagttcggtacg

SEQ ID NO: 407065 - DNA, 539 bp, Homo sapiens
  misc_feature: GZ8MTXP02INA9N.10.34.D01.1.454.CMB.2.raw
  modified_base (470)..(470): a, c, t, g, unknown or other
  modified_base (527)..(527): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttcctgctgctatttaaaggtgtccagtgtgaggtgcagctggtggagtcgtgggggaggcttggtaaagcctgggggtcccttagactctcctgtgcagcctctggattcactttcagtaacgcctggatgaactgggtccgccaggctccaggggaagggctggagtgggttggccagtattaaaatcaaagctgatggtgggacaacagagcacgctgccacccggtgaaacggcagattcagcatctacaagagatgattacaaaaagtcgactgtaatctagaacatagaaacagacctaggaaaaacggngaacacagaccgtagtatactagtcgacccactacgaggaaccgtaatagttcgttntgtacgtgtacg

SEQ ID NO: 407066 - DNA, 603 bp, Homo sapiens
  misc_feature: GZ8MTXP02JB9R2.10.34.D01.1.454.CMB.2.raw
  modified_base (259)..(259): a, c, t, g, unknown or other
  modified_base (314)..(314): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttggctgagctggattttccttgctgctattttaaaggtgtccagtgtgaggtgcagctggtggagtcgtggggaggtcgttaggtaagccgtgggggtccttagactctctgtgcagcctntgattctacttcagtacgctgatgacgtggccgcgagctccgagggaggcgtggnggtggtgacaattaataaatacaaagctagagtggtaggaacaacgagagcacgcgtcgaccgaccggtagaaacgcaagtacttacgagtactataccgtagaaagagtagtaagtaaatttaaaccgaaaaagtacgtacgttagtaacttaccgtagtaaactaagtacgaaacgacgtaaccgaaaggaaaacggtaggaaccacgaacgtcgtacgttagtacgtcgtacgaccctacgacgaacggtaacgtattacgttacgttactacggtagtacgtacg

SEQ ID NO: 407067 - DNA, 575 bp, Homo sapiens
  misc_feature: GZ8MTXP02JGLIZ.10.34.D01.1.454.CMB.2.raw
  modified_base (295)..(295): a, c, t, g, unknown or other
  modified_base (399)..(399): a, c, t, g, unknown or other
  modified_base (448)..(448): a, c, t, g, unknown or other
tcagcatagtagtgcacgaccggtgctcgatttagatcgtctgtgttgggtttgggggagaggagccccagccttgggattcccaagtgttttcattcagtgatcaggactgaacacagaggactcaccatggagtttgggctgagctggattttcctgctgctattttaaaggtgtccagtgtgaggtgcagctggtggagtctgggggagcttggtaaagccgtgggggtcccttagactctcctgtgcagcctctggattcactttcagtaacgcctggatgaactggtccncaggctccgagggagggctggagtggtgccatattaaaatcaaagctagatcggtaggacaacgagagcacgctgcacccgtagaaacgcagattcagcatcanaagagatgattacgaaaagtcgatagtatctagaactagtacgaaacgngtacctaaggaaaaccggaggtaaccacgtacgacccgttagttacgttaacgtcggtacgtacccgtacgtacgacggtaacccgtagttaacgtttcgttaccgtaggttaacgtcggttaaccg

SEQ ID NO: 407068 - DNA, 626 bp, Homo sapiens
  misc_feature: GZ8MTXP02HC9N2.10.34.D01.1.454.CMB.2.raw
  modified_base (615)..(615): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctgggtggagtcgtgggggaggcgttagggtaaacggccggttcggggggttccccttaggacctctccgtgtgcagcctcgtggtattcactttcagtaacgctggatacgaacgtcgggtcccgccgaggcgtaccgaggggaacggggcgtgggaggtggggttcggacctaagttaaattaaaatcgaaaagtcgtaggagtggggtagggaacaacgagacgacacgcgtcgaccaacccggtagaaacgggcaggtattcgagactatacgacaagagtatagtaacttaaacgaaaaagtcgattagtaactacgtagaaactagtacgaaacgacgaccgtaaaggaaaacggagaacaacgacgtaccgtagttactacgtgacgccactacgacgaacgtatattcgtntcgagtgtacg

SEQ ID NO: 407069 - DNA, 575 bp, Homo sapiens
  misc_feature: GZ8MTXP02FNH48.10.34.D01.1.454.CMB.2.raw
  modified_base (302)..(302): a, c, t, g, unknown or other
  modified_base (400)..(400): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggaggcttggtaaagccgtggggggtcccttaggactctcctgtgcagcctctggattcactttcagtaacgcctggatgaactggtccnccagctccgaggggagggctggagtgggtgcatataaatcaaagctgatcggtaggacaacagagcacgctcgcaccgtgaaagcagattcagcatcncaagagatgattacaaaagtcgctagtactctagaacatacgaacacgactaagaaaacgggacggaacacgaacggtcccggtagttaacttacgtaggttacgaccctaaccgtccgaagggtaacccgtaagttaacgtttacgttaccgtaggtacgtacgggttaaccgg

SEQ ID NO: 407070 - DNA, 593 bp, Homo sapiens
  misc_feature: GZ8MTXP02IUFWH.10.34.D01.1.454.CMB.2.raw
  modified_base (501)..(501): a, c, t, g, unknown or other
  modified_base (545)..(545): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtgggggtcccttagactctcctgtgcagcctctggattcactttcacgtaacgcctggatagaacgtgggtccgccgaggctccgaggggaagggcgtggaggtgggtggccaagtaattaaaatcgaaaagctagagttgggtagggacaacgaggagaccacgcgtcgacgacccgtaggaaacgcaaggacttacgagacagtctacgaagtagatagtaattaaccgaaaaagtcggacttagtactacgtagaacaagtagaaacngtacccaggaaaaacggcgaaacacgacgtacgtatacttacgngtacgtccactcgaaggaacctagtactagttcgacgtacgtggtacg

SEQ ID NO: 407071 - DNA, 686 bp, Homo sapiens
  misc_feature: GZ8MTXP02IFDNC.10.34.D01.1.454.CMB.2.raw
  modified_base (386)..(386): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgcttattttaaaggtgtccagtgtgaggtgcagcgtgggtggaggtcggtgggggaggcttagggtaaacgccggtggggggtcccttagacttctcctgtgcagcctgtggtattctactttcagtaaccgctggatagacgtcgggtccgccgacggctaccggagggggaacggggtcgtaggggtaggtggggttacggacctaaattaaattaaaancgaaaagcgtaggagtggggtaggaacaacgaggacgccgaacgtcgtacgaccgaacccggtaagaaacggcgtaagtacttacgacgactaactaccgtaagaaagagtaagttaaggtaaacttaaaacgaaaaagttccgattacgttaactacgtaagaaactagtaacgaacaacgaccgtaaaggaaaacggagacgaacgacggtaaccgtagttacttacgttacggactacccgtacgtacgaacgggtaaccgtatttaagtttcgttagtacggtagttacgggtacg

SEQ ID NO: 407072 - DNA, 539 bp, Homo sapiens
  misc_feature: GZ8MTXP02I737L.10.34.D01.1.454.CMB.2.raw
  modified_base (372)..(372): a, c, t, g, unknown or other
  modified_base (392)..(393): a, c, t, g, unknown or other
  modified_base (395)..(395): a, c, t, g, unknown or other
  modified_base (399)..(399): a, c, t, g, unknown or other
  modified_base (403)..(403): a, c, t, g, unknown or other
  modified_base (407)..(407): a, c, t, g, unknown or other
  modified_base (416)..(416): a, c, t, g, unknown or other
  modified_base (428)..(428): a, c, t, g, unknown or other
  modified_base (430)..(430): a, c, t, g, unknown or other
  modified_base (432)..(432): a, c, t, g, unknown or other
  modified_base (434)..(434): a, c, t, g, unknown or other
tcagcatagtagtgcacgaccggtgctcgatttagatcgtctgtgttgggtttgggggagaggagcccagccttgggattcccaagtgttttcattcagtgatcaggactgaacacagaggactcaccatggagtttgggctgagctggatttcctgctgctatttaaaaggtgtccagtgtgaggtgcagctggtggagtctgggggaggcttggtaaagccgtgggggtcccttagactctcctgtgcagcctctggattcactttcagtaacgcctggatgaactgggtccgccaggctccaggggaagggctggagtgggttggccatattaaaatcaaagctagatggtggacaacagagcacgtcncgcaccgagaagcagatcannanacanaganatanataacaaanagatatatatananananacacgacgaacgaaacgaagacgacgacgacgtacgtacgtacgtacgtacgaccgacgtacgacgaacgtacgttacgttacgttacgtacgtacgtacgtacg

SEQ ID NO: 407073 - DNA, 678 bp, Homo sapiens
  misc_feature: GZ8MTXP02I727T.10.34.D01.1.454.CMB.2.raw
  modified_base (360)..(360): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagcgtggatttccttgctgctatttaaagtgtcagtgtgaggtgcagctggtggagtctgggggaggcttggtaaagccgtggggggtcccttaggactctcctgtgcagcctctggattcactttcagtaacgcctggatgaactgggtccgccgaggcctccgaggggaagggcgtggagtgggttggcgatattaaaatcaaagctgatggngggacaacgagagcaacgcgtgccgacccgagaaaacggggctaagggacctttaacgacgtactaactcgtaagaaagaagtaagtaagtaaacgttaaacgtaaaacgtaaacgtaacgttaacgttaacgttacgtaacgtaacgtaacgtaaacgtaaacgaacgtaaccggtaaacgggaaaacgggaaacggaaacgaacgtaacggtacggttacgttaacgttacgttacgtacgtaccgtaaccgtaaccggtaacggtaaccgttaacgttacgtttacgtttacgttacggttacggttacggtacg

SEQ ID NO: 407074 - DNA, 592 bp, Homo sapiens
  misc_feature: GZ8MTXP02IUN9X.10.34.D01.1.454.CMB.2.raw
  modified_base (573)..(573): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtgggggagcttggtaagccgtgggggtcccttagactctcctgtgcagcctctggattcactttcagtaacgcctggatgaacgtcgggtccgccgacggctccgaggggaaggggctggagtgggtggccagttaattaaaagtcaaaagctagagtgggtagggacaacgagacgcaacgcgtacgccaacccggtagaaacgggcaacgtattacgagcatctacaagagtatagtaaattaacaaaaagtcgtactagtatacgtagaaactatacgaaacacgaacctaaggaaaacggagaacacgacgtccgtattacgttacgtgcgaccgactacgaagtaaccgtattaacgttnttacgaggtacgtgggtac

SEQ ID NO: 407075 - DNA, 590 bp, Homo sapiens
  misc_feature: GZ8MTXP02GQQM7.10.34.D01.1.454.CMB.2.raw
  modified_base (301)..(301): a, c, t, g, unknown or other
  modified_base (503)..(503): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagcttggtaaagccgtgggggtcccttagactctcctgtgcagcctctggattctactttcagtaacgctggatggaactgggtccnccgaggctccgaggggaagggctggaggtgggttggacctataattaaaatcaaaagtctagagtgggtaggacaacgaggagcacgctgacccgacccgtagaaaacggcaagacttcagacatctacaagagatagaacttaacgaaaaagtcgacgtagttaatctagaacagtacgaacgagacctaaggaaaacggngaacacgtacgtccgtagtacttacgtgtacgacctacgtccgaacggaaccgtaagttagttacgttcgtagtacgtacgggtacg

SEQ ID NO: 407076 - DNA, 690 bp, Homo sapiens
  misc_feature: GZ8MTXP02G9SGL.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttggctgagctggtattttccttgctgcttaagttttaaaaggtgtccagtgtgaggtgcagcgtggtggagtcggtgggggaggtcgttagggtaaacgccggttcggggggttacccttaggacttctccgtgtcgcacgtcctcgtggtacttctactttcacgtaaccgccgtaggatacggaacgtcgggtcccgcgacggccgtaccggagggggaaggggtcgtaggggaggttggggttacggaccgtaaattaaattaaaacgtacgaaaagtcgtaggtagtggggtacggaacaacgtagacgcgacgcgtacgaccgaacccggtagaaacggacgagtacttacgacgcaactacgtaacgaaagatagtagtaaacttaaacgaaaaacgtcgtactagtactacgtaagaactagtacgaacgtacgaacgtaaaggaaaacggagaacacgtacgtaccgtagttaactacgttagccgtaccgtacgtaccggaaacgaaccgttattagttccgttgtacggtagtcgggttaag

SEQ ID NO: 407077 - DNA, 693 bp, Homo sapiens
  misc_feature: GZ8MTXP02IUDG8.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcggtgggggaggcgttggtaaaggccggtggggggtcccttaggacttctcctgtgcagcctctggtattctactttcagtaacgcctaggatagaacgtcgggtcccgccgaggcctaccggaagggggaacggggcgtggggtaggtggggttcggacctaaagttaaattaaaaagtacgaaaaggtcgtaggtaagtcggggtagggaaaccaacgaaggacgccgaacgccgtacggacccgaacccggtagaaacgggcaaggtacttcaacgacaattaccgagaaagagtaagtacgaaattaaaccgaaaagtcgacttaagttaataaccggtataaaacgtagtaacgaaacgtaaccgtaacgtaaacgggaaaacggaagaaccgaacgaacggtaccgtagttaccttacgacgtacgtacccacgtacgaaacggtaaccgtattaagtttcgtagtacgtaacgtggtacg

SEQ ID NO: 407078 - DNA, 580 bp, Homo sapiens
  misc_feature: GZ8MTXP02GO0YA.10.34.D01.1.454.CMB.2.raw
  modified_base (399)..(399): a, c, t, g, unknown or other
  modified_base (419)..(419): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtgggggtcccttagactctcctgtgcagcctctggattcactttcagtaacgcctggatgaactcgggtccgccgaggctccgaggggaagggctggagtgggtcggacataattaaaatcaaagctagatggtaggacaacagagcacgctcgccaccgagaaacggnagatcagcatctacaaaganagtagtaattaacaaaaagtcgtacttagtaactacgtagaacaagtacgaaactaacgacctaaaggaaaacggaggaaccaacgacgtccgtagttattacgtagtcgacctacgtacgaacgaaccgtaattagtcgtttacgagtacgtcggtaacg

SEQ ID NO: 407079 - DNA, 586 bp, Homo sapiens
  misc_feature: GZ8MTXP02G97G6.10.34.D01.1.454.CMB.2.raw
  modified_base (347)..(347): a, c, t, g, unknown or other
  modified_base (486)..(486): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtggggggtcccttagactctcctgtgcagcctctggattcactttcagtaacgcctggatgaactcgggtccgccaggctccgaggggaagggctggagtgggtgccatattaaaancaaaagctagatgggtagggacaacgagagcacgcgtgcacccgtagaaaggcagacttcagcatctacaagagatagaattacgaaaaagtacgtatagtatcgtagaacatacgaaacacggaccgaagaaaacggnggaaacaacgacggtaccgtagttacttacgtagttacggacctaccgtacgtaacgggaacctaattacgttcgttacgtagtaacggttggttaaccg

SEQ ID NO: 407080 - DNA, 594 bp, Homo sapiens
  misc_feature: GZ8MTXP02H3EWH.10.34.D01.1.454.CMB.2.raw
  modified_base (501)..(501): a, c, t, g, unknown or other
  modified_base (579)..(579): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggtattttccttgctgcttattttaaaaggtgtccagtgtgaggtgcagctggtggagtcgtgggggaggtcgttagggtaaaggtccggtggggggtcccttagaccttctccgtgtgcagcctctggattcactttcagtaaccgcctggatgaacgtgggtccgccgaggctccgaggggacgggcgtgggaggtggggtggacctagtaaattaaaatcaaaagctaggagtgggtagggaacaacgaggacgcgacgctacgaccacccgtaggaaacgcagtactcagcatcacgaagagaatgaacttaacaaaagtcgacttagtatactagaaacatacgaanacgactaaggaaacggagacacgagtccgtattactactgacgacccacgtcgaacgtaaccgtaattcgttacgttntaacgagttcggacg

SEQ ID NO: 407081 - DNA, 577 bp, Homo sapiens
  misc_feature: GZ8MTXP02IG76O.10.34.D01.1.454.CMB.2.raw
  modified_base (261)..(261): a, c, t, g, unknown or other
  modified_base (279)..(279): a, c, t, g, unknown or other
  modified_base (319)..(319): a, c, t, g, unknown or other
  modified_base (321)..(321): a, c, t, g, unknown or other
  modified_base (344)..(344): a, c, t, g, unknown or other
  modified_base (400)..(401): a, c, t, g, unknown or other
  modified_base (407)..(407): a, c, t, g, unknown or other
  modified_base (413)..(413): a, c, t, g, unknown or other
  modified_base (429)..(429): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttcctgctgcttaattttaaaaggtgtccagtgtgaggtgcagctgggtggaggtcgtgggggagcgttaggtaaagccggtgggggtcccttagactctctgtgcngcctctgtattcactttnagtaacgctgatgacgtcggccgcaggctcgaggggaggngnggaggtggtgactataattaaancaaagctagagtgggtaggacaacgagacgcacgctcgcaccgagaagcagatgannatctanaagagntagaataacaaaagtnactagtatactaagaactagtacgaaacgagaaccgtaagaaaacgggacgaaccacgacgtaccggttagttaaacttcgtacgtacgaccctaacgtccgaaacggtaaccgtaaatttcgttacgtagtacgtacgtacggttcg

SEQ ID NO: 407082 - DNA, 694 bp, Homo sapiens
  misc_feature: GZ8MTXP02JK4FF.10.34.D01.1.454.CMB.2.raw
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctattttaaaaggtgtccagtgtgagtgcagctggtggagtcgtgggggagtcgttggtaaagccgtgggggtcccttagactctcctgtgcagcctctggtattcactttcagtaacgcctgatgactggtccgccaggcctaccgaggggaagggctgggaggtgggttgccaattaaattaaaatcaaaagctaggagttcggggtagggaacaaacaggagcaaccgcgtacgacccgtaacccggtagaaaacgggcaaggtattaccaagcctacgtactaccgaaaggaagtaagttagaaacgtttaaaccgaaaaaacgttaccggaacttagtaaacttctagtaaactaagtagaaaccgtaacggacccgtaaaggaaaacccggggaagaaccgaacgaaaccggtccgttacgttaacgttacgtacggtaccggtaacccctaaacgtacggaacggtaacccggtatttacgtttacggttaccgtttacggtaacgtttacgggttaaccgg

SEQ ID NO: 407083 - DNA, 560 bp, Homo sapiens
  misc_feature: GZ8MTXP02IGMK9.10.34.D01.1.454.CMB.2.raw
  modified_base (346)..(346): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcttggtaaagccgtgggggtcccttagactctcctgtgcagcctctggattcactttcagtaacgcctggatgaactgggtccgccaggcctccgaggggaagggctggagtgggtggccatattaaaancaaaagctagatgggtagggacaacagagcacgctgaccacccggtagaaacgggcaagattcagcatctacaagagatagaattaacgaaaaagtcgactagtaatctagaacatagaacagacgtagaaaacggaggacacgacgaccgtagtattactagtcgtaccactcgaacggaaccgtaattattacgttcgtagtacgtaggtcg

SEQ ID NO: 407084 - DNA, 661 bp, Homo sapiens
  misc_feature: GZ8MTXP02HZXGI.10.34.D01.1.454.CMB.2.raw
  modified_base (457)..(457): a, c, t, g, unknown or other
tcagcatagtagtgcacgaccggtgctcgatttagatcgtctgtgttgggtttggggggagaggagccccagcccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcttggtaaagccgtgggggtcccttagactctcctgtgcagcctctggtattcactttcagtacgcctggatagaacgtcgggtccgccgaggccgtaccgaggggaacggggcgtagggaggtggggttggaccgtaattaattaaaatcgaaagcgtagagtgggtaggaacaacgagagacgacgcgtcgacacccgtagaaacgcagtacttcgagtacaagtctacgaaaggtanagttagaactttaaacgaaaaagtccgtaatttaggaaacttaccgtaagaaactagtaacgaaacgacgtaacccggtaaaggaaaaaccgggcgaaaccgaaacgacgggtacccgttagttaaacgttacgtacggtaacacccgtaacgtaccggaacgggtaaccttatttagtttcgtctaggtacggttacggtacg

SEQ ID NO: 407085 - DNA, 553 bp, Homo sapiens
  misc_feature: GZ8MTXP02FFWWW.10.34.D01.1.454.CMB.2.raw
  modified_base (302)..(302): a, c, t, g, unknown or other
  modified_base (378)..(378): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtggggggtcccttagactctcctgtgcagcctctggattcactttcagtaacgcctggatgaactgggtccnccaggctccgaggggaaggggctggagtgggtgccatataaaatcaaagctgatggtgggacaacgagagcacgcngcaccgtgaaaggcagattacagcatctcaaagagatagaattacaaaaaagtacgactgtaatctagaacatagaaacagacctaggaaaacggaggaacacgaacgtccgtagtattaacctgttacgccaacctcgaacggaaccgtataacttgttactagacttggtacg

SEQ ID NO: 407086 - DNA, 713 bp, Homo sapiens
  misc_feature: GZ8MTXP02JIBEL.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcggtgggggaggtcgttagggtaaacggccggttgggggggttcccttaaggacttcctccgtgtgcacgcctcgtggtattctactttcagtaaccgccgtggactcgaacgtcgggtcccgccgaggccgtccggaaggggaacggggtcgtggggaggttggggttcggacctaagttaaattaaaaactacaaaagtctagacgttggggtagggaaccaaagaggacgaccacgctcgacccgtaacccggagaaacggacaaggtacttacgaacgacaactcctaacgaaaagagtattaagtaaacttaaaacgaaaaacgtcgtagtacgttactacgtagaaacagtaacgaaacacggtaacccgaaaggaaaacggcgaaacacgaacggtccgttaagttacgttacggtacgtaccgtaccgtaccgttacgaaacgggtaaccgttaacgtttagtttaacggtccgttaaaggtacggtacggttaaccgg

SEQ ID NO: 407087 - DNA, 610 bp, Homo sapiens
  misc_feature: GZ8MTXP02I41TP.10.34.D01.1.454.CMB.2.raw
  modified_base (434)..(434): a, c, t, g, unknown or other
tcagcatagtagtgcacgaccggtgctcgatttagatcgtctgtgttgggtttgggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagcgttggtaaagccgtgggggtcccttagactctcctgtgcagcctctggattcactttcagtacgctggatgacgtggtccgcgaggctccgaggggaacgggcgtggtaggtggggttcggacctaattaattaaaatcgaaaagcgtagagtgggtaggacaacaggagcacgcgtagccgaccggtagaaacggcagactcagtcatctacaaganatagtaacttaagaaaacgttcgacttagtaactcgtaagaacagtaacgaacgagtaccgtaaagaaaaccgggagaacgaacgacgtaccgttagtactttacggtcgtaccggaccacgttacggaacggtaacctacgtttagttcgttaccgtaggtaacgttcgggtacg

SEQ ID NO: 407088 - DNA, 640 bp, Homo sapiens
  misc_feature: GZ8MTXP02JGVYB.10.34.D01.1.454.CMB.2.raw
  modified_base (255)..(255): a, c, t, g, unknown or other
  modified_base (578)..(578): a, c, t, g, unknown or other
  modified_base (599)..(599): a, c, t, g, unknown or other
  modified_base (605)..(605): a, c, t, g, unknown or other
  modified_base (631)..(631): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgcttatttaaaggtgtccagtgtgaggtgcagctggtggagtcgtgggggagcgttggtaaagccgtgggggtccttagactctctgtgcngcctctggattctactttcgagtaacgccgtggatcgaacgtcggggtcccgccaggcctccgagggggaagggcgtagggtaggtgggttcggacctaagttaattaaaaactacgtaaaacgctagtagttagggacgggaaccaaacgacggaacgccgaaccgccgtacgacccggaaccccggtagggaaaacggtaccgaagtaaacttccgaagttcccaaattaccaacgaaaaggacgtaataaggtaacttaaagaaaaacgtcgtactagttactacgtagaaacagtagaaaccagacccaagggaaacgngtacactagccgtatagtacnggtacncacgtgacggctattacgtcggttancgtataggc

SEQ ID NO: 407089 - DNA, 643 bp, Homo sapiens
  misc_feature: GZ8MTXP02FG7UY.10.34.D01.1.454.CMB.2.raw
  modified_base (291)..(291): a, c, t, g, unknown or other
  modified_base (583)..(583): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggtcttagggtaaagccggttggggggtcccttagacctctcctgtgcagcctctggattctactttcagtaacncctggatgactcggtccgcgaggctaccgaggggagggcgtgggaggtgggtcggaccaataaattaaaagtacaaaagtctaggtagtggggtacgggaacaaacgagaacgccaacgcctcgacctaacccggtagaaacggcagtacttcaagcatactacaaagagatagtaacttaacgaaaaaagtacgactagtactacgtagaactagtagaaccgacgacgtaacggaaaacggagtaacaacgacggaccgttagtacgttactcggtaccgaccgtaaccnccggtaaacggtaacccgtaatttacgtttacggttacgtacggaaggttcgggttaacg

SEQ ID NO: 407090 - DNA, 615 bp, Homo sapiens
  misc_feature: GZ8MTXP02JVK41.10.34.D01.1.454.CMB.2.raw
  modified_base (355)..(355): a, c, t, g, unknown or other
  modified_base (380)..(380): a, c, t, g, unknown or other
  modified_base (385)..(385): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtggggggtcccttagactctcctgtgcagcctcgtggattcactttcagtaacgcctggatgaacgtgggtccgccaggcctccgaggggaagggctgggaggtgggttggccagtaattaaaancaaaagctagagtgggagggacaanaggancgacgctcggaccacccggtagaaaaggcaaagtacttacgacgactaatcgtacgaaagagatacggtaaattaaacgaaaaagtcgtactagttactcgttaagaaacataacgaaacacggaccgtaaggaaaacggaggaaccacgacggtccgttagtacttacgtagacgtacccgacgttacgaacggtaaccgtattagttcgttacgtagtacgtggtacg

SEQ ID NO: 407091 - DNA, 641 bp, Homo sapiens
  misc_feature: GZ8MTXP02F3LQZ.10.34.D01.1.454.CMB.2.raw
  modified_base (425)..(425): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttggctgagctggtattttccttgctgctattttaaaggtgtccagtgtgaggtgcagcgtggtggagtcgtgggggaggtcttggtaaagccgtgggggtcccttagactctcctgtgcagcctcgtggattcactttcagtaacgcctggatgaacgtgggtccgccaggcgtccgaggggacgggctgggaggttgggttggcctaattaattaaaatacgaaagctagagtgggtaggaacaagagagccaacgcgtcgaccacccggtagaaaggcctaagtnttacgagactaactctacgaaagaagaattagtaaactttaaagaaaaaacgttccgtagtagtaaacttaccgtagtaaaccagttaagaaaccgtagacccgtaaagggaaaaccggacgaaacgaacgacgaccggttagtacttacggtcgtacgacccgtaactacgaacggtaaccgaagtttattcggtacctacggtagtcgtaacgg

SEQ ID NO: 407092 - DNA, 729 bp, Homo sapiens
  misc_feature: GZ8MTXP02IR4YH.10.34.D01.1.454.CMB.2.raw
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttcctgctgcttattttaaaggtgtccagtgtgaggtgcagcgtgggtggagtcggtgggggaggcgttagggtaaacggccggttggggggtcccttaagacctcctcctgtgcagcctcgtggtattcctactttcagtaacgcctggatgaacgtcggtccgccgacggctaccggaggggaaggggcgtaggggaggttggggttacggcctaaagttaaattaaaactacgaaaagtctaggtagttaggggtacgggaacaaacgagacgaccgaccggcgtcgacccgtaacccgggtagaaacgggacaaggtacttacgagtactaactactaacgaaagtaagtataacggtaaactttaaaacgaaaaacgtccgtacgttagtaactacttaacgaactacgtaacgaaacgtacggtaaccggtaacgggaaaaaacggggacggaaccaacgacggtaccgttagttactttaccgtaggtcccgaccgttaacctaccgtaacggtaacccgttaaagtttcgtttacggttaccgtttaggtaacgttcggttaacgg

SEQ ID NO: 407093 - DNA, 664 bp, Homo sapiens
  misc_feature: GZ8MTXP02GTGZ0.10.34.D01.1.454.CMB.2.raw
  modified_base (349)..(349): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggaggtcgtgggggaggcgttggtaaagccgtggggggtcccttagactctcctgtgcagcctctggattcactttcagtaacgcctggatgaacgtggtccgccaggctccgaggggagggctggaggtgggtgcctataataaaancaaagctagatcgggtagggaacaacaggagcacgctgaccctaccggtagaaacggcaaggtattacgagacagtactacgaaagagaagttagtaacttaaacgaaaaacggttacggtacttaggtaacttacgtaagtaaacctagtaacggaaaccgtaacggtaacccgtaaacgggaaaaaaccggggaacggaaaccgtaaacgtaacgggtaacccggttggttaaaactttacggtacggtccgacctaaccgtaccgaacggaaccgttaattacgtttagttccgtaggtacgtacggtaacg

SEQ ID NO: 407094 - DNA, 689 bp, Homo sapiens
  misc_feature: GZ8MTXP02FZP7M.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtgggggtcccttagactctcctgtgcagcctctggattcactttcagtacgcctggatgaacgtggtcccgccaggccgtccgaggggaagggcgtgggaggtgggttcggaccaattaattaaaatcaaaagctagagtggtaggaacaaacgagagacacgctcgaccacccggtagaaacggcaaggtacttacgaagctaatactaacgaaagtaacgattaagtaaacgtttaacgaaaaaaaggttaccgtaacgttaagttaaacgttaccgttaaggaaaacctaagttaacgaaaacccgtagaacccggtaaaggaaaaaaccgggacggaaaccgaaacgaacggtaccgttaggttaaacgtttacgtaggttaccgtacccgaaccgttacgaaaccggtaaccgtaacgttagtttacgttacgttaggtacgttaggttaaccg

SEQ ID NO: 407095 - DNA, 687 bp, Homo sapiens
  misc_feature: GZ8MTXP02JWXWB.10.34.D01.1.454.CMB.2.raw
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggtattttccttgctgctattttaaaaggtgtccagtgtgaggtgcagctggtggaggtcgtgggggaggtcgttaggtaaacggccggttgggggtcccttagtacctcctccgtgtcgcacgtccttcgtggtacttctactttcagttaaccgccgtggatcgaacgtcgggtcccgccgacggctaccggaggggaacggggcgtgggaggtggggttcggacctaattaattaaaagtcaaaagtctaggagtcgggtaggaacaagagacgcgacgcgtcgaccgaccgtagaacgcgagtacttacagtccaatacacaagagtatagtaattaacaaaaagtccgaagtagtactacgtaacgaaactagtaacgaaacgaacggaaccggtaaacggaaaaacgggcggaaaaccgaacgtaaccggtaccggttaagttaacgttaacgtcggttaccgacccgttactacccggaagggtaacccttagtttaaacgttccggttagtaggtacgtacgggtttacg

SEQ ID NO: 407096 - DNA, 621 bp, Homo sapiens
  misc_feature: GZ8MTXP02FIPUD.10.34.D01.1.454.CMB.2.raw
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttcctgctgcttattttaaaaggtgtccagtgtgaggtgcagctggtggagttcgtgggggaggtcgttaggtaaagccggttggggggtcccttagactctcctgtgcagtcctcgtggacttcactttcaagtaacgcctggatgaactggccgccaggctccgaggggaaggggctgggaggtgggtcggcctaataaattaaaatacaaagctgtagtgggtagggaacaacgagagccacgctcgaccaccgtagaaggcagtattaccgagacctatactacgaaagagatagtaacttaagaaaaaacgtcgtacttagtaataccaagtaacctaagaagaaaccgacgtaacgaaaacggaaaacggacgaacgacgacgtaccgtaagttacttaacgtcgtacgctacgacgaacggtaacctaagttatttcgtaattcgtaacgtcggttacg

SEQ ID NO: 407097 - DNA, 667 bp, Homo sapiens
  misc_feature: GZ8MTXP02JKEBQ.10.34.D01.1.454.CMB.2.raw
  modified_base (262)..(262): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttcctgctgctattttaaaaggtgtccagtgtgaggtgcagctggtggagtcgtgggggagtcgttggtaaagccgtgggggtcccttagactctcctgtgcagcctntggattctacttcagtaaccgccgtgatggaactcgggtaccgcgaggctccgaggggagggctgggaggtgggtggacctaataattaaaatacaaagtctaggtagtcgggtaggaaccaacgaggacgccaacgcctacggaccctaaacccggtaggaaacggcgtaaacgtactttaccgaagtaccaacgtacttacgaaaggatagtaaggtaaactttaaacgaaaaaacgtcgtaccgttaggttaacttaccgtaagaaaacctagttaacggaaaccacggtaacccgtaaaggaaaaccggaggaacaaacgtcgaccgtttagtactacgtacgtacgccttaacgccgaacgaaccgtattaacgtttggtacctaggtacctcggtaacg

SEQ ID NO: 407098 - DNA, 610 bp, Homo sapiens
  misc_feature: GZ8MTXP02JO4W9.10.34.D01.1.454.CMB.2.raw
  modified_base (264)..(264): a, c, t, g, unknown or other
  modified_base (284)..(284): a, c, t, g, unknown or other
  modified_base (290)..(290): a, c, t, g, unknown or other
  modified_base (303)..(303): a, c, t, g, unknown or other
  modified_base (350)..(350): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttgggtaaagccgtgggggtcccttaggactctcctgtgcaggccnctggattcacttcagtaacncctggntgaactgggtccncaggctccgaggggaggggctggaggtgggttggccagtattaaaancaaaagctagatggtgggacaacagagcacgctcgacacccgtgaaagcagattcagccatctcaaagagtaagagtaaagttaaccgaaaaaagttacgtactacggttaaactccgttaagaaactacgttaagaaacccgaaggtacccaaacggggaaaaccgggaacgggaaccaacgtaacgaccggttaggttaactacgtacgttcgaccctacgtcgaacgaaccgattaacgttcgtactggatcggtag

SEQ ID NO: 407099 - DNA, 657 bp, Homo sapiens
  misc_feature: GZ8MTXP02FYM8V.10.34.D01.1.454.CMB.2.raw
  modified_base (298)..(298): a, c, t, g, unknown or other
  modified_base (347)..(347): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttcctgctgctattttaaaaggtgtccagtgtgaggtgcagctggtggagtcgtgggggaggcttggtaaagccgtgggggtcccttagactctcctgtgcagcctctggattctactttcagtacgctggatgactggtccncgaggctcgaggggagggctggagtgggtgcataattaaaatcaaaagntagagtcggtagggacaaacgaggacgccgaacgctcggccgtaacccggtagaaaagggccaagtacttaccgagaccatactacaagagatagtaattaaacgaaaaacgtcgtacttagtactacgtagaaactagtaagaaaccgacgtaaccggtaaacggaaaaacgggaacggaaaccaaccgaacggtacccggttaagtttaactttaaccgtggttaccgacccgtaaccgttacgaaaccggggtaacccttaagttaagttttaccggttcgtttacggtaacggttgggtttaaccg

SEQ ID NO: 407100 - DNA, 734 bp, Homo sapiens
  misc_feature: GZ8MTXP02IROIT.10.34.D01.1.454.CMB.2.raw
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggtattttccttgctgcttatttaaaaggtgtccagtgtgaggtgcagcgtgggtggagtcggtgggggaggtcgtttagggtaaacggtccggtcggggggttaccccttaggacttccgtcctggtcgcacgtcctcgtggtattctactttcaagtaacgcgtaggtatacgaacgttcgggccaccgacggccgtaccggaggggtaacgggcgtgggtaggttggggtgacctaagttaaattaaaatacgaaaagtcgtaggtacgtaggggtacggaacaacgaagacgaccgacgtcgtaccggaccgaacccggtaaggaaacgggacaaaggtacttacgacgactatcgtaaacgaaagtagtaagtaagtaaacttaaaacgaaaaaacgttcgtaacgttacgttaacgtaaccgttaagaaaacaacgtaacggaaaccttaacggaacccggaaaaggaaaacgggacgaaaccgtagtaaccggtacgttaaggttaactacgtaggtaccaccgtacgtaacgacgtaacgttagttagtttacggtagtacgtaggttaggtaccg

SEQ ID NO: 407101 - DNA, 602 bp, Homo sapiens
  misc_feature: GZ8MTXP02GQF4M.10.34.D01.1.454.CMB.2.raw
  modified_base (262)..(262): a, c, t, g, unknown or other
  modified_base (518)..(518): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgtgggggtcccttagactctcctgtgcagcctntggtattctactttcagtaacgcctggatgaacgtcggtccgccgaggctccgaggggagggcgtggagtgggtgcataataaatcaaagtctagagtggtaggacaacgagacgcacgctcgaccaccggtagaaacggcaaggtattacagacctagtactaacgaaagagtattaacgaatttaaacgaaaaagttcgaactaggttactctaagaaactagtaacgaaacctacgtaccaaaggaaaacggngaaccagacgtacgttagtaacttcgagtccgacctacgtacgaacggtaaccgtattacgttcgtccgtaggacgtggttacg

SEQ ID NO: 407102 - DNA, 674 bp, Homo sapiens
  misc_feature: GZ8MTXP02FSVDI.10.34.D01.1.454.CMB.2.raw
  modified_base (553)..(553): a, c, t, g, unknown or other
  modified_base (558)..(558): a, c, t, g, unknown or other
  modified_base (609)..(609): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgacttaattttaaaaggtgtccagtgtgaggtgcagcgtggtggagtcgtgggggaggcgttggtaaagccgtgggggtcccttagactctcctgtgcacgtcctctggattcctactttcgaagtaacgccgtggatacggaacgtcgggtccccgccgacggccgtaccggagggggaacggggtcgtagggtaggttggggttacggaccgtaaaagtaaacttaaaaaagttaccaaaagcgttaggtaagtacggggtacgggaaaccaaagaacggacgactaaccggcgtcgacccgtaaacccggtagaaaacggcaagtattaccagactacgtactacgaaagtagataagtaactaacaaaaagtcgatagtatactanaatanagaactacgaccgtaaggaaacgaggaacacgacgtaccgtataacttacncgttacgaccctacaccgtaacggaaccgttagtttacgttagtacgttacgtagtcggttaacg

SEQ ID NO: 407103 - DNA, 724 bp, Homo sapiens
  misc_feature: GZ8MTXP02HQXSS.10.34.D01.1.454.CMB.2.raw
  modified_base (257)..(257): a, c, t, g, unknown or other
  modified_base (378)..(378): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggtattttccttgctgtctaattttaaaaggtgtccagtgtgaggtgcagctggtggagtcgtgggggaggcttaggtaaaggccggtgggggtccttagactctccngtgcagcctcgtggtacttcactttcagtaacgcctggatgaacgtcggtcccgcgaggccgtacccggaaggggacgggcgtgggaggttggggttcggacctaaagttaaattaaaaanacgtaaaaagtcgtagtaagtagggtaggaaacaacgagagccgaacgcctacgaccaacccgtaggaaaacgcaaaggtacttacgacgtactactacgtaacgaaagaagtaataaggtaaacttaaaacgaaaaacgtacgtaaccgtttagtaacttaccgttaaagaaactaacgtaaacgaaaaccgaacggtaaacccggtaaaacggaaaaccgggaacggaaaccgaaacgtaaccggtaccggttaaacgtttaacgtacgtacggttaccgtacccgtacgttaacgaaacggtaaccgttaaattacgtttagtacgttagaacgtttggtacg

SEQ ID NO: 407104 - DNA, 631 bp, Homo sapiens
  misc_feature: GZ8MTXP02GE5ZI.10.34.D01.1.454.CMB.2.raw
  modified_base (263)..(263): a, c, t, g, unknown or other
  modified_base (353)..(353): a, c, t, g, unknown or other
  modified_base (425)..(425): a, c, t, g, unknown or other
  modified_base (484)..(484): a, c, t, g, unknown or other
tcagcatagtagtgcacgaccggtgctcgatttagatcgtctgtgttgggtttggggggagaggagccccagccttgggattcccaagtgttttcattcagtgatcaggactgaacacagaggactcaccatggagtttgggctgagctggattttccttgctgctattttaaaaggtgtccagtgtgaggtgcagcgtggtggagtcgtgggggagcgttggtaaagccgtgggggtcccttagactctcctgtgcagcctntggattcactttcagttaacgcctggatgaacgtcggtccgcgacggctcgaggggaagggcgtggaggtggggtgactataattaaaancaaagcgtagatggtacggacaacgagagacacgctcgaccgtaccgaggaaagcaagtattacgacgtacntactacgaaagtagagttagaactttaacgaaaaacgtcgtaccgtagtataccgtaanaaacgtagaacgaacgacggaaccgtaaacggaaaacggaacggaacgacgtaacggtaccgtaggttacttacggtacgtaccgtaccgaccgtaacggtaaccgtaacgttacgttacgtttcgttacgtagtacgtacggtacg

SEQ ID NO: 407105 - DNA, 701 bp, Homo sapiens
  misc_feature: GZ8MTXP02FNOKO.10.34.D01.1.454.CMB.2.raw
  modified_base (469)..(469): a, c, t, g, unknown or other
tcagcatagtagtgcacgaccggtgctcgatttagatcgtctgtgttgggtttgggggggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcggtgggggaggcttaggtaaagccgtcggggggtcccttagactctctgtgcagcctctggattcactttcagtaaccgctggatgaacgtgggtcccgccgaggcgtccgagggggaacggggcgtgggaggtggggttcggacctaattaaattaaaagtacgaaaagtcgtagtagtaggggtacggggaactaaacgagagccaacgtcgtacgacacccggtaagaaacggcagtatttcgaacgctaagtacctanaaagtacgattaagtaaactttaaacgaaaaaacgtaccgtacgttagttaactacgtaagaaaaccgtaagtaaggaaaccgaagtacccgtaaagggaaaaaccgggaggaaacctaacgaacggtacccggttagttaacttaccggtacggtaccgtacccaacgtaccgaacggtaaacccgtagtttaaccgtttacggttacgttacggtacgttagggtaaccg

SEQ ID NO: 407106 - DNA, 452 bp, Homo sapiens
  misc_feature: GZ8MTXP01ES3M4.19.25.C03.1.454.CMB.2.raw
  modified_base (233)..(233): a, c, t, g, unknown or other
  modified_base (445)..(445): a, c, t, g, unknown or other
  modified_base (447)..(452): a, c, t, g, unknown or other
tcagtactctcgtgcacgaccggtgctcgatttagtagtgtagatttgggtttgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattacngtggccggggtagtggttatttgtactactttgactactggggccagggaaccctggtcaccgtctcctcagcctccaccaagggcccatcggtcttccccctggcaccctcctccaagagcacccctctgggggcacagcggccctggggctgcctggtcaagggactacttcccacgagagtactgagcgggctgggcaaggcgcatagngnnnnnn

SEQ ID NO: 407107 - DNA, 450 bp, Homo sapiens
  misc_feature: GZ8MTXP01DYTKU.19.25.C03.1.454.CMB.2.raw
  modified_base (352)..(352): a, c, t, g, unknown or other
  modified_base (445)..(450): a, c, t, g, unknown or other
tcagtactctcgtgcacgaccggtgctcgatttagtagtgtagatttgggtttgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtatggttatttgtactactttgactactggggccagggaaccctggtcaccgtctcctcagcctccaccaagggcccatcggtcttccccctggcaccctcctccaagngcacccctctgggggcacagccggccctggggctgcctggtcaagggactacttcccacgagagtactgagcgggctggcaaggcgcataggnnnnnn

SEQ ID NO: 407108 - DNA, 305 bp, Homo sapiens
  misc_feature: GZ8MTXP01AM0DF.19.25.C03.1.454.CMB.2.raw
  modified_base (305)..(305): a, c, t, g, unknown or other
tcagtactctcgtgcacgaccggtgctcgatttagtagtgtagatttgggtttgggtgcccaagctgctgaaggcctcggacaccgccatgtattactgtggccggggtagtggttatttgtactactttgactactggggccagggaacactggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagn

SEQ ID NO: 407109 - DNA, 477 bp, Homo sapiens
  misc_feature: GZ8MTXP01ER2CJ.19.25.C03.1.454.CMB.2.raw
  modified_base (462)..(462): a, c, t, g, unknown or other
  modified_base (464)..(477): a, c, t, g, unknown or other
tcagtactctcgtgcacgaccggtgctcgatttagtagtgtagatttgggtttgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgcatgtattactgtggccggggtatggttatttgtactacttgactactggggccagggaaccctggtcaccgtctcctcagccctccaccaagggccccagtccggtcctttccccctcggcctacccctccgtaccaagacgccaccccgtcgtgggggcacgacgccggccctgggctgcctggtcaaggactacttcccacgagagtacgtgaggcgggctgggcaaggcgcagtagngnnnnnnnnnnnnnn

SEQ ID NO: 407110 - DNA, 306 bp, Homo sapiens
  misc_feature: GZ8MTXP01D039G.19.25.C03.1.454.CMB.2.raw
  modified_base (304)..(306): a, c, t, g, unknown or other
tcagtactctcgtgcacgaccggtgctcgatttagtagtgtagatttgggtttgggtgcccaagctgctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggctacttcccacgagagtactgagcgggctggcaaggcgcatagnnn

SEQ ID NO: 407111 - DNA, 475 bp, Homo sapiens
  misc_feature: GZ8MTXP01DNXGO.19.25.C03.1.454.CMB.2.raw
  modified_base (460)..(475): a, c, t, g, unknown or other
tcagtactctcgtgcacgaccggtgctcgatttagtagtgtagatttgggtttgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgggccggggtagtggttatttgtactactttgactactggggccagggaaccctggtcaccgtctcctcagcctccaccaagggccccatccggtcttccccctggccacccctcctccaagagccaccccgtcgtgggggcacgacgccggccctgggctcgcctggtcaagggctacttcccagagagtactggagcgggactgggcaagggtcgcatacggnnnnnnnnnnnnnnnn

SEQ ID NO: 407112 - DNA, 303 bp, Homo sapiens
  misc_feature: GZ8MTXP02HJ9MS.19.25.C03.1.454.CMB.2.raw
  modified_base (301)..(303): a, c, t, g, unknown or other
tcagtactctcgtgcacgaccggtgctcgatttagtagtgtagatttgggtttgggtgcccaagctgctgaaggcctcggacaccgccatgtattactgtggccgggtagtggttatttgtactactttgactactggggccagggaacactggtcaccgtctcctcagcctccaccaagggcccatcggtcttcccctggcaccctcctccaagagcacctctggggcacagcggccctgggctgcctggtcaaggactacttccacgagagtactgagcgggctggcaaggcgcatagnnn

SEQ ID NO: 407113 - DNA, 478 bp, Homo sapiens
  misc_feature: GZ8MTXP02GK0NO.19.25.C03.1.454.CMB.2.raw
  modified_base (472)..(478): a, c, t, g, unknown or other
tcagtactctcgtgcacgaccggtgctcgatttagtagtgtagatttgggtttgggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccggagatcatgagggtgtccttgggttttgggggaagagggaagaccgtgacggtccccccaggagttcaggtgctgggcacagcggccctgggctgcctggtcaagggactacttcccacgagagtactgagcgggctggcaaggcgcatagnnnnnnn

SEQ ID NO: 407114 - DNA, 469 bp, Homo sapiens
  misc_feature: GZ8MTXP02FYYCR.19.25.C03.1.454.CMB.2.raw
  modified_base (210)..(210): a, c, t, g, unknown or other
  modified_base (461)..(469): a, c, t, g, unknown or other
tcagtactctcgtgcacgaccggtgctcgatttagtagtgtagatttgggtttggggctgccctttggctttggagatggtttctcgatgggggctgggagggctttgttggagaccttgcacttgtactccttgccattcagccagtcctggtgcaggacggtgaggacgctgaccacacggtacgtgctgttgtactgctcctcccgnggctttgtcttggcattatgcacctccacgccgtccacgtaccagttgaacttgacctcagggtcttcgtggctcacgtccaccaccacgcatgtgacctcaggggtccggagatcatgagggtgtccgttgggtttgggggagaggagacctgacggtcccccaggagtcaggtgctgggcacagcggcctgggctgcctggtcaaggctactcccagagagtactgagcgggctggcaaggcgcatagnnnnnnnnn

SEQ ID NO: 407115 - DNA, 445 bp, Homo sapiens
  misc_feature: GZ8MTXP02FH84Y.19.25.C03.1.454.CMB.2.raw
  modified_base (443)..(445): a, c, t, g, unknown or other
tcagtactctcgtgcacgaccggtgctcgatttagtagtgtagatttgggtttgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacccctctgggggcacagcggccctggggctgcctggtcaaggactacttcccacgagagtactgagcgggctggcaaggcgcatagnnn

SEQ ID NO: 407116 - DNA, 445 bp, Homo sapiens
  misc_feature: GZ8MTXP02HNS3N.19.25.C03.1.454.CMB.2.raw
  modified_base (440)..(445): a, c, t, g, unknown or other
tcagtactctcgtgcacgaccggtgctcgatttagtagtgtagatttgggtttgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccgggtagtggttattgtactactttgactactggggccagggaaccctggtcaccgtctcctcagcctccaccaagggcccatcggtcttccccctggccaccctcctccaagagcacccctctggggcacagcggccctggggctgcctggtcaaggctacttcccacgagagtactgagcgggctggcaaggcgcatagnnnnnn

SEQ ID NO: 407117 - DNA, 440 bp, Homo sapiens
  misc_feature: GZ8MTXP02H8ARU.19.25.C03.1.454.CMB.2.raw
  modified_base (439)..(440): a, c, t, g, unknown or other
tcagtactctcgtgcacgaccggtgctcgatttagtagtgtagatttgggtttgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaccctggtcaccgtctcctcagcctccaccagggccccatcggtcttccccctcggcaccctcctccagagcacccctctggggcacgagcggccctggggctgcctgtcgagactacttcccacgagagtactgagcgggctggcaagcgcatagnn

SEQ ID NO: 407118 - DNA, 552 bp, Homo sapiens
  misc_feature: GZ8MTXP02GG5G0.19.25.C03.1.454.CMB.2.raw
  modified_base (213)..(213): a, c, t, g, unknown or other
  modified_base (233)..(233): a, c, t, g, unknown or other
  modified_base (528)..(552): a, c, t, g, unknown or other
tcagtactctcgtgcacgaccggtgctcgatttagtagtgtagatttgggtttggggctgccctttggctttggagatggttttctcgatgggggctgggagggctttgttggagaccttgcacttgtactccttgccattcagccagtcctggtgcaggacggtgaggacgctgaccacgacggtacgtgctgttgtactgcctcctcccgnggtctttgtcttggcattangccacctccacgccgtccacgtaccagttcaacttgacctcaggtctcgtggctcacgtccacccaccacgcatgtgacctcgacggggtccggagatcatggagggtgttccggtttggggtttgggggaagtaggaagaccgtacgaccggtcccccaggacgttcgaggtgcgtgggctacgagcggcccgtgggcctgcccgtggtacgaaggtacctacgttcccgacgtacggacgtaccgtaggcggaccgggtcgtacggggacgaacgggccgacgtaagtaaggnnnnnnnnnnnnnnnnnnnnnnnnn

SEQ ID NO: 407119 - DNA, 564 bp, Homo sapiens
  misc_feature: GZ8MTXP02FMYZV.19.25.C03.1.454.CMB.2.raw
  modified_base (211)..(211): a, c, t, g, unknown or other
  modified_base (403)..(403): a, c, t, g, unknown or other
  modified_base (541)..(541): a, c, t, g, unknown or other
  modified_base (543)..(564): a, c, t, g, unknown or other
tcagtactctcgtgcacgaccggtgctcgatttagtagtgtagatttgggtttggggctgccctttggctttggagatggttttctcgatgggggctgggagggctttgttggagaccttgcacttgtactccttgccattcagccagtcctggtgcaggacggtgaggacgctgaccacacggtacgtgctgttgtactgctcctcccgnggtcttttgtcttggctattatgcacctccacgccgtccacataccagttgaacttgacctcaggtcttcgtggctcacgtcccaccaccacgcatgtcgacctcgacggggtccggagatcatgagggtgtccgtttggggtttgggggaaagtaggaacgacgtcgaccggtccccccgaggacgttcgnggtcgcgtgggcacgacgcgggcccgtggggccttggcccgtgggtaccgaaagggtacctaaccgttcccgaaacggagtaacgtaccgtgggaacggcggggacgtgggaccgaaacggggcgaccgaaaggtagngnnnnnnnnnnnnnnnnnnnnnn

SEQ ID NO: 407120 - DNA, 523 bp, Homo sapiens
  misc_feature: GZ8MTXP01DSBYF.21.15.B04.1.454.CMB.2.raw
  modified_base (337)..(337): a, c, t, g, unknown or other
  modified_base (493)..(493): a, c, t, g, unknown or other
tcagtcgtcgctcgcacgaccggtgctcgatttagacagtatatatccgcgggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccagccggggggtccctgagactgtcctgtgaagtctctggattgtatagcagagattggatgcactgggtccgccagacttcaggaaaggggtctggagtggggtggcccaaanataaaccaagatggaaagtgtgaagcactatgtggcctctgtgaggggccgattcacaatctccagagacagtgccaaagaactcgttgtatctgacaaatgggaacagcctgagagaccgaggacacggctctctattactgttgcgacggattnttggctacgtcatgcgtcgttggggaaccg

SEQ ID NO: 407121 - DNA, 553 bp, Homo sapiens
  misc_feature: GZ8MTXP01DLBH1.21.15.B04.1.454.CMB.2.raw
  modified_base (306)..(306): a, c, t, g, unknown or other
tcagtcgtcgctcgcacgaccggtgctcgatttagacagtatatatccgcggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaaataagactactagcttggaccagcagcaaccaggacaacgtcctaaattgctcatttacnggcatctgtccgggaatccggggtcctgaccgattcgttggcagcggtctgggcagatttcactctcaccatcagcagcctacaggctgaagatgtggctaagttttatttttgggtattgactaactattatcgccgtctcccgtctccgtacgtttccgggaacgggtacgggaccctaaggggttcggaagtacgttaccgaaaacggttaacgtggtacgggctggacacctaacgttcttcg

SEQ ID NO: 407122 - DNA, 508 bp, Homo sapiens
  misc_feature: GZ8MTXP01AVHQ6.21.15.B04.1.454.CMB.2.raw
  modified_base (306)..(306): a, c, t, g, unknown or other
  modified_base (356)..(356): a, c, t, g, unknown or other
  modified_base (430)..(430): a, c, t, g, unknown or other
tcagtcgtcgctcgcacgaccggtgctcgatttagacagtatatatccgcggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatccctctccgacaataagaactacttagcttggaccagcagcaaccaggacaacgtcctaaatgctcatttacnggcatctgtccggatccgggtcctgaccgattcgtgcagcggtctgggcngatttcactctcaccatcagcagcctacaggctagagatgtgctagttttattttggatgcaactattatgccnctcccgctcacgtttcgggcggtagggaccaaaggttggaagattacgaaacgactgtaggctggcaacctgttcgtg

SEQ ID NO: 407123 - DNA, 516 bp, Homo sapiens
  misc_feature: GZ8MTXP01EB28J.21.15.B04.1.454.CMB.2.raw
  modified_base (306)..(306): a, c, t, g, unknown or other
  modified_base (437)..(437): a, c, t, g, unknown or other
  modified_base (510)..(510): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagaactactagcttggaccagcagcaaccaggacaacgtcctaaatgctcatttacnggcatctgtccgggaatccggggtcctgaccgtattcgttggcagcgggtctgggcagatttcactctcacatcagcagcctacaggctgaagatgtggctagttttattttgggtatgctaaactattangtcccgctccgtctctacgtttcggcggtagggaccaaggttggaagattacgaaagactgtggctgcacctnttcttg

SEQ ID NO: 407124 - DNA, 514 bp, Homo sapiens
  misc_feature: GZ8MTXP01C8BEQ.21.15.B04.1.454.CMB.2.raw
  modified_base (402)..(402): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaaataagactacttagcttggacagcagcaaccaggacaacgtcctaaattgctcatttactgggcatctgccgggaatccgggtcctgaccgattcgttgcagcggtctgggcagtatttcactctcaccatcagcagcctacaggctgaagatgnggctagtttatttttgggtatgacaactattatgccgctccgtctctacgtttggcggagggaccaaggttggagattacgaaacgaactgtggctgcacctaattcgttcg

SEQ ID NO: 407125 - DNA, 543 bp, Homo sapiens
  misc_feature: GZ8MTXP01EFWWS.21.15.B04.1.454.CMB.2.raw
  modified_base (353)..(353): a, c, t, g, unknown or other
tcagtcgtcgctcgcacgaccggtgctcgatttagacagtatatatccgcgggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccaggccggggggtcctgagactgtcctgtgaagtctctggattgtatagcagagattggatgcacgtgggtccgccagacttcgaggaaaggtctggagtgggtgccaacataaaccaagatggaagtgngaagcactatgtgctgtgtgaggggccattcacatctcagagacagtacgaccaaagaactcgttagtatctgacaaagtggaacaggcctggacgaggcccgggagaccgacgtctctaactattacgtgttcgccggaacggattgttcggtctacggtcagttcgccgtccggttcgggtaacccgg

SEQ ID NO: 407126 - DNA, 587 bp, Homo sapiens
  misc_feature: GZ8MTXP01B18E7.21.15.B04.1.454.CMB.2.raw
  modified_base (538)..(538): a, c, t, g, unknown or other
tcagtcgtcgctcgcacgaccggtgctcgatttagacagtatatatccgcgggggtctcagagaggagccttagccctggactccaaggcctttccacttggtgatcagcactgagcacagaggactcaccatggaattggggctgagctgggttttccttgttgctattttagaaggtgtccagagtgaggtgaagtggtggaggtcgggggaggcttggtccaggccggggggtccctgagactgtcctgtgaagtctctggattgtatagcagagattggatgcacgtgggtccgccagacttcgaggaaagggtctggaggtgggtggacccaaacaactaaaccaagataggaagtgtagaagcactatgtgcctcgtggtgggaggggccgattcacaactctccgagagacagtacgaccgaaagtaacttcgttagtatctagacaaagtgggacacggcctaggacgacgaccggaggaccacggtctcgtaacttattacgtggttcgaccggtaccggttagttcgngggtccttacgtcgtacgttcggacccggttccggttcgggggaacccg

SEQ ID NO: 407127 - DNA, 600 bp, Homo sapiens
  misc_feature: GZ8MTXP01EJT1F.21.15.B04.1.454.CMB.2.raw
  modified_base (246)..(246): a, c, t, g, unknown or other
  modified_base (325)..(325): a, c, t, g, unknown or other
  modified_base (421)..(421): a, c, t, g, unknown or other
  modified_base (424)..(424): a, c, t, g, unknown or other
  modified_base (426)..(426): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggacgaaaggccaccatcaactgacaagtccagcccgagtgtcttatcctcctccngacaatagactcttagctagtacagacacgacaacacgacaacgtactaatcactactatttacgtggtctatcgtacngggtacccccggtaacggtccgggtccctcgtaccgtaacgttcggttcggtcgacgggtccgggtcggtacggtacgacgtacttcactctcacncancnacacgaccgacgacgtacgacggtacgtacgtacgtacgttagttagttagtttagtttagttacgttactactactacgtaactcgttccgtccgttccgtccgtccgttccggttcggttacggaacggtacggtaacggtacggtacggttaacgtaacgttaacgtaacg

SEQ ID NO: 407128 - DNA, 593 bp, Homo sapiens
  misc_feature: GZ8MTXP01DCOA7.21.15.B04.1.454.CMB.2.raw
  modified_base (309)..(309): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatccctcctaccgacaaataagaactactagcttggaccagcagacaacaggacaacgtcctaaatgctcatttacnggcatctggtaccgggatcccggggtaccctgaccgtattcggtggacgaggtcggtcgtagggcagtatttccactctacacactacagacacgtccacgaggctagaagtagtgtcggattaagttttattttggtaattgactaaactatttacgcgtccgtcctcccgtctaccgtacgtttcggggaacgggtaacgggaccggtaaagggttaggaaataacgttaaccgaaaaccggttacgtggtaggcttacgaccttaccctaagttcgttaac

SEQ ID NO: 407129 - DNA, 510 bp, Homo sapiens
  misc_feature: GZ8MTXP01DL2PH.21.15.B04.1.454.CMB.2.raw
  modified_base (334)..(334): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctggcgaaagggccaccatcaactgcaagtccagcccgagtgtcttatcctcctccgacaataagaactacttagcttggaccagcagcaaccaggacaacgtcctaaattgctcatttactgggcatctgtccgggatccgggtccngaccgattcgtgcagcggtctgggcagatttcactctcaccatcagcagcctacaggctagaagatgtgctagtttatttttggtatgactaaactattatcgccgtctccgtctctactttcgggcggaggaccaaggttggagattcgaaagactggtgctgcactaagttctg

SEQ ID NO: 407130 - DNA, 559 bp, Homo sapiens
  misc_feature: GZ8MTXP01DW7NT.21.15.B04.1.454.CMB.2.raw
  modified_base (302)..(302): a, c, t, g, unknown or other
  modified_base (309)..(309): a, c, t, g, unknown or other
  modified_base (412)..(412): a, c, t, g, unknown or other
  modified_base (416)..(416): a, c, t, g, unknown or other
  modified_base (448)..(448): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaagggccaccatcaactgacaagtccagcccgagtgtcttatccctctcgacaataagaactactagcttaggaccagcagacaaccagacaacgtcctaaatgctnatttacnggctatcgtgtaccgggatccggggtcctgaccgtagttcgtggcacggcgggtctagggcagtactttcactctacacatcagcacgcctagaggctagaangtgngacttagtttattttggatgactaactattancgtccgcttccgtctcgtaccgtttcgggaacgggtaagggaccgtaaagggttggaagtaacgttaacgaaacgttacgtgtggtctgaccttactaacgttctttaacg

SEQ ID NO: 407131 - DNA, 600 bp, Homo sapiens
  misc_feature: GZ8MTXP01BD1FJ.21.15.B04.1.454.CMB.2.raw
  modified_base (308)..(308): a, c, t, g, unknown or other
  modified_base (393)..(393): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatccctcctccgacaataagaactacttagcttggaccagcagcaaccaggacaacgtcctaaatgctcatttacnggcatctgtccgggaatccgggtcctgaccgattcggtgcagcgggtctgggcagtactttcactctacaccatcagcagcctanaggctagaagtatgtggtctaagttttattttggggtattgactaaactattacgtcgcccgtccttccgtccttcctaaccggtttccgggaacggggtaacgggttaacccggaaagggttcgggaaagtaacgttaaccgttaaaaacggttaacccgttgggtcgggtccgttacggccttaaacccgtaacttccgtttcgg

SEQ ID NO: 407132 - DNA, 526 bp, Homo sapiens
  misc_feature: GZ8MTXP01EGFTE.21.15.B04.1.454.CMB.2.raw
  modified_base (308)..(308): a, c, t, g, unknown or other
  modified_base (510)..(510): a, c, t, g, unknown or other
  modified_base (519)..(519): a, c, t, g, unknown or other
tcagtcgtcgctcgcacgaccggtgctcgatttagacagtatatatccgcgggggagctacaacaggcaggcaggggcagcaagatggtgtgcagacccaggtcttcatttctctgttgctctggatctctggtgcctacggggacttcgtgatgacccagtctccagactccctggctgtgtctcgtgggacgaaagggccaccatcaactgacaagtccagcccgagtgtcttatcctcctcgaacaaataagaactactagcttggaccagcagcaacaggacaacgtctaaatgctcatttacnggcatctgtccggatcccggggtcctgaccgtattcggtgcagcggtctgggcagtatttcactctacaccatcagcacgcctacgaggctagaagtatgtagcttagttttattttagggtatgtacctaaatattacgtcgccgtctccgtctctacgttcgggaacggtaggacgaggttgagattacgaaacgatggngctgcactnttcgttc

SEQ ID NO: 407133 - DNA, 560 bp, Homo sapiens
  misc_feature: GZ8MTXP01DLB3P.21.15.B04.1.454.CMB.2.raw
  modified_base (307)..(307): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctcgacaaataagaactactagcttggaccagcagcaaccaggacaacgtactaaatgactcatttacnggcatctcggtaccggatccggggtcctgaccgtattcgtggcaggcggtctgggcagtatttcactctacacatcagcacgcctacgaggactagaagatgtgctagtttattttggtatgacaactattatcgccgacttcccgcttcctaccgtttcgggaacgggtaacgggaaccgtaagggttcggaaaggtaacttaacgaaaacggttaacttgggacggtcttcgaccacctaacttcgtttcg

SEQ ID NO: 407134 - DNA, 581 bp, Homo sapiens
  misc_feature: GZ8MTXP01DNDO6.21.15.B04.1.454.CMB.2.raw
  modified_base (310)..(310): a, c, t, g, unknown or other
  modified_base (334)..(334): a, c, t, g, unknown or other
  modified_base (356)..(356): a, c, t, g, unknown or other
  modified_base (388)..(388): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctccgacaaataagaactacttagcttggaccagcagcaaccaggacaacgtcctaaattgctcatttacnggcatctgtccggatccgggtccngaccgattcgtggcagcggtcngggcagtattcactctcacatcagcagcctanaggctagaagatggtggtactagttttattttgggtattgactaaactattactggcccgtcttccgtccttacgtaacgtttcggggaacggggtaacgggaaccggtaaagggttgggaaacgaagttaaccgaaaacgggttaacgttgggtacgggaaccttcggaccttaacccgtaattccgtttcg

SEQ ID NO: 407135 - DNA, 590 bp, Homo sapiens
  misc_feature: GZ8MTXP01BWDQ4.21.15.B04.1.454.CMB.2.raw
  modified_base (309)..(309): a, c, t, g, unknown or other
  modified_base (426)..(426): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccaccatcaactgcaagtccagcccgagtgtcttatcctcctcgacaataagactacttagcttggaccagcagcaaccaggacaacgtcctaaaattgctctatttacngggctatctggtaccgggaatcccgggggtccctggaccgtacgttcgttaggcaggcgggtactgggaacagtactttcactctcacatcagctagcctagaggctagaagatggngtacttagttttaattttggggtatgtactaaactattagtcgtacccgtcttcccgtcttccgtaacgtttcggggaaccgggtaagggaccgtaaggggttggaaggacttacgaaacggaccgtttggacgggtcttcggccttaacccgttgttccgtcg

SEQ ID NO: 407136 - DNA, 539 bp, Homo sapiens
  misc_feature: GZ8MTXP01DAE2C.21.15.B04.1.454.CMB.2.raw
  modified_base (437)..(437): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaaataagaactacttagcttggaccagcagcaaccaggacaacgtcctaaatgctcatttactgggcatctgccgggaatccggggtcctgaccgtattcgttggcagcgggtctgggcagtatttcactctcaccatcagcagcctacaggctgaagatgtgctagttttattttgggtaatgacaaactnttagtcgccgtctccgtctcgtaccgtttcgggaacgggacgggttaccaaagggttggaagattacgaaacgactggtaggctggccacctaagttccttg

SEQ ID NO: 407137 - DNA, 549 bp, Homo sapiens
  misc_feature: GZ8MTXP01CGI54.21.15.B04.1.454.CMB.2.raw
  modified_base (311)..(311): a, c, t, g, unknown or other
  modified_base (376)..(376): a, c, t, g, unknown or other
  modified_base (450)..(450): a, c, t, g, unknown or other
  modified_base (541)..(541): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggacgaaagggccaaccatcaaactgacaagtccagcccgagtgtcttatcctcctccgacaaataagaactactagcttggaccagcagcaacaggacaacgtcctaaatgctcatttacnggcatctgtccggaatccgggtcctgaccgattcggtgcagcgggtctgggcagtatttcactcncacatcagcagcctacgaggctagaagtagtgtggtactagtttttattttggaacttgactaaactatttacncgcctctccgtactcctacgtttcgggaacgggaacgggaccaagggttcggaaagacttacgaaacgttacgtggtaggcctgcaacctnttcgttcg

SEQ ID NO: 407138 - DNA, 575 bp, Homo sapiens
  misc_feature: GZ8MTXP01CHU95.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggaggcttggtccgaggccggggggtccctgagactgtcctgtgaagtctctggattgtatagcagagattggatgcacgtgggtccgcagacttcgaaggaaagggtctgggagtgggtcggaccaaacaataaaccaagaatgggaagtgtagaagcaactatgtcggcctcgtggtggagggggcctattcaacaatctaccagagacagtgacaaagaactcgttagtaatctagactaaagtgggaacacgccgtagacggacgaccggaggtacacggtctcgtcttattacgtgttcgacggaccggattagttcggtctacgtctacttggccgttccggttcggggaacccg

SEQ ID NO: 407139 - DNA, 514 bp, Homo sapiens
  misc_feature: GZ8MTXP01D9ZGX.21.15.B04.1.454.CMB.2.raw
  modified_base (300)..(300): a, c, t, g, unknown or other
  modified_base (307)..(307): a, c, t, g, unknown or other
  modified_base (431)..(431): a, c, t, g, unknown or other
  modified_base (479)..(479): a, c, t, g, unknown or other
  modified_base (500)..(500): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctccgacaataagaactactagcttggaccagcagcaacaggacaacgtcctaaattgctnatttacnggcatctgtccggaatccgggtcctgaccgtattcgtggcagcggtctgggcagtatttcactctcaccatccagcagcctacaggctagaagatgtgctagtttatttggtattgacctaatnttatgccgtctccgtctctacgtttggcgtagggccaaggttgaagtnttacgaaacgacgtgtacggntgcactaattctcg

SEQ ID NO: 407140 - DNA, 613 bp, Homo sapiens
  misc_feature: GZ8MTXP01DXPZP.21.15.B04.1.454.CMB.2.raw
  modified_base (316)..(316): a, c, t, g, unknown or other
  modified_base (367)..(367): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtctccagactccctggctgtgtctcgtgggacgaaaagggccaccatcaactgcaagtccagcccgagtgtcttatccctcctaccgaacaaataagaactactagcttgaccagcagacaacagacaacgtacctaaatgctacatttacgnggcatctgtaccgggatcccgggtcctgacctattcggtgcgaggcggtcngggaacagtattcactctacaccatcagcacgctacgagactagaagtatggtaggtacttaagttttatttttaggggtaattcgaactaaactatttaacgcgtcccgtcctccgtcctacgttaaccggtttcggggaacgggtaacgggttaacccggtaaagggttcggaaaggtaacttaaacccgaaaaggttaaccgttggaacgggtcctacggacccttaaccgtcgttccgttcg

SEQ ID NO: 407141 - DNA, 570 bp, Homo sapiens
  misc_feature: GZ8MTXP01AVTW2.21.15.B04.1.454.CMB.2.raw
  modified_base (306)..(306): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagactacttagcttggaccagcagcaacaggacaacgtcctaaatcgctcatttacnggcatcgtggtccgggaatcccggggtcctgaccgtacttcggtggcaggcggtctgggcagtattcactctacacatcagcagcctacgaggctaggaagtagtggtgtcttagtttttagttttggattcgaactaactattagcgccgtctcccggtctacgtaccgtttcgggaacgggtaacgggaccgtaaagggttcggaagtaacttaccgaaaacgttaccgtgggtcgcgtcgaccttaacctcgttccgttcg

SEQ ID NO: 407142 - DNA, 653 bp, Homo sapiens
  misc_feature: GZ8MTXP01EPGV9.21.15.B04.1.454.CMB.2.raw
  modified_base (313)..(313): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggacgaaaggccaccatcaaactgacaagtccagcccgagtgtcttatccctctaccgactaaataagaactactagcttggaccagcagacaacagacaacgtctaaatgctatatttacgnggactagtcgtaggtaccgggaacttcccgggggtccctaggacccgtagtttcggtggactaggccgggtactagggaactagtactttcactctacactatcagcacgtcctaacgaggtactagaaagtgtggtacggtattaaggtttttattttagggaattcgaactaaacgttatttagccggtcctccgtccgtcttaccgttaccggttcggggaacgggtaacgggttaaaccgtaaaggggttcggaaaggtaacttaaacccggaaaacggttaccgttcggggtaggtcccttaggaacccttaaccgttaagtttccggttaaccg

SEQ ID NO: 407143 - DNA, 556 bp, Homo sapiens
  misc_feature: GZ8MTXP01EL3S7.21.15.B04.1.454.CMB.2.raw
  modified_base (308)..(308): a, c, t, g, unknown or other
  modified_base (403)..(403): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtggacgaaaggccaccatcaactgacaagtccagcccgagtgtcttatcctcctaccgaacaaataagaactactagcttggaccagcagacaacagacaacgtctaaatgctcattacnggctatctggtaccgggatccggggtcctgaccgtattcggtggcaggcggtactgggaactagtatttcacttctcaccatcagcagcctaagnggactagaagtatggtgtattaggtttttattttgggtaatttgacctaatattagtcgtcccgcttccgcttcgtaccgttcgggaacgggtaaggaccgaaagggttggaagtacttacgaaacgacgtgtggcctgccactaagttcctg

SEQ ID NO: 407144 - DNA, 843 bp, Homo sapiens
  misc_feature: GZ8MTXP01EA84N.21.15.B04.1.454.CMB.2.raw
  modified_base (270)..(270): a, c, t, g, unknown or other
  modified_base (287)..(287): a, c, t, g, unknown or other
tcagtcgtcgctcgcacgaccggtgctcgatttagacagtatatatccgcgggggggtctcagagaggagccttagccctggactccaaggcctttccacttggtgatcagcactgagcacagaggactcacatggaattggggctgagctgggttttcctgttgctatttagaggtgtccagagtgaggtagaaaggtggtgggagggtcggggggaggcgttgggtccgacgggccgggggggtccctgacgactgtcctgtgaagtntcgtggtattgtatagnagagagttggatgcacgtcgggtccgacagacgttcgaagggtaaaggggttcgtaggggaggtgggggtacgacccgaaaacgtaacgttaaaaaccgaaaggtaagtaggggaaaggttcggtaaggaaacgtaccgtaaaccgttaggttacgggttacgggtccccgttacggttaggggttacggggaaccggggggtacccgttaacggtttaccgaaacctaaacgttcccgttaacccgaaagggtaacggaaccgtaaagggttaccggaaacccgtaaaaggtttaaccgtttaccggggtttaagttaacttacccgtaaagggtaaccgggttaaaaaaggttacccgggggtaaaaccaacgggtacccggtaaaggggaaccgggaaaccgggtaccccgggtaaaggggaacccgtaccgggtacccttacggttaactttaacgtttaacgtcgggttacggaccggtaaccggttagttcggttacggtaacctacgtcgtaggtttccgccggggtttccggcgggggtaaccccggg

SEQ ID NO: 407145 - DNA, 767 bp, Homo sapiens
  misc_feature: GZ8MTXP01C3R91.21.15.B04.1.454.CMB.2.raw
  modified_base (310)..(310): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggacgaaaggccacatcaactgacaagtccagcccgagtgtcttactcctctacgacaaataagactactagcttggaccagcagcaacagacaacgtcctaaatgctcaattttaccgnggactatcgtacggtaccggacgtcccgggtacctaggtaccgttacgtttccgggtaggacgtacgggtccggggtaacgtacggggaactacggttaactttacccgacttcccgtaccaaccctagtaccgaacgtaccgtaacggtacccgtaaacgacggtacgttaaggaaacgtacgttcggttacggtacgttttaagttttttagttttacgggtaacgttacgtaaaccttaaacgttacgtttaacgtcccgtacccggttacccgttacccggttaccgttacccggttaacccgggttttccgggggaaccggggttaaacggggttaaacccggtaaaggggttacgggtaaacggtaacgttaaacccggttaaaacgggttaccggttaacgggtacggtaaccgtaccggaccttaacccgtttaacgttcgtttaaccg

SEQ ID NO: 407146 - DNA, 509 bp, Homo sapiens
  misc_feature: GZ8MTXP01E1MWA.21.15.B04.1.454.CMB.2.raw
  modified_base (403)..(403): a, c, t, g, unknown or other
  modified_base (431)..(431): a, c, t, g, unknown or other
  modified_base (435)..(435): a, c, t, g, unknown or other
  modified_base (480)..(480): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctggcgaaaggccaccatcaactgcaagtccagcccgagtgtcttatcctcctccgacaataagaactacttagcttggtaccagcagcaaccaggacaacgtcctaaattgctcatttactgggcatctgtccgggatccggggtccctgaccgattcggttggcagcgggtctgggcagatttcactctcaccatcagcagcctacaggctgaanatgtggctagtttatttggtatgcaacnttangcccgctccgctcacgtttcggcggtagggaccaagggttcgagnttcaaacgactggtgctgcaccaattctg

SEQ ID NO: 407147 - DNA, 610 bp, Homo sapiens
  misc_feature: GZ8MTXP01ETFI4.21.15.B04.1.454.CMB.2.raw
  modified_base (315)..(315): a, c, t, g, unknown or other
  modified_base (466)..(466): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccaccatcaactgcaagtccagcccgagtgtcttatccctcctccgaacaaataagaactacttagcttggaccagcagacaaccaggacaacgtacctaaattgctctatttacngggcatctcggtaccgggaatcccgggggtcctgaccgtattcggttggcgaggtcgggtctgggcagtattcactctcaccatcagcagcctacgaggactgaagatgtagtcttaagttttattttgggattgtaaccaattattacgngtcccgtcttccgtcttactaaccggtttcggggaacggtaacggggaaccgtaaaggggttcgggaaataacgttaaccggaaaaacggttaccgttggggtagggtccttcggaccttaccccggtaagttcggtttaaccg

SEQ ID NO: 407148 - DNA, 552 bp, Homo sapiens
  misc_feature: GZ8MTXP01D9BSZ.21.15.B04.1.454.CMB.2.raw
  modified_base (304)..(304): a, c, t, g, unknown or other
  modified_base (313)..(313): a, c, t, g, unknown or other
  modified_base (365)..(365): a, c, t, g, unknown or other
  modified_base (385)..(385): a, c, t, g, unknown or other
  modified_base (398)..(398): a, c, t, g, unknown or other
  modified_base (410)..(410): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtctccagactccctggctgtgtctcgtgggcgaaaggccaccatcaactgacaagtccagcccgagtgtcttatccctcctccgaacaaataagaactactagcttggaccagcagcaacaggacaacgtctaaatcgctntatttacgnggcatcgtggtccggatcccgggtcctgaccgtacttcgtgcgaggcggtcngggcagtcttcactctcacntcagcagcctagnggactagaagtntgtgtcttagtttatttggtatgactaatattagtcgccgtctccgtctcgtaccgttcgggaacggtacgggaccgtagggttcgaagtaacgttaccgaaacgttacgtggtacggctacgccttaccgtcttccgttcg

SEQ ID NO: 407149 - DNA, 659 bp, Homo sapiens
  misc_feature: GZ8MTXP01BLSAG.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcgggggagcgttggtccgaggccggggggtcctgagactgtcctgtgagtctctggattgtatagcagagattggatgcacgtcgggtccgccagacttcgaaggaaagggtcgtagggaggtggggtacggacccaaacgaagtaaaaccgaagaagtagggaaagtacgtaggaaagctaactagtcggtacggtcctcgtggtgggacggggtccgtaattacgaaactaactcctaccgaaggaacgaccgaaggttacgaccctaaagtaaccgttcggttagtacttcgtagaacgtaaaagttcggaaccacggcctaggaacggacggaccggaaggtaccaacggtcctacgtaacttaacttacgtcgttcgaccggtaaccgttagttgttcgggtaactacggtctaggttcggccggtcccggttcggggtaacccg

SEQ ID NO: 407150 - DNA, 534 bp, Homo sapiens
  misc_feature: GZ8MTXP01EUR2V.21.15.B04.1.454.CMB.2.raw
  modified_base (342)..(342): a, c, t, g, unknown or other
  modified_base (486)..(486): a, c, t, g, unknown or other
  modified_base (501)..(501): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggcccgggggggtccctgagactgtcctgtgaagtctctgggattgtatagcagagattggatgcacgtgggtccgccagacttcgaggaaagggtctggagtggggtgcccaanataaaccaagatggaagtgtagaagcactatgtggcctctggtggaggggccattcacaatctccagagacagtgaccaaagaactcgttgtatctgacgaaatggacagcctgagacgccgaggacacggctctctattacgngttcgcggacgattnttcggctacgtcattgcgtcgttggggaacccg

SEQ ID NO: 407151 - DNA, 726 bp, Homo sapiens
  misc_feature: GZ8MTXP01CI45A.21.15.B04.1.454.CMB.2.raw
tcagtcgtcgctcgcacgaccggtgctcgatttagacagtatatatccgcgggggagctacaacaggcaggcaggggcagcaagatggtgttgcagaccccaggtcttcatttctctgttgctctggatctctggtgccgtacggggacttcgtgatcgacccagtctccagacctcctggctgtgtctcgtggacgaaacggccacatcaaactgacaagtccagcccgagtcgtcttactccctcctaccgaacaaataaacgaacttacttagcttacggaccagcagaccaaaccgaggaaccaaacgtacctaaattgactactaatttacgtggactagtcgtcggtaccgggaacgttccccgggggtcctggaccgtacgttccgggttggccgtagggtccgggtacgtacggggaactacggtacttttccgaccttcctacccaacctatacccgaagaccaacggtaccctaaacggacggtacgtaaggaaacgtagttggtagggttacttaaggttttttattttaggggtaattcgtaaacctaagttaattcgtaccggccccgttaccgttccccggtacctttaccgtaccggtttccgggggaacgggtaaacggggacccgtaaaagggggttgaaacgttaacgttaaccgaaaacggttaccgttgggtacgtcttcggaccttaacctcgttcccgttaacg

SEQ ID NO: 407152 - DNA, 577 bp, Homo sapiens
  misc_feature: GZ8MTXP01DIK6W.21.15.B04.1.454.CMB.2.raw
  modified_base (330)..(330): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggagcttggtccagcgggggtcctgagactgtcctgtgaagtctctggattgtatagcagagattggatgcacgtgggtccgcagacttcgaggaaggtctggagtgggtggccaaanataaaccagatggaagtgagagcactagtgtgctcgtgtgaggggccattcactaatctaccagacgacaggtacgaccaaagtaacctcgttagtacttcgtagacgtaaagtcggaacacggcctagacgagaccggagaccacggctcgtctaacgttactcgttgacggaccggttattacgttcgggtaaccttaacggttctacgtttcggccggtttaacccgttcgggggtaaccccgg

SEQ ID NO: 407153 - DNA, 682 bp, Homo sapiens
  misc_feature: GZ8MTXP01C7CRX.21.15.B04.1.454.CMB.2.raw
  modified_base (303)..(303): a, c, t, g, unknown or other
  modified_base (316)..(316): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccaccatcaactgacaagtccagcccgagtgtcttactccctcctccgacaaataacgaactacttagcttggaccagcagcaaccaggacaacgtcctaaatnactcatttacggngctatcgtcggtaccgggtacgtcccggtcctacgtaccgtacgttccggtcggcgtacggtccgggtacgtcgggaactacgtactttaccactcctacacctactacgacgtaccgacgtaccgtacgacggtacgtagtaagtacgttggttacggttacgtttaagtttttagtttttacggtaagttacgtaacctaacgttacgtttacgtccgtcccgtccgtccgtccgttaccgttaccggtttcccggggaacggggtaaccgggttaccggtaaagggttacgggtaacgtaacggttaaccgaaacggttacgtcgggtacgtccgtcggaccttacgtaacgttcgtttaacg

SEQ ID NO: 407154 - DNA, 558 bp, Homo sapiens
  misc_feature: GZ8MTXP01BRFCW.21.15.B04.1.454.CMB.2.raw
  modified_base (303)..(303): a, c, t, g, unknown or other
  modified_base (385)..(385): a, c, t, g, unknown or other
  modified_base (393)..(393): a, c, t, g, unknown or other
tcagtcgtcgctcgcacgaccggtgctcgatttagacagtatatatccgcggggagctacaacaggcaggcagggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctctcgacaaataagaactacttagcttggaccagcagcaacagacaacgtcctaaatgctcatttacnggcatctgtccgggaatccgggtcctgaccgattcgtggcagcggtctgggcagtatttcactctcacatcagcagcctacnggctgaantgtgctagttttatttggtaatgtacaactattatgaccgtctccgtctctaccgtttcgggaacgggtaacgggaccaaagggttcggaaggtaacttaccgaaaaacggttaaccgtggttacggggaacttacggggccttaacccgtaagttccgtttcgg

SEQ ID NO: 407155 - DNA, 661 bp, Homo sapiens
  misc_feature: GZ8MTXP01DAASS.21.15.B04.1.454.CMB.2.raw
  modified_base (318)..(318): a, c, t, g, unknown or other
  modified_base (450)..(450): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtctccagactccctggctgtgtctcgtgggacgaaaggccaccatcaactgacaagtccagcccgagtcgtcttactcctcctaccgaacaaataagaactacttagcttagaccagcagacaacagacaacgtactaaatgctactatttacgnggactatcgtcggtaccgggaacgttcccgggtcctagaccgtacttcggttggcgtacggtcggtcgtagggaactagtactttcactctacgaccatcagtacacgtcctaacgagggtactaggtaaanagttgggtacgtactttaagtttttttagttttagggggaactacgtaacctaaactgtttaacgccggtaccggtcctaccgtaccgttacgttaacggtttccgggggaacgggtaaccgggaaccgtaaaggggttgaaaaccggtattaaacccgggaaaagttccgtgggtacggccttcgaccttaccgttaacttcggtttccg

SEQ ID NO: 407156 - DNA, 558 bp, Homo sapiens
  misc_feature: GZ8MTXP01AWQPB.21.15.B04.1.454.CMB.2.raw
  modified_base (379)..(379): a, c, t, g, unknown or other
  modified_base (387)..(387): a, c, t, g, unknown or other
  modified_base (408)..(409): a, c, t, g, unknown or other
  modified_base (429)..(429): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtctccagactccctggctgtgtctcgtgggacgaaacggccaccatacaactgacaacgtccacgcccgagtgtcttactccctcctaccgaacaaataagaacttacttagcttggaccagcagacaaccgaggacaacgtctaaatcgctctatttacgggactagtcgtcggtaccgggacgttcccggggtcctagaccgtgttcggtggcnggcggtcngggctagtcttcactcacacnncagcagcctagagcagaagntgtgtacttagtttatttaggatagactaatattcgcgcccgtctccgtctcgtcgttcgggaaggtacggacgaggttggacgtaattacgaacgttacgtggtcgcgtgaccttactcgttcgttcg

SEQ ID NO: 407157 - DNA, 622 bp, Homo sapiens
  misc_feature: GZ8MTXP01ALK5G.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcgggggagcttggtccgaggccggggggtcctgagactgtcctgtgaagtctctggattgtatagcagagattggatgcacgtgggtccgccagacttcgaggaaagggtctggagtgggtggccaaacataaaccaagatagggaagtgtagaagcactagtgtcggcctcgtggtgggacgggggtccgatttaccgaactaacgttctaccgaaggacgacctagtacgacccaaagtaaccttcgttagtactactcgacaaagttgggacacggcctaggacgacggaccggaaggaccacgggtcttccgtctaactttcgtaggttcggaccggaacgggttattacggttcggtaaccttacggtctacggttcggttccgttaacccggttgggggtaaccccg

SEQ ID NO: 407158 - DNA, 638 bp, Homo sapiens
  misc_feature: GZ8MTXP01AI1ET.21.15.B04.1.454.CMB.2.raw
  modified_base (416)..(416): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccaacatcaactgcaagtccagcccgagtgtcttatcctcctccgaacaataagaactacttagcttggaccagcagcaaccagacaacgtcctaaattgactcatttactggcatcgtgtccgggattccggggcctgaccgacttcgtggcaggcggtctgggcagtatttcgactctcaccatccagcacgtccctaacgaggactagtaaagnttcgggtagtacttaagggttttttaatttttgggggtaattacggtacctaaacgtattttaacgcgtccccgtccgttcccggtcctttacgtaaccgttttccgggggaaccgggtaaacggggttaacccgaaaggggttacggaacgtaacgttacccgttaaaacggttaaccgttggtacggccgttacggacccaccttaacgttcccgtttcg

SEQ ID NO: 407159 - DNA, 620 bp, Homo sapiens
  misc_feature: GZ8MTXP01BSG4N.21.15.B04.1.454.CMB.2.raw
  modified_base (303)..(303): a, c, t, g, unknown or other
  modified_base (310)..(310): a, c, t, g, unknown or other
  modified_base (418)..(418): a, c, t, g, unknown or other
  modified_base (430)..(430): a, c, t, g, unknown or other
  modified_base (439)..(439): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccaccatcaaactgacaagtccagcccgagtgtcttatccctcctccgacaataagaactacttagcttggaccagcagacaacaggacaacgtctaaatgctnatttacnggcatctggtaccgggaatcccggggtcctgaccgtagttcggtggctaggtccgggtactagggctaggtactttccactcctacaccatacagcaacgcctaacgnggactagaaagntggtcggtnttaagtttttagtttttaggacttgacctaaattattacgtcgtcccgtctccggtaccttcgtaacggtttccggggaacgggtagggaaaccctaaggggttcggaaagtaacgttaacccgaaaaggttacgttcggggtcgtccgttcggacccttaacgttaacttccgtttcccg

SEQ ID NO: 407160 - DNA, 640 bp, Homo sapiens
  misc_feature: GZ8MTXP01EUBG8.21.15.B04.1.454.CMB.2.raw
  modified_base (308)..(308): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccaccatcaactgcaagtccagcccgagtgtcttactccctcctccgaacaataagaactactagcttggaccagcagacaacagacaacgtctaaatgctcatttacnggctatcgtggtccgggatcccggggtcctgaccgtagttcggtggcgaggtcgggtctagggctagtactttccactcctacacctactcgaacgtcacggcccttaacgagggtacctaggaaagtcgttgggtacggttacttaagttttttagttttcgggtaagttcggaaccttaaattaacgtttcgccggtccccgtacgttcccggtcttaccgtaccgggtttcggggaacggtaacgggttaccgtaaaggggttcgaaagtaaccgttaacgaaaacgttacgttggtacggcttacggaccttaaccgtgttcctttcg

SEQ ID NO: 407161 - DNA, 591 bp, Homo sapiens
  misc_feature: GZ8MTXP01EPZYB.21.15.B04.1.454.CMB.2.raw
  modified_base (318)..(318): a, c, t, g, unknown or other
  modified_base (451)..(451): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtctccagactccctggctgtgtctcgtgggcgaaacgggccaccatacaactgacaagtccagcccgagtgtcttactccctcctaccgaacaaataagaactacttagcttggaccagcagacaacgagaacaacgtctaaatgctcatttacngggctatctggtccggaatcccggggtcctgaccgtagttcggtggcgtaggcgggtcagggtaacagtactttccacttctacgaccagtccagcacgcctaacaggctagagtatgtggtactagtttttntttaggattagacctaaataactttgccgtcgtccctcgtccttacgtacgttcggggaacgggtaacgggactaaggggttagagtaacttaaccgaaagttacctggtacgcccttagacttacctaagttcccgttg

SEQ ID NO: 407162 - DNA, 579 bp, Homo sapiens
  misc_feature: GZ8MTXP01BBZ8L.21.15.B04.1.454.CMB.2.raw
  modified_base (312)..(312): a, c, t, g, unknown or other
  modified_base (402)..(402): a, c, t, g, unknown or other
  modified_base (476)..(476): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctggacgaaaggccaccatcaactgacaagtccagcccgagtgtcttatccctcctccgaacaaataagaactacttagcttaggaccagcagcaaccaggacaacgtctaaatgactcattacgnggctagtctggtaccgggtacgtcccgggtcctgaccgtacgttcggtggcaggcggtactgggcagtactttcactctcaccatcagcncacctagaggctagagagtggtagtcgttagtttgtttagtagtagactaactattagtcgccgtactcccgtntccgtacgttcgggaacgggtaacgggaaccgaagggttggaaacgtaacgttaacgaaccgttaacgtgggtcgcgtacggaccttacctaacttcgttccg

SEQ ID NO: 407163 - DNA, 621 bp, Homo sapiens
  misc_feature: GZ8MTXP01B6XP9.21.15.B04.1.454.CMB.2.raw
  modified_base (308)..(308): a, c, t, g, unknown or other
  modified_base (400)..(400): a, c, t, g, unknown or other
  modified_base (608)..(608): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctcgacaataagaactacttagcttggaccagcagcaaccaggacaacgtcctaaattgctcatttacnggcatctgtccgggaatcccgggggtcctgaccgtattcggttggcagcgggtctgggcagtattcactctacactatcagcacgcctacgnggctagaagatggtcgcttaaggtttttattttggggattaggtcctaaacttatttagtcggtacccgtccttcccggtcttaccgttaacccggttttcggggaacccgggtaacggggaacccgtaaagggggttacgggaacgtaacttaacccggaaaacggttaaccgttgggtcggtcccgttaggaccccttaacccgtntttcccgtttccg

SEQ ID NO: 407164 - DNA, 602 bp, Homo sapiens
  misc_feature: GZ8MTXP01EQQHG.21.15.B04.1.454.CMB.2.raw
  modified_base (309)..(309): a, c, t, g, unknown or other
  modified_base (424)..(424): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagaactactagcttggaccagcagcaaccaggacaacgtacctaaatgctctatttacgnggctatcgtggtccgggaactccgggggtccctgaccgtacttcggttagcgagcgggtctagggcagtatttcactctcacatcagcagcctagaggtctagagagtgtacgtnttagttttattttggtagttgtactaactattacgtgtcccgtctcccgtcgttccgtacgtttccggggcgggtaacggggttaacccgtaaagggggttggtaaacgtaacgttaccgaaaacggttaccgttaagggtcggtccgtacggaccaccccgtaatttccgtttccgg

SEQ ID NO: 407165 - DNA, 719 bp, Homo sapiens
  misc_feature: GZ8MTXP01DDCP7.21.15.B04.1.454.CMB.2.raw
  modified_base (332)..(332): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatcgacccagtctccagacctccctggctgtgtctcgtggacgaaacggccacatcaactgacaacgtccacgcccgtagtcgtacttactccctcctaccgaataaataacgaactacttagcttacggaccagcacgaccaacgacggacaacgtactaaatgactatatttacgnggctagtcgtcggtaccgggtacgttcccggggtcctaggacccgtagttcgggtggcgtaggccgggtacgtagggaacctagttactttacccaccttcctaccaacctacgtaccgaacgaccgaaccggtacctaaacggaggtacgttaaggaaagtcggttggtcggttaactttaaggtttttttattttagggtacgttacggtaaaccttaaacttagtttaccgccggtccccgttaccgttccccggtcttaccgttaacccgggtttcgggggaaccgggtaaacggggaaccgtaaaggggttcgaaacgtaacgttaaaccgaaacggttacgtggtaccggtctacggacccttaacttgttcccgtttaag

SEQ ID NO: 407166 - DNA, 617 bp, Homo sapiens
  misc_feature: GZ8MTXP01EH546.21.15.B04.1.454.CMB.2.raw
  modified_base (315)..(315): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggacgaaagggccaccatcaaactgacaagtccagcccgagtgtcttatccctctccgacaaataagaactactagcttggaccagcagacaaccaggacaacgtacctaaatgctatattacgnggcatctggtaccgggatcccgggtcctgaccgtattcggtggcgaggtcggtactgggcagtactttcactctcactatcacgcacgcctaacgagggacctaggaaagtgtggtacgtactttaagtttttagttttgtaagttagtaacctaaacgtattagtcgtcccgtccgtcccgtcttcccgtaaccggtttcggggaacggtaacggggacccgtaaagggttggaaacgtaacttaaccgaaaacggttaaccgtggtacgggcctacggccttaacccgtaattcgttccg

SEQ ID NO: 407167 - DNA, 655 bp, Homo sapiens
  misc_feature: GZ8MTXP01B5LHU.21.15.B04.1.454.CMB.2.raw
  modified_base (300)..(300): a, c, t, g, unknown or other
  modified_base (303)..(303): a, c, t, g, unknown or other
  modified_base (310)..(310): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggacgaaaggccaccatcaactgcaagtccagcccgagtgtcttactccctcctccgaacaaataagaactactagcttggaccagcagcaacagacaacgtcctaaatnctnatttacnggcatcgtggtaccgggagtcccgggtcctgaccgtagttcggtggcgaggcggtcgtgggctagtactttccactcacacatcagcacgcctagacggtactagaagtagtggtaggtctttaagtttttatttttggggattaggtacctaacgttatttacgtccggcccgtcccgttcccgtccgttaccgttaaccggttttccgggggaacccgggtaacggggttaaaccccggtaaaggggtttcgggaaacgtaacgttaaacccgaaaaccggttaacgttcgggttacgggtaaccgttacggacccgttaccctaactttccggtttaacccg

SEQ ID NO: 407168 - DNA, 542 bp, Homo sapiens
  misc_feature: GZ8MTXP01CSNQK.21.15.B04.1.454.CMB.2.raw
  modified_base (337)..(337): a, c, t, g, unknown or other
  modified_base (460)..(460): a, c, t, g, unknown or other
  modified_base (530)..(530): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccgaggccggggggtcctgagactgtcctgtgaagtctctggattgtatagcagagattggatgcacgtgggtccgcagacttcgaggaaaggtctggagtgggtggaccaaanataaaccaagatggaagtcgtagaagcactatgtgcctcgtgtaggaggggccgattcgacaatctccagagacagtgaccaagaacgtcgtagtatctagactaaagtggacagcctgacgngaccgagacgacggctcgtctagttactggttcgacggaccggattgcggctacgtcattggccgtccgngggggtaacccg

SEQ ID NO: 407169 - DNA, 627 bp, Homo sapiens
  misc_feature: GZ8MTXP01BSRZM.21.15.B04.1.454.CMB.2.raw
  modified_base (317)..(317): a, c, t, g, unknown or other
  modified_base (358)..(358): a, c, t, g, unknown or other
  modified_base (366)..(366): a, c, t, g, unknown or other
  modified_base (460)..(460): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtctccagactccctggctgtgtctcgtgggacgaaaggccaccatcaactgacaagtccacggcccgagtgtcttactcctcctcgaacaaataagaactacttagcttggaccagacagacaacaggacaacgtctaaatgctatatttacgnggacagttccgtggtaccgggaagttccccgggggtacccnggaccgtntttcggtgcgaggccggtactgggaactaggttactttccacgttctaccacgtactacgagaccgacgacctaccgaggaccgttaggaagtntggtcggtattagttttactttggtatcgtactactattacgtcgacccgtctcccgtacttccgtaccggtttcgggaaccgggtaagggaaccgtaagggttaggtaacgtaagttaccggttaaacgacgtgggtagtccgtacgcttacctaacgttccttcg

SEQ ID NO: 407170 - DNA, 635 bp, Homo sapiens
  misc_feature: GZ8MTXP01AJDZB.21.15.B04.1.454.CMB.2.raw
  modified_base (176)..(176): a, c, t, g, unknown or other
  modified_base (335)..(335): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctggtttcctgttgctatttagaggtntccagagtgaggtgaagtggtggagtcgggggagcttggtccaggccggggggtcctgagactgtcctgtgaagtctctggattgtatagcagagattggatgcacgtgggtccgccagtaccttcgaggtaaagggtctgggagtggggtgaccaaanataaaccaagatggaagtcgtagagcactatgtcggcctcgtggtcgggacgggggtccctattaccgaactaacgtcctacccgaaggacggaccgtagtacgaccaaaggtaaccttccggttagtaactcgttaggacgtaaagtcgggaaccacggtcccgtaggaacggaccggacccggaagggtaccgaaccgggtccttcgttaaccttaattaccggtcggttcggaccgtaaccgggttattacgttcgggctacggtctacgttgcccgttccgttcgggggaaccccg

SEQ ID NO: 407171 - DNA, 608 bp, Homo sapiens
  misc_feature: GZ8MTXP01A0VKH.21.15.B04.1.454.CMB.2.raw
  modified_base (298)..(298): a, c, t, g, unknown or other
tcagtcgtcgctcgcacgaccggtgctcgatttagacagtatatatccgcgggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcgggggaggcttggtccaggccggggggtcctgagactgtcctgtgaagtctctggattgtatagcagagattggatgcacgtgggtccncagacttcgaggaaagggtctgggagtgggtggccaacataaaccaagatggaagtcgtgaaagcaactagtgtcggcccttgtggtgggagggggtccctagttcactaatctaccgagacgacagtcgaccaaagtactcgttagtactctagacaaagtgggacaggtccaggacgacggtcccggaggtaccgaccggtcttcgtaacttagttaccgtggttcgaccggtaaccgggttattagttcgggtaacccttaacgggttccaaggtttcggcccggttccggttcgggggtaaccccg

SEQ ID NO: 407172 - DNA, 628 bp, Homo sapiens
  misc_feature: GZ8MTXP01AEUTI.21.15.B04.1.454.CMB.2.raw
  modified_base (313)..(313): a, c, t, g, unknown or other
  modified_base (373)..(373): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtggcgaaaggccaccatcaactgacaagtccagcccgagtgtcttactcctcctccgaacaataagaactacttagcttaggaccagcagcaaccgaggacaacgtcctaaatgctcatttacgnggctatcgtggtccgggaagttcccggggtcctgaccgtattcggtggcgaggcggttcngggaactagtactttcactcacacatcagcacgcctacgaggatacgaagtagtcggtaggtacttaagtttttagttttacgggtaattaggtaacctaaacttatttaacgtccggtccctccgtccgtccttacgtacccgtttcggggaacgggtaacgggaaccgtaaggggttacggaacgtaacgttaaccgaaaacggttaccgtgggtcggtaacttacggcccttaaaccgttcttccgtttccg

SEQ ID NO: 407173 - DNA, 660 bp, Homo sapiens
  misc_feature: GZ8MTXP01AVKC1.21.15.B04.1.454.CMB.2.raw
  modified_base (313)..(313): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccaccatcaactgcaagtccagcccgagtgtcttatcctcctccgacaaataagaactacttagcttggaccagcagcaaccaggaccaacgtcctaaattgctctatttacgnggcatcgtggtaccgggagtcccggggtcctgaccgtattccggttggcgaggtcgggtcgtaggggaactaggtactttccgactctaccacctatccagtccacgcctaacgaggtctagaagtagtggtacggtactttaagtttttagttttaggggtattacggtaacctaaacttagtttacgtccgtcccgtccttcccgtccttaccgttaccggtttccggggaaccgggtaacggggttaacccgtaaagggggttacggaaacggtaacttaacccggaaaacggttaacgttcggtaggtcccgttacggaccttacccgtaacgttccgttccg

SEQ ID NO: 407174 - DNA, 676 bp, Homo sapiens
  misc_feature: GZ8MTXP01B73Z0.21.15.B04.1.454.CMB.2.raw
  modified_base (317)..(317): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtctccagactccctggctgtgtctcgtgggacgaaacgggccaccatcaactgacaagtccagcccgagtgtcttactccctcctccgaacaaataagactacttagcttggaccagcagacaacagacaacgtctaaatcgctctatttacgnggctactcgtcggtaccgggtaacgtccccgggggtccctggacccgtacgtttcggttcgggcgtacggtcgggtacgtaggggaactaggtactttccactctaccaaccgattccgaagccacggccctaacgagggtactaggaaatgtggtcgtattagtttttatttagggaattcgaacttaaacgtatttacgccgccgttacctcccgtacgttaccgttaccgggtttcgggggaaccgggtaacgggttaccgtaaacgggggttcggtaaacgtacttaaaacccgttaaaacggttacgttcgggacggtccttacggacccttaccgttaagttcctttaacccg

SEQ ID NO: 407175 - DNA, 696 bp, Homo sapiens
  misc_feature: GZ8MTXP01EHMGQ.21.15.B04.1.454.CMB.2.raw
  modified_base (320)..(320): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtctccagacctccctggctgtgtctcgtgggcgaaacggccaccatcaactgacaagtccagcccgagtgtcttatccctcctaccgacaaataagaactactagcttggaccagcagacaaccaggacaacgtcctaaatcgactctaatttacgnggctatccgttcggtaccggggaacgttccccgggggtaccctaggaaccccgttagttccggtttagggcgtacgggtccggggtacccgtagggggaacctaggttactttaccgaccttcctacacctaacttacgacgacacgtcccgtaacgacgggtacctaaggaaagtagttcggtacgggtacgtttagtttttaagttttttacggggtaatttgaacctaaactatttaacgcgtcccacgtcccgtcttaccgtaactttccgggggaacggtacggggttaaaccgaacgggttggaacgtacttaacgttaaaccggttacgtaacgggtgggtaacctgacccacctaagttccgttaacg

SEQ ID NO: 407176 - DNA, 625 bp, Homo sapiens
  misc_feature: GZ8MTXP01AM357.21.15.B04.1.454.CMB.2.raw
  modified_base (426)..(426): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagcgtggttttcctgttgctatttagaaggtgtcagagtgaggtgaaagtggtggaggtcggggggagcgttggtccgaggccggggggtcctgagactgtcctgtgagtctctggattgtatagcagagattggatgcacgtgggtccgccagtacttcgaaggaaagggtctggaggtggggtggaccaaacgaagtaaaaccaagtagtagggaagtcgtaggaaagctactagtgtggccctgtgggtggacggggccattcgacaatctcaganacgagtacgacaaagtaacgtcggttatatcgtacggaactaaaagtcgggaacaacggccgtaggacgacggaccggaggtaccgaccggtcctcttaacgtaatttccgtgttacggacggtaacccggttagttagttccgggtccttaacggtcgttaacgtcgggttccgtccgggttaacgggggaaccccgg

SEQ ID NO: 407177 - DNA, 572 bp, Homo sapiens
  misc_feature: GZ8MTXP01E1UYW.21.15.B04.1.454.CMB.2.raw
  modified_base (311)..(311): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccaccatcaactgcaagtccagcccgagtgtcttatcctcctccgacaataagaactacttagcttggaccagcagacaaccaggacaacgtactaaatgctctatttacgnggcatcgtcggtaccgggaattcccggggtcctggaccgtacgtttcggtggcgtaggcgggtctgggaactagtattcactctacaccatcagcacgcctacgaggctagaagatggtagtcttagttttattttgggatcgactaaactattagtcgcccgtcctccgtctaccgtacggtttcgggaacggggtaacgggaccgaagggttggaagtacttaacgaaacgactggtacgctcgacacgtaattcgtcg

SEQ ID NO: 407178 - DNA, 615 bp, Homo sapiens
  misc_feature: GZ8MTXP01BXYEC.21.15.B04.1.454.CMB.2.raw
  modified_base (177)..(177): a, c, t, g, unknown or other
  modified_base (576)..(576): a, c, t, g, unknown or other
  modified_base (583)..(583): a, c, t, g, unknown or other
  modified_base (605)..(605): a, c, t, g, unknown or other
tcagtcgtcgctcgcacgaccggtgctcgatttagacagtatatatccgcgggggtctcagagaggagccttagccctggactccaaggcctttccacttggtgatcagcactgagcacagaggactcaccatggaattgggctgagctggttttccttgtgctattttagaaggtntccagagtgaggtgaaagtggtggaggtcgggggagcttggtccaggccggggggtcctgagtactgtcctgtgaagtctcgtggtattgtatagcagagagttggactgcacgtgggtccacagacttgacggaaggtctggagtgggtgaccaacaataaaccaagagtaggaagtccgtagaagctaactagtcgtcgtcccgtgtgggtacggaggggtccctatttccaaactaatcctacccggaagacgaaccgtaggttaccgacccgtaaaggtacccgtttaggttacgttaaacttcgtacggaaaccgtaaagttcggggaaccacgccgtaggacgacgtaccggagtacgacggtcttcgtcttaagttctcggttgaccgacgngttacgngtctacgctagtcgcgttccgngggtaacccg

SEQ ID NO: 407179 - DNA, 602 bp, Homo sapiens
  misc_feature: GZ8MTXP01CS4C8.21.15.B04.1.454.CMB.2.raw
  modified_base (443)..(443): a, c, t, g, unknown or other
  modified_base (465)..(465): a, c, t, g, unknown or other
  modified_base (572)..(572): a, c, t, g, unknown or other
tcagtcgtcgctcgcacgaccggtgctcgatttagacagtatatatccgcgggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggaggcttgggtccgagggccggggggtccctgagactgtcctgtgaagtctcgtggattgtatagcgagagattggatgcacgtgggtccgcagacttcgaaggaaagggtcgtagggagtgggggtacgaacccgaaacaactaaaaccgaagtaacgtagggaaagtgtagaaagctaatagtcggtgcctgtggtgggacggggcctattcaacatctacaganacgagtcgacaagtactcgttntatcgtagacgtaaagcggacacggctaggacgacggacccggaagcccgaaggtctctaacgttaacttcgtagttcggaacgcggttaattgttcgtctaccgtntacgtggccgtccgggttcggggaacccgg

SEQ ID NO: 407180 - DNA, 634 bp, Homo sapiens
  misc_feature: GZ8MTXP01BCWT5.21.15.B04.1.454.CMB.2.raw
  modified_base (297)..(297): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagcttgggttttccttgttgcttattttagaaggtgtccagagtgaggtgaagtggtggagtcgggggagcttggccgaggccggggggtcctgagactgtcctgtgagtctctgattgtatagcagagattggatgcacgtcgggtccncagacttcgaaggtaaagggtctggaggtgggtggacccaaacgaataaaaccgaagagtggaagtgtagagcaacgtatggtcggccctgtgggtagggacggggctattacaactaaacttccacccgaaggaacgacgagtacgacctaaagtaacttcggttagtaatcctaggaacaaagtcgggaacacggccgtggaacgacggacccggaagggaccgtaaccgggtccttcttaacttaacgtttacggtcggttacggacccggtaacggttattacgttcggtaactacgtccgtagttcggcccgttaaccggcggggaaccccg

SEQ ID NO: 407181 - DNA, 637 bp, Homo sapiens
  misc_feature: GZ8MTXP01AR2PM.21.15.B04.1.454.CMB.2.raw
  modified_base (299)..(299): a, c, t, g, unknown or other
  modified_base (506)..(506): a, c, t, g, unknown or other
  modified_base (566)..(566): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaagtggtggaggtcgggggagcgttggtccgagggccggggggtcctggagactgtcctgtgaagtctctggatgtatagcagagattggatgcacgtgggccncagacttcgaaggaaggtctggaggtgggtacgaccaacaactaaaccaagagtagggaagtggtagaagctaactagtcggtacgtcctcgtagtcggggacggggctaagttcgaactacttcgtaccgaagaacgacagtacgaaccctaaagtaaccgttcgttagtacttacgtacggtaaaccaaaaggttcgggaaaccncggtacctaggacgacggaccgggaacgaccgaccggtcttcgttaactaacgtttacgngttcggaaccgtaccgttagttcgttcggtaactaccgtgttagtcggaccgtccgggttcgggaaccccg

SEQ ID NO: 407182 - DNA, 693 bp, Homo sapiens
  misc_feature: GZ8MTXP01D5AXX.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaggtgtccagagtgaggtgaaagtggtggaggtcgggggagcttggtccaggccggggggtcctgagactgtcctgtgaagtctctggattgtatagcagagattggatgcacgtgggtcccgcgagacttcgaaggaaagggttcgtagggaggtgggggtacggacccaaaacgaagtaaaaccgaaagtagtagggaaagtcggtaggaaagcacgtaagtggtacggtccctcgtgggtagggacgggggtcccgtaagtttaccgaaactaactctaccgaagacgacaagtacgaaccaaagtaacctcggttagtaactcgttagaaccgtaaaagttcggaaccaggcccgtaggaacgacggaccggacggaaccgtacggtccttcctaacgtttaacgttacgttcggttcgtcccgggtaacccggttagttacgttcgggtaacttaaccccgggttcgttacggttccgggttacccgggttccggggttccgggggtaacccg

SEQ ID NO: 407183 - DNA, 718 bp, Homo sapiens
  misc_feature: GZ8MTXP01CN29L.21.15.B04.1.454.CMB.2.raw
  modified_base (336)..(336): a, c, t, g, unknown or other
  modified_base (652)..(652): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatcgacccagtctccagacctcccgtggctgtgtctcgtgggacgaaacggccaacatacaaactgacaacgtccacggcccgtagtcgtacttactccctcctaccgaataaataagactactagcttagacagcagaccaacgagaactaacgtacctaaagtcactactacgtttacgnggactagtcgtacgggtaccgggtaacgttccccgggggtacctacggaccgttacgtttccggtcggaccgtacggggtccggggttacgtaacggggaactaagttacctttacccgacctaccgtaccgaacctattaccgaacgaccgtaaccgtaccgtaaccgtaacggtacgtacggtaaagtcgtaggttacggttaacgtttaagtttttacgttttaggtaacgttacgtaaacctaacgttattacgtcgtccgttacctcgtcctaccgtaccggttcggggaacggtaacggacggtaagggngtaaacgtacgttaaacggaaacgttacgtaaggtcgtaacgtcgtaccacttcgttccgttaacg

SEQ ID NO: 407184 - DNA, 708 bp, Homo sapiens
  misc_feature: GZ8MTXP01C52HV.21.15.B04.1.454.CMB.2.raw
  modified_base (633)..(633): a, c, t, g, unknown or other
  modified_base (669)..(669): a, c, t, g, unknown or other
  modified_base (677)..(677): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagtcttgggttttccttgttgtattattttagaaggtgtcagagtgaggtagaaaggtggtggaggtcgggggaggtcgttggtccgagggccggggggtcctgagactgtcctgtgtaagtctcgtggtattgtatagcgagtagagttggatgacgtacgtcgggtcccacgagtaccgttacggaagggtaaagggttcgtagggaggtacggggtacgaaccctaaaacgaaacgttaaaacgaagtaagtagggtaaagttaggtaggaaagtacctaacgtagttcgggttacggtcccgttcgggtagggtacgggtaacgggggtcccttaaggttacccaaactaactttaccgaccgaaggaacgtacgtaacggttaccgaaccgtaaacgtaacgtttcggttaatacgttacgtacgaacggtaaagttacggaacgtacgacgtaggacgacggacggacggaccgcgtctntaacgttattcgtagcgaccggacttgttgttcggnttaccgtntacgttcggccgttaacggcgggtaacccgg

SEQ ID NO: 407185 - DNA, 601 bp, Homo sapiens
  misc_feature: GZ8MTXP01ENRWU.21.15.B04.1.454.CMB.2.raw
  modified_base (263)..(263): a, c, t, g, unknown or other
  modified_base (300)..(300): a, c, t, g, unknown or other
  modified_base (307)..(307): a, c, t, g, unknown or other
  modified_base (559)..(559): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatcgacccagtcctccagactccctggctgtgtctcgtgggacgaaacggccaccatcaactgcaacgtccagcccgagtgtcttactcctcctcgaacaataagactntagcttggacagcagcaacgagacacgtctaatgctntattcgnggctatcgtggtaccgggaacgttcccggggtacctggaccgtacgttccggtgacaggtcgggtactagggaactagtcttcgactcgtacacatcagcacgtcctagacggtacgtagaacgtagtcgtaggtacttaggttttattttggggtattacgtaactaacgttattacgtccggtacgtcccgttccgtccgttaccgttcggttcggggaacggtaacgggacgtaagggttgaaacgtanaaccgttaacgacgtggtcgctcgacactaattcccgttaag

SEQ ID NO: 407186 - DNA, 660 bp, Homo sapiens
  misc_feature: GZ8MTXP01EIR80.21.15.B04.1.454.CMB.2.raw
  modified_base (315)..(315): a, c, t, g, unknown or other
tcagtcgtcgctcgcacgaccggtgctcgatttagacagtatatatccgcgggggagctacaacaggcaggcaggggcagcaagatggtgttgcagaccccaggtcttcatttctctgttgctctggatctctggtgcctacggggacttcgtgatgacccagtctccagactccctggctgtgtctcgtgggacgaaaggccaccatcaactgacaagtccagcccgagtgtcttactcctcctaccgacaaataacgaactactagcttggaccagcagacaacagacaacgtcctaaatgctacatttacgnggctatcgtacggtaccgggattcccggggtcctgaccgtattcggttggcgtaggtcgggtctagggaactaggtatttaccaccttctccaaccgtactcacgaccacgaccctaacgacggtactaggaagtagtcggtagtactttagtttttattttaggggtatacggtactaacgtattacgtcgcccgtccgtcccgtacttaccgtaccggtttcggggaaccgggtaacgggacccgtaaagggttacgggaaacgtaaccggttaaccgaaaaccggttaacggttcggtcgggtcccttacggacccttaccgtaactttcccgtttaaccgg

SEQ ID NO: 407187 - DNA, 756 bp, Homo sapiens
  misc_feature: GZ8MTXP01EY8NI.21.15.B04.1.454.CMB.2.raw
  modified_base (176)..(176): a, c, t, g, unknown or other
  modified_base (261)..(261): a, c, t, g, unknown or other
tcagtcgtcgctcgcacgaccggtgctcgattttagacagtatatatccgcgggggggtctcagagaggagccttagccctggactccaaggcctttccacttggtgatcagcactgagcacagaggactcaccatggaattggggctgagcgtggtttctgtgctatttagagtntcagagtgagtgaagtggtggaggtcgggggagcgttggtccagggcccggggggttcctgacgtactgtcctgtagtaagtctntgtattgtatgacagagattggatgctacgtcggccgacgagtactagaaggaagggtctagggaggtttcgggggagtacccgaaacgtaacgttaaaaccgaagaaggttacgggaaagtttacgggtacggaaacggtacctaaaggtaccgtttagggttcgggtccccgttcgtaggggttaccgggggaaacgggggtaccctttaaacgggtttaccaaacccggttaaattccccgtaaccgggtaaggtaaacgacggtacgttaaaccgggacccttaaaaaggtccgggtttaccttaaagggttcttaaccttacgaacgggttaaaggtcgggaaacttcccgggaacgtacggaaacggaccgtaccgggaagtaccgtaccgtccttaattaacgttattaccgggaggttacgccggtaaggttattcggttcgtaacgttataacgttcggtcgaccgggtccgggttaaccggaacg

SEQ ID NO: 407188 - DNA, 512 bp, Homo sapiens
  misc_feature: GZ8MTXP02JWAAS.21.15.B04.1.454.CMB.2.raw
  modified_base (308)..(308): a, c, t, g, unknown or other
  modified_base (393)..(393): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagaactacttagcttggtaccagcagcaaccaggacaacgtcctaaatgctcatttacnggcatctgtccgggaatccggggtcctgaccgattcgttggcagcgggtctgggcagatttcactctcaccatcagcagcctacnggctgaagatgtggctagtttattttgatgcaactattatcgccgtctccgcttcacgtttcggcggtagggaccaagggtcggagactacgaaacgactgacggctcgcaccgatctg

SEQ ID NO: 407189 - DNA, 510 bp, Homo sapiens
  misc_feature: GZ8MTXP02FZQYS.21.15.B04.1.454.CMB.2.raw
  modified_base (306)..(306): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctctccgacaataagaactactagcttggtaccagcagcaaccaggacaacgtcctaaatgctcattacnggcatctgtccgggaatccggggtcctgaccgtattcgtgcagcgggtctgggcagatttcactctcaccatcagcagcctacaggctgaagatgtagctagtttatttgtatgactaacattatgccgctccgctcgtacgtttcggcggtagggaccgtaaaggtggacgagtacgaaacgaatgtggctgcaccatcgttg

SEQ ID NO: 407190 - DNA, 517 bp, Homo sapiens
  misc_feature: GZ8MTXP02FXM5I.21.15.B04.1.454.CMB.2.raw
  modified_base (309)..(309): a, c, t, g, unknown or other
  modified_base (485)..(485): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatccctcctccgacaataagaactacttagcttggtaccagcagcaaccaggacaacgtcctaaatgctcattacnggcatctgtccggaatccggggtcctgaccgattcgtgcagcggtctgggcagatttcactctcaccatcagcagcctacaggctgaagatgtaggctaagttttattttgtatgactaaactatttatcgaccgtctccgcttcacgtttcgggcggtagggaccaagggtgganacgtacgaaacgaactgtcgctcgcacatctg

SEQ ID NO: 407191 - DNA, 510 bp, Homo sapiens
  misc_feature: GZ8MTXP02HXRKF.21.15.B04.1.454.CMB.2.raw
  modified_base (309)..(309): a, c, t, g, unknown or other
  modified_base (361)..(361): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagccccgagtgtcttatcctcctccgacaataagaactacttagcttggtaccagcagcaaccaggacaacgtcctaaattgctcattacnggcatctgtccggaatccggggtcctgaccgattcgtgcagcggtctgggcngatttcactctcacatcagcagcctacaggctgaagatgtgcagttttatttttgattgcaactattatgccgctccgctcacgtttcggcggaggaccgaaaggtcggaacgtagtacaaaacgacgtgtacggctcgcaccatctcg

SEQ ID NO: 407192 - DNA, 532 bp, Homo sapiens
  misc_feature: GZ8MTXP02HVJVD.21.15.B04.1.454.CMB.2.raw
  modified_base (379)..(379): a, c, t, g, unknown or other
  modified_base (404)..(404): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctccgacaataagaactactagcttggtaccagcagcaaccaggacaacgtcctaaattgctcatttactggcatctgtccgggaatccggggtccctgaccgattcgttggcaggcgggtctggggcagatttcactcncacatcagcagcctacaggctgaanatgtggctagttttattttgtaattgctaacattatcgcgtctccgctcgtacgtttcggacggtagggaccaaaggtggaagactacgaaaaacgtcgtaaggtacggctacggactaccattctcg

SEQ ID NO: 407193 - DNA, 506 bp, Homo sapiens
  misc_feature: GZ8MTXP02H8KQN.21.15.B04.1.454.CMB.2.raw
  modified_base (246)..(246): a, c, t, g, unknown or other
  modified_base (299)..(299): a, c, t, g, unknown or other
  modified_base (305)..(305): a, c, t, g, unknown or other
  modified_base (346)..(346): a, c, t, g, unknown or other
  modified_base (381)..(381): a, c, t, g, unknown or other
  modified_base (422)..(422): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctccganaataagaactacttagcttggtaccagcagcaacagacaacgtctaaatgctnattacnggcatctgtcggatccgggtcctgacgatcgtgcagcggtntgggcagtattcactctcaccatcagcagcctacnggctagaagatgtgctagtttattttgatgacaactattancgccgactccgctctacgttcggacggacggtaccaaaggtggaacgactaccgaaaacgactggtggctacgcaccatcttcg

SEQ ID NO: 407194 - DNA, 510 bp, Homo sapiens
  misc_feature: GZ8MTXP02JLX9S.21.15.B04.1.454.CMB.2.raw
  modified_base (307)..(307): a, c, t, g, unknown or other
tcagtcgtcgctcgcacgaccggtgctcgatttagacagtatatatccgcggggagctacaacaggcaggcaggggcagcaagatggtgttgcagacccaggtcttcatttctctgttgctctggatctctggtgcctacggggacttcgtgatgacccagtctccagactccctggctgtgtctctgggcaaaggccaccatcaactgcaagtccagcccgagtgtcttatcctcctccgacaataagaactacttagcttggtaccagcagcaaccaggacaacgtcctaaattgctcatttacnggcatctgtccgggaatccggggtcctgaccgattcgtgcagcgggtctgggcagatttcactctcaccatcagcagcctacaggctgaagatgtggctaggtttattttgattgactaacattaatgccgctccgctcactttcggacggagggtaccaaggtggagactacgaaacgactgtacggctggcaccactctcg

SEQ ID NO: 407195 - DNA, 552 bp, Homo sapiens
  misc_feature: GZ8MTXP02GY4NY.21.15.B04.1.454.CMB.2.raw
  modified_base (245)..(245): a, c, t, g, unknown or other
  modified_base (307)..(307): a, c, t, g, unknown or other
  modified_base (398)..(398): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccganaataagaactacttagcttggtaccagcagcaaccaggacaacgtcctaaatgctcattacnggcatctgtccggaatccggggtcctgaccgattcgttgcagcggtctgggcagattcactctcacatcagcagcctacagctgaagatgngctagtttattttgtatgactaactattaatcgccgtctccgcttacgtacgtttccgggacggtacgggaacccgtaagggttacggaagtacgtaaccgtaaaacgaaccgtaaggttacgggcttacggaccaaccgtaactacgtttccg

SEQ ID NO: 407196 - DNA, 548 bp, Homo sapiens
  misc_feature: GZ8MTXP02GBPYT.21.15.B04.1.454.CMB.2.raw
  modified_base (308)..(308): a, c, t, g, unknown or other
  modified_base (412)..(412): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagaactacttagcttggtaccagcagcaaccaggacaacgtcctaaatgctcatttacnggcatctgtccgggaatccggggtcctgaccgattcgtgcagcggtctgggcagatttcactctcaccatcagcagcctacgagctgaagatgtgctagttttnttttagattgactaactatttagtcgccgtctccgcttcgtaccgtttccgggacgggtaacggggaccctaaaggggtcggaacgtactaccgaaaacgtaacgtggtacggctacggaccaccgtagtctttcg

SEQ ID NO: 407197 - DNA, 534 bp, Homo sapiens
  misc_feature: GZ8MTXP02IYIPH.21.15.B04.1.454.CMB.2.raw
  modified_base (335)..(335): a, c, t, g, unknown or other
  modified_base (342)..(342): a, c, t, g, unknown or other
  modified_base (348)..(348): a, c, t, g, unknown or other
  modified_base (353)..(353): a, c, t, g, unknown or other
  modified_base (355)..(355): a, c, t, g, unknown or other
  modified_base (382)..(382): a, c, t, g, unknown or other
tcagtcgtcgctcgcacgaccggtgctcgatttagacagtatatatccgcggggagctacaacaggcaggcaggggcagcaagatggtgttgcagacccaggtcttcatttctctgttgctctggatctctggtgcctacggggacttcgtgatgaccccagtctccagactccctggctgtgtctctgggcgaaaggccacatcaactgcaagtccagcccgagtgtcttatccctctccgacaataagaactacttaactgtaccagcagcaaccaggacaacgtcctaaattgctcattactggcatctgtccggatccgggtcctgacgtntcgtgcngcggtntggcngntttcactctcacatcagcagccctaanaggctagaagatggtgctaagttttagtttttgtaattgtactaactagtttactcgccgtcttccgcttcacgtttcggacggtacgggaccaaagggtcgaatactacgaaaacgtacgtggtaacggcttagaccaccgatcctgttcc

SEQ ID NO: 407198 - DNA, 571 bp, Homo sapiens
  misc_feature: GZ8MTXP02IPV7Q.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttcctgttgctattttagaaggtgtccagagtgaggtgaaagtggtggagtcgggggagcttggtccagccggggggtcctgagactgtcctgtgaagtctctggattgtatagcagagattggatgcactgggtccgccagacttcgaaggaaagggtctaggaggtgggtcggaccaaacgataaaaccaagataggaagtgtagaagcactatgtggcctctggtgaggggccgtattcacaatctaccagacgacagtgaccaaagactcgttgtatctagactaaagtggacagacctgacgaggccgaggaccacggctactcgtatttacgtgtacgaccggaccggtattaacgtcgggtaaccttaacgtccgtagttcggccggttaccggtacggggaacccgg

SEQ ID NO: 407199 - DNA, 603 bp, Homo sapiens
  misc_feature: GZ8MTXP02JBDWN.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggagcttggtccaggccggggggtcctgagactgtcctgtgaagtctctggattgtatagcagagattggatgcacgtgggtccgccagacttcgaagggaaagggtctggagtggggtggaccaaacaataaaaccaaagatagggaagtggtagaaagcaactagtggtcggcctcgtggtgggacgggggcctattcaactaaactcctaccagagacagtacgaccaaagacttcgttagtaatctagacaaaagtggaacagcctaggagacggccgaaggaccaacggtctactactattacgtggtacgaccggaccgtaagtacgtcgggtaacctacggttacctagtttcggaccggtttcccggtacgggggaaccccgg

SEQ ID NO: 407200 - DNA, 564 bp, Homo sapiens
  misc_feature: GZ8MTXP02GC5T9.21.15.B04.1.454.CMB.2.raw
  modified_base (247)..(247): a, c, t, g, unknown or other
  modified_base (299)..(299): a, c, t, g, unknown or other
  modified_base (309)..(309): a, c, t, g, unknown or other
  modified_base (409)..(409): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatccctcctccganaataagaactacttagcttggaccagcagcaaccaggacaacgtcctaaatnctcatttacnggcatctgtccggaatccggggtcctgaccgtagttcgtgcgagcggtctggggacagtatttcactctacaccatcagcagccctagagctagaaagtntggtggacttaaggtttttattttgaattgactaaactattagtcgaccctctccgctaccgtaacgtttcgggacgggtaaacgggacctaaaggggtcggaaagtacgtaaaccgaaaagtaacgtggtacgctacgaccacctatacgttcg

SEQ ID NO: 407201 - DNA, 571 bp, Homo sapiens
  misc_feature: GZ8MTXP02H4ET1.21.15.B04.1.454.CMB.2.raw
  modified_base (349)..(349): a, c, t, g, unknown or other
  modified_base (395)..(395): a, c, t, g, unknown or other
  modified_base (400)..(400): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaagtggtggaggtcgggggaggcttgggtccgaggccggggggtcctgagactgtcctgtgagtctctggattgtatagcagagattggatgcacgtgggtccgcagacttcgaggaaaggtctggagtgggtgaccaaacgataaaccaaganaggaagtgtagaagcactatgtgcctgtgtggaggggcctattcanactcncagagacagtgacccaagtaactcgttgtactcttagacctaaaagtggtacaggccgtagacgacggcggagaccgcgtctctactacgttacgtcgtacggaccgtacggtactacggttcgtaacgtaccgttactacggttcgccggtcgggtacggggaaccccgg

SEQ ID NO: 407202 - DNA, 591 bp, Homo sapiens
  misc_feature: GZ8MTXP02JX05W.21.15.B04.1.454.CMB.2.raw
  modified_base (308)..(308): a, c, t, g, unknown or other
  modified_base (401)..(401): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctcctccgacaataagaactactagcttggtaccagcagcaaccaggacaacgtcctaaatgctcatttacnggcatctgtccggaatccggggtcctgaccgattcgttgcagcggtctgggcagatttcactctcaccatcagcagcctacagctgaagatgngctagtttattttgatgacaacgtatttaatcggtacctcctcccgcttaccgtaccgttttcgggaccggggtaacggggtaaacccgaaagggggttacggaaacggtaacgttaacccgaaaaaccggtaaccgttaaggttacggggaccttacgggaccctaacccgtaactttacgtttcccgg

SEQ ID NO: 407203 - DNA, 569 bp, Homo sapiens
  misc_feature: GZ8MTXP02IOE93.21.15.B04.1.454.CMB.2.raw
  modified_base (361)..(361): a, c, t, g, unknown or other
  modified_base (443)..(443): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgctgctctggatctctggtgcctacggggacttcgtgatgacccagtctccagacctccctggctgtgtctctgggcgaaagggccaccatcaactgcaagtccagcccgagtgtcttatcctcctccgacaataagaactacttagcttggtaccagcagccaaccaggacaacgtcctaaattgctcatttactggcatctgtccggaatccggggtcctgacccgtattcgtgcagcggtcnggggacagtatttcactctacaccatcagcagcctacgagctagaagatgtggacttagttttattttgattgactaaactnttagtcgccgtctccgtctcgtaccgtttcgggacggtacgggaccgtaaagggtcggtaacgaacgttacgaaaaacggtaacgttaggtcgggtaccttacggaccctaaccgtaagtttcccg

SEQ ID NO: 407204 - DNA, 559 bp, Homo sapiens
  misc_feature: GZ8MTXP02IXKSQ.21.15.B04.1.454.CMB.2.raw
  modified_base (395)..(395): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatcctctccgacaataagaactactagcttggtaccagcagcaaccaggacaacgtcctaaatgctcatttactggcatctgtccgggaatccggggtccctgaccgtattcgtggcaggcggtctgggacagtactttcacttctcacatcagcagcctanaggctagaagatgtggcttagttttattttgatgtacctaatattactcgccgtctccgtccttacgacgtttcgggacgggacgggtaacccaaaggggttcggaagtacgttaaaccgaaaacgtaacgtggtacggcttacggacctaccgtattcgttcg

SEQ ID NO: 407205 - DNA, 688 bp, Homo sapiens
  misc_feature: GZ8MTXP02IFO2E.21.15.B04.1.454.CMB.2.raw
  modified_base (256)..(256): a, c, t, g, unknown or other
  modified_base (349)..(349): a, c, t, g, unknown or other
  modified_base (479)..(479): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtcctccagacctccctggctgtgtctcgtgggacgaaaggccaacatacaactgacaagtccagcccgagtcgtcttactcctcctaccgaanaataaacgaactacgttagccttaggtaaccagacaacgaccaaaccgaggaaccaaacgttacctaaaagttcgaccttactaagtttacgngggtacctaagttcgtacggtacccgggaaacgttccccgggggtaccctggaacccgtagtttccggttggacctagggtccggggttactaggggacctaggtactttccgaaccttcctacaacctnacagccaacgcctagaggtctaggaagtagtgggtacgttacttaaggtttttattttagacgtttagaccttaaagtatttacgccgtacccgccttccgacttaccgtaccgtttacggggacggtaaacgggaccgtaaagggttggaaacgtaacgtaaaccgaaaacgtgtaaggtcgaactcgaactaccactttcgttaccg

SEQ ID NO: 407206 - DNA, 571 bp, Homo sapiens
  misc_feature: GZ8MTXP02HT67N.21.15.B04.1.454.CMB.2.raw
  modified_base (248)..(248): a, c, t, g, unknown or other
  modified_base (310)..(310): a, c, t, g, unknown or other
  modified_base (399)..(399): a, c, t, g, unknown or other
  modified_base (413)..(413): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaagggccaccatcaactgcaagtccagcccgagtgtcttactcctcctccganaataagaactacttagcttggtaccagcagcaacaggacaacgtctaaatgctacatttacnggcatctgtaccggaatcccggggtcctgaccgtattcgttgcaggcgggtctgggacagtatttcgactctcaccatcagcagcctanaggctaggaaagtntggtagtacttagtttttattttgattgaactaaactattagcgccgtctccgtcttaccgtacgtttccggggacggaacgggtaccgtaaagggtcggaaacaacgtaacgaaaacgtacgtaaggtcggacctcgacctaacctacgttcgttcg

SEQ ID NO: 407207 - DNA, 604 bp, Homo sapiens
  misc_feature: GZ8MTXP02JOOMV.21.15.B04.1.454.CMB.2.raw
  modified_base (300)..(300): a, c, t, g, unknown or other
  modified_base (306)..(306): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagaactactagcttggtaccagcagcaaccaggacaacgtcctaaatgctnattacnggcatctggtccgggaatcccggggtccctgaccgtacgttcgttggccaggccggggtctggggaccagtactttccaccgttctaccacctatccgaagtccacgccctacagggtctaggaaagatggtagcttaggttttattttgtaatgtactaactattacgtcgcccgtctccggtcttcgtacgtttcgggacggtacggggacccgtaaaggggtcggaaagtacttaaaccggaaaaccgtaacgttgggtacggccgttacggaccctaccgtacgttcgtttccg

SEQ ID NO: 407208 - DNA, 611 bp, Homo sapiens
  misc_feature: GZ8MTXP02GQJCD.21.15.B04.1.454.CMB.2.raw
  modified_base (309)..(309): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccacatcaactgcaagtccagcccgagtgtcttatccctcctccgacaataagaactacttagcttggtaccagcagacaaccaggacaacgtcctaaatgctcatttacngggcatcgtcggtccgggaacgtccggggtccctgaccgtacgttcggttggcaggtcgggtctgggctagtactttcactctcacatcagcagcctagacggctaggaagtagttcggtaggtactttaaggttttttatttttagtaagttacgacctaaattattaagtcccgcccgtcctacccggtccttccgtaaccggtttccgggacggggtacgggtaaaccgtacggggtaggaacgtacttaaccgaaaacggtaccgtggtacgtctacggaccctacgtagttcgttcg

SEQ ID NO: 407209 - DNA, 566 bp, Homo sapiens
  misc_feature: GZ8MTXP02HQB15.21.15.B04.1.454.CMB.2.raw
  modified_base (296)..(296): a, c, t, g, unknown or other
  modified_base (369)..(369): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcgggggagcttggtccaggccggggggtcctgagactgtcctgtgagtctctggattgatagcagagattggatgcacgtgggtccnccagacttcgaggaaaggtctggagtgggtggaccaaacataaaccaaagatggaagtgtagagcactatggngcctctgtggacggggccgattcaacaactctaccgagagacagttcgacccaaagtaactcgttgtactcgttagacaaagttggacagccctaggagacggcgaggtaccacggctactacctagtttacctgtacggacgaccggtatacgtgaacgttacgtcgtattcggccggttccgttaggggaccccg

SEQ ID NO: 407210 - DNA, 537 bp, Homo sapiens
  misc_feature: GZ8MTXP02JLENK.21.15.B04.1.454.CMB.2.raw
  modified_base (337)..(337): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggagcttggtccaggccggggggtcctgagactgtcctgtgaagtctctggattgtatagcagagattgggatgcacgtgggtccgccagacttcgaggaaagggtctggagtgggtggaccaanataaaccaagataggaagtgtagaagcactatgtggcctcgtggtggaggggcctattcacaatctaccagagacagtgacccaaagaactcgttagtatcagacaaatggacagcctgagacgccgaggaccacggctctcgtattactgtcgacgaccggtatagtggctacgtcagttcgacgtccgtggggacccg

SEQ ID NO: 407211 - DNA, 518 bp, Homo sapiens
  misc_feature: GZ8MTXP02ICPH7.21.15.B04.1.454.CMB.2.raw
  modified_base (459)..(459): a, c, t, g, unknown or other
  modified_base (472)..(472): a, c, t, g, unknown or other
  modified_base (486)..(486): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtcaggccggggggtcctgagactgtcctgtgaagtctctggattgtatagcagagattggatgcactgggtccgccagacttcgaggaaaggtctggagtgggtgcaaacataaaaccaagatggaagtgtagaagcactatgtggcctgtgtgagggggccagttcacaaatctaccagagacagtgaccaaagaactcgttgtatctgacaaagtgacagcctgagagcgagacncgctctctattcngtcgcgacgatagngaacgtcgactactcgcgtcggtacggaccgg

SEQ ID NO: 407212 - DNA, 552 bp, Homo sapiens
  misc_feature: GZ8MTXP02HSRZ2.21.15.B04.1.454.CMB.2.raw
  modified_base (238)..(238): a, c, t, g, unknown or other
  modified_base (313)..(313): a, c, t, g, unknown or other
  modified_base (391)..(391): a, c, t, g, unknown or other
  modified_base (395)..(395): a, c, t, g, unknown or other
  modified_base (403)..(403): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtctccagactccctggctgtgtctcgtgggacgaaaggccaccatcaactgacaagtccagcccgagtgtcttancctcctccgacaataagaactacttagcttaggtaccagcagcaaccagacaacgtcctaaatgctcatttacgnggcatctggtaccggaagtcccggggtcctggaccgtgttcgtggcaggtcggtcgtgggcagtattcactctcacancacnacgcctanagctagaagagtgtgtacttagttttatttgattgaactatattacgcgcccgctccgcttaccgtacgttccgggacgggtacggtaccaaagggtggaaacacgtaacgaaaacgagtcggtcgactacgacctaaccgtctcgtcg

SEQ ID NO: 407213 - DNA, 527 bp, Homo sapiens
  misc_feature: GZ8MTXP02I43HC.21.15.B04.1.454.CMB.2.raw
  modified_base (417)..(417): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagaactacttagcttggtaccagcagcaaccaggacaacgtcctaaattgctcatttactggcatctgtccggaatccggggtccctgaccgattcgtgcagcggtctgggcagtattcactcctcaccatcagcacgcctacgagctgaagatgtggcttaagtttnttttagtattgacctaagtattaatcgtccgtctccgcttctacgtttcggcgagggaccaagggtagagtactacgaaacgacgtgtacgctcgacaccgtattctacg

SEQ ID NO: 407214 - DNA, 625 bp, Homo sapiens
  misc_feature: GZ8MTXP02JUS48.21.15.B04.1.454.CMB.2.raw
  modified_base (315)..(315): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtcctccagactccctggctgtgtctcgtgggacgaaaggccaccatcaactgacaagtccagcccgagtgtcttactccctcctaccgaactaataagaactactagcttggaccagcagcaacagacaacgtactaatgctatatttacgnggctagtcgtcgtaccgggactcccggggtccaggtaccgtagtttcggtgactacgggtcgggtagtacggggacagttactttccgacgtcctaccacctatccacgaccacgtccctagacgtactaggaaacgtgtcggtagtatttagttttagttttagatcgtactaactattacgcgtccgtcctccgtacttccgtacggtttacgggaccggggacgtaaccggtaagggtacgaaacggttaacctaaccgtaaacggtaacgttgggacgtactacggaccacgttacgtcgttaccg

SEQ ID NO: 407215 - DNA, 578 bp, Homo sapiens
  misc_feature: GZ8MTXP02G64G0.21.15.B04.1.454.CMB.2.raw
  modified_base (301)..(301): a, c, t, g, unknown or other
  modified_base (308)..(308): a, c, t, g, unknown or other
  modified_base (359)..(359): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagaactacttagcttggtaccagcagcaaccaggacaacgtcctaaatgctnatttacnggcatctgtccggaatccgggtcctgaccgattcgtgcagcggtctgggcngtattcactctcacatcagcagctacaggctgaagagtgtagcttagttttattttggtattgactaactaattagtcgcccgtctcccgcttaccgtaacgtttcgggacgggtaacgggtaacccgtaaagggttaggaacgtaacgttaaaccgaaaaccggtaaacgttgggttacggaccttacggaccgtaaccccgtattacccgtttacgg

SEQ ID NO: 407216 - DNA, 542 bp, Homo sapiens
  misc_feature: GZ8MTXP02GULVP.21.15.B04.1.454.CMB.2.raw
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtcttatccctcctccgacaataagaactacttagcttggtaccagcagcaaccaggacaacgtcctaaatgctcatttactggcatctgtccggaatccggggtcctgaccgattcgtgcagcgggtctgggcagatttcactctcaccatcagcagcctacagctgaagatgtggctagtttattttgtattgactaactattatcgccgtctccgctctacgtttcgggacggacgggaccgaaagggtggaacgtaacgtacaaaaccggtaacttggtacggacttcggaccacccgtaattcctttcg

SEQ ID NO: 407217 - DNA, 618 bp, Homo sapiens
  misc_feature: GZ8MTXP02GP57U.21.15.B04.1.454.CMB.2.raw
  modified_base (297)..(297): a, c, t, g, unknown or other
  modified_base (379)..(379): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggagcttggtccaggccggggggtcctgagactgtcctgtgaagtctctggattgtatagcagagattggatgcacgtgggtccncagacttcgaaggaaaggtctggagtggggtgaccaaacataaaccaagataggaagtgtagaagcactagtgtggcctcgnggtggacgggggccagttccaacaatcctaccgagagacagtcgacccaagtaaccttcgttagtaatctagacaaaagtggaacacggcctaggaacgacggacccggaagggaccgtacgggccttcctacttacgtttaccgtgggtacggaccggtacccgggtaattaacgtcgggtaaccttaacccggttacgtacggttcggtacccggttccgggtaccgggggaacccg

SEQ ID NO: 407218 - DNA, 573 bp, Homo sapiens
  misc_feature: GZ8MTXP02H9IZF.21.15.B04.1.454.CMB.2.raw
  modified_base (249)..(249): a, c, t, g, unknown or other
  modified_base (313)..(313): a, c, t, g, unknown or other
  modified_base (347)..(347): a, c, t, g, unknown or other
  modified_base (401)..(401): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaagggccaccatcaactgcaagtccagcccgagtgtcttatccctcctccgaanaataagaactacttagcttggtaccagcagcaaccagacaacgtcctaaatgctctatttacgnggacatctggtccggagtcccggggtcctgaccnttcgtgcaggcggtctgggacagtactttcactctcacatcagcacgcctacgnggactagaacgtagtgtggtacttaggtttttatttttgatttcgactaaacgtattacgtcgcctcgtaccgtcttcgtaccgtttcgggacgggtacgggaccgtaaaggtggaaacgtacgtaaccgtaaaacgacgtggtacggctacggaccaaccgttctacgtcg

SEQ ID NO: 407219 - DNA, 622 bp, Homo sapiens
  misc_feature: GZ8MTXP02GF41H.21.15.B04.1.454.CMB.2.raw
  modified_base (305)..(305): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaagggccaccatcaactgcaagtccagcccgagtgtctatcctcctccgacaataagaactactagcttggaccagcagcaaccaggacaacgtctaaatgctcatttacnggcatctgtccgggaatccggggtcctgaccgtattcgtgcaggcggtctgggcagtactttcactctcaccatcagcagcctacgaggtctagaaagagtggtacggactttaaaggtttttatttttaggtaagttgacctaaaacgttatttaacgtcggtacccgtcccgttccgtccttaccgtaaccgttttccggggaccggggtaacggggtaaacccgtaaaaggggttcggaaacgtacgttaaccgaaaacggtaaccgttgggtacgggtaccttacggaccctaacccgtagtttcctttacgg

SEQ ID NO: 407220 - DNA, 624 bp, Homo sapiens
  misc_feature: GZ8MTXP02I0GR6.21.15.B04.1.454.CMB.2.raw
  modified_base (321)..(321): a, c, t, g, unknown or other
  modified_base (351)..(351): a, c, t, g, unknown or other
  modified_base (358)..(358): a, c, t, g, unknown or other
  modified_base (381)..(381): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagacctccctggctgtgtctcgtgggcgaaaggccacatcaactgcaagtccagcccgagtgtcttactccctcctaccgaacaataaagaactacttagcttaggtaccagcagaccaaaccaggaccaacgtcctaaatgctctatttacgnggcatcgtggtccggaactcccggggtccngaccgtnttcgtgcaggcggtcgtgggacngtactttccaccttccacacctatacagccacgaccctagagctaggaagtagttggtagggtactttaaggtttttatttttaggaacttcgtaaccctaaacgttattacgtccggtacccgtccgtcccggtcttaccgtacggtttccggggaacgggtacgggtaaccgaaggggttcggaacgtactaaaccgaaacgtacgtggtacggtctacggacctaacgtacttcgtttcg

SEQ ID NO: 407221 - DNA, 517 bp, Homo sapiens
  misc_feature: GZ8MTXP02GFRQX.21.15.B04.1.454.CMB.2.raw
  modified_base (332)..(332): a, c, t, g, unknown or other
  modified_base (358)..(358): a, c, t, g, unknown or other
  modified_base (386)..(386): a, c, t, g, unknown or other
  modified_base (428)..(428): a, c, t, g, unknown or other
  modified_base (432)..(432): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctctccgacaataagaactacttagcttggtacagcagcaaccaggacaacgtcctaaatgctcattactggcatctgtccgggaatcccgggtccngaccgattcgtgcagcggtctgggcngatttcactctcaccatcagcagcctanagctagaagatgtagctagtttattttgatgacaatattagngccncttccgctctacgtttcggcggacgggacctaaagggtcgaagactaaccgaaaacgactggtacggctacgacctacactctcg

SEQ ID NO: 407222 - DNA, 549 bp, Homo sapiens
  misc_feature: GZ8MTXP02JJ75B.21.15.B04.1.454.CMB.2.raw
  modified_base (309)..(309): a, c, t, g, unknown or other
  modified_base (402)..(402): a, c, t, g, unknown or other
  modified_base (443)..(443): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatccctcctccgacaataagaactacttagcttggtaccagcagcaaccaggacaacgtcctaaatgctcatttacnggcatctgtccggaatccggggtcctgaccgtattcgtggcaggcggtctgggcagatttcactctcacatcagcagcctacaggctagaagntgtcggtcttaagtttattttagtatgactaactattaacncgccgtctccgctcgtacgtttcggacgggtacgggaccaagggtcggaagtacgtaccgaaaacgtaacgtggtacggtacgtacggacctacccagtttcttcg

SEQ ID NO: 407223 - DNA, 585 bp, Homo sapiens
  misc_feature: GZ8MTXP02JVVTZ.21.15.B04.1.454.CMB.2.raw
  modified_base (306)..(306): a, c, t, g, unknown or other
  modified_base (354)..(354): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccaccatcaactgcaagtccagcccgagtgtcttatcctcctccgaacaataagaactatagcttggaccagcagcaacagacaacgtctaaatgctacatttacgnggcatctgtccggaatccggggtcctgacgcttcgtgcaggtcggtcngggacagtactttccgactctcaacctatcagcacgcctaacgaggtctaggaaagagtggtaggctttaagtttttattttagaattgactaaactatttacgcgtccgtctccgtctaccgtacgttcgggacggggtaacggtaccgaaagggtcggaaacgtaactaccgaaaaacggtcgttaaggtcggtacgtacggacctaaacccgtagttacccgtttcgg

SEQ ID NO: 407224 - DNA, 656 bp, Homo sapiens
  misc_feature: GZ8MTXP02IM2OC.21.15.B04.1.454.CMB.2.raw
  modified_base (249)..(249): a, c, t, g, unknown or other
  modified_base (320)..(320): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggacgaaaggccaccatcaactgcaagtccagcccgagtgtcttactcctcctccgaanaataagaactacttagcttggtaccagcagacaaccaggaaccaacgtacctaaatgactactatttacgngggacattcgtggtaccgggaagtccccggggtccctaggacccgtactttcggttggccgtagggtccgggttcgtggggacctaggttactttccgaccttccgtacaaccctatcaagccaacgtccctagacggctagaaagtagtggtcgtacttagtttttatttttggtaattagacctaaattattacgtcggtccctcgttaccgccttacgtaccggttttaccgggacgggaaccgggtaaccgaagggtacgggtaaactacgttaaaccgaaaacggtaacgttggtaacggtcctacggacctaaccgtacgtttaccttcg

SEQ ID NO: 407225 - DNA, 586 bp, Homo sapiens
  misc_feature: GZ8MTXP02GZ68A.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttcctgttgctattttagaaggtgtccagagtgaggtgaaagtggtggaggtcgggggagcttggtccaggccggggggtccctgagactgtcctgtgaagtctctggattgtatagcagagattggatgcacgtgggtccgccagacttcgaagggaaagggtctaggaggtggggtggacccaaacataaaaccaagaagtaggaagtgtagaagcactagtgtgcctgtggtggacgggggtccgattcgaactaactctaccaagagacagtacgacccaaagaacttcgttagtactacgtcgaacaaagtgaactagaccgtagacgacggaccgaggaccacggctctacgtattactcggtacgacggaccggtatacgtcgtcgttacgtactagttcggcgttccggtacggggacccgg

SEQ ID NO: 407226 - DNA, 745 bp, Homo sapiens
  misc_feature: GZ8MTXP02IFJ61.21.15.B04.1.454.CMB.2.raw
  modified_base (338)..(338): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatcgacccagtctccagacctccctggctgtgtctcgtggggacgaaagggccaccatcaactgacaacgtccacgcccgagtcgtcttactccctcctaccgaacaataaagaacttacttagcttaggaccagcagaccaaaccgacggaacaaacgtacctaaattgactactatttacgnggactagtcgtcggtaccgggaacgtccccggggtaccctggaccgtcgttcggttggcagggtcgggtcgtacgggactagttactttccgaccttccctacaacctactaccgaacgccgtaacgtacccttaaacggacggtaccgtaaggtaaaacggtagttggggttacggtacgtttaaagggtttttttaagtttttaggtaagtttacgtaacccttaaaattacgtttaacgtccgggtaccctaccgtttccccggtaccgtttacccgttaccgggtttccggggaacggggtaacgggtaaacccggtaagggtacggaaacggtactaaaaccgtaaaacggtaaccgtggtaaccggttcgccgtaaccgtacccgtaatttccgtttaacg

SEQ ID NO: 407227 - DNA, 539 bp, Homo sapiens
  misc_feature: GZ8MTXP02I6O45.21.15.B04.1.454.CMB.2.raw
  modified_base (335)..(335): a, c, t, g, unknown or other
  modified_base (492)..(492): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggagcttggtccaggccggggggtcctgagactgtcctgtgaagtctctggattgtatagcagagattggatgcactgggtccgccagacttcgaggaaagggtctggagtgggtggcccaanataaaccaagataggaagtgtagaagcactatgtggcctcgtggtggacggggccgattcacaatctccagagacagtagaccaaagtaactcgttagtactctagacaaagtggacagcctgagacggccgaaggcgacggctcgtactattacgngtcgcgaccggatacgtggctacgtctacgtcgcgtcgtggggaccg

SEQ ID NO: 407228 - DNA, 626 bp, Homo sapiens
  misc_feature: GZ8MTXP02I1MXN.21.15.B04.1.454.CMB.2.raw
tcagtcgtcgctcgcacgaccggtgctcgatttagacagtatatatccgcgggggtctcagagaggagccttagccctggactccaaggcctttccacttggtgatcagcactgagcacagaggactcaccatggaattggggctgagctgggttttcctgttgctattttagaaggtgtccagagtgaggtgaaagtggtggagtcgggggagcttggccaggccggggggtcctgagactgtcctgtgagtctctggattgtatagcagagattggatgcacgtgggtccgccagacttcgagggaaaggtctggaggtgggtgaccaaacaataaaaccaagagtaggaagtgtagaagctaactagtaggtcggcctcgtggtgggacgggggcccgtaagtttccaacgtaaactcctacccgaagacgaacagtacgacccgaaagtaacctcgttagtactcgtagacaaaagtggaactagacctagagaggacccgaaggaccacggcttacgtacttacttaccgtggtacggaccggaccggtaacgttagtacgggtaaccgttaaccgtacgtacgtttcggcccgttacccgggtacgggggaaacccccgg

SEQ ID NO: 407229 - DNA, 513 bp, Homo sapiens
  misc_feature: GZ8MTXP02HLY8E.21.15.B04.1.454.CMB.2.raw
  modified_base (305)..(305): a, c, t, g, unknown or other
  modified_base (387)..(387): a, c, t, g, unknown or other
  modified_base (494)..(494): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagactactagcttggtaccagcagcaaccagacaacgtcctaaatgctcatttacnggcatctgtccggaatccggggtcctgaccgattcgtgcaggcggtctgggcagtatttcactctcaccatcagcagcctanaggctgaagatgtggctagtttatttttgtaattgacaactattactcgccgctccgctactacgttcggcggtaggacctaaagggtgagactacgaaacgactgngactcgacaccgatcgtcg

SEQ ID NO: 407230 - DNA, 599 bp, Homo sapiens
  misc_feature: GZ8MTXP02GCS2T.21.15.B04.1.454.CMB.2.raw
  modified_base (297)..(297): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcgggggagcttggtccaggccggggggtcctgagactgtcctgtgagtctctggattgtatagcagagattggatgcacgtgggtccnccagacttcgaggtaaaggtctggagtggggtaggaccaaacaataaaaccaagatagggaaagtgtagaagcaactagtggtaggcctcgtggtagggacgggggcccgtaatttccgaactaaatcctacccgaaggaagaccagtacgacccgaaaagtaaacgttcgttagtaacttccgtaggactaaaagtggaacagcctaggagacgaccggaaggacgacggtctcgtacttacttacgtgtcgacgaccggatacgtcggaacgtacgtctagtgccgtcgtacggggaccg

SEQ ID NO: 407231 - DNA, 523 bp, Homo sapiens
  misc_feature: GZ8MTXP02GZCGI.21.15.B04.1.454.CMB.2.raw
  modified_base (318)..(318): a, c, t, g, unknown or other
  modified_base (370)..(370): a, c, t, g, unknown or other
  modified_base (407)..(407): a, c, t, g, unknown or other
  modified_base (409)..(409): a, c, t, g, unknown or other
  modified_base (415)..(415): a, c, t, g, unknown or other
  modified_base (428)..(428): a, c, t, g, unknown or other
  modified_base (442)..(442): a, c, t, g, unknown or other
  modified_base (448)..(448): a, c, t, g, unknown or other
  modified_base (488)..(488): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgacaagtccagcccgagttgtcttactccctcctccgaactaataagaacctacttagcttggtaccagcagacaaccaggacaacgtcctaaattgctacatttacnggcatctggtaccggaactccggggtcctgacctattcggtgcaggcggtcnggggacagtactttcactctcaccatcagcagcctangntcgaanatgagctagtttnttgatgcaatatcngacctntccgactcgacgtttcggacggtggaccaaaggtcggaanactacgaaacgatgcgactcgacacgtatcgtacg

SEQ ID NO: 407232 - DNA, 620 bp, Homo sapiens
  misc_feature: GZ8MTXP02GYWM1.21.15.B04.1.454.CMB.2.raw
  modified_base (312)..(312): a, c, t, g, unknown or other
  modified_base (488)..(488): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagaactactagcttggtaccagcagcaaaccaggacaacgtactaaattgctactatttacgnggctatcgtggtcccgggaatcccggggtccctggaccgattcgttggcaggcgggtctggggacagtatttccactctcacctagtccagccaagccctacgaggctaggaaagagtgtggacttaaggtttttattttggattgactaaactattagtgcccggtctcccggtnttcctaacgttttccggggacggtaacgggtaacccggtaaagggttcggaaaacgttactaaaccggaaaacggttaaaccgttggggtaacggtacccttaggacccaaaacccttaggttaccgtttcg

SEQ ID NO: 407233 - DNA, 558 bp, Homo sapiens
  misc_feature: GZ8MTXP02GCVQX.21.15.B04.1.454.CMB.2.raw
  modified_base (183)..(183): a, c, t, g, unknown or other
  modified_base (229)..(229): a, c, t, g, unknown or other
  modified_base (267)..(267): a, c, t, g, unknown or other
  modified_base (304)..(304): a, c, t, g, unknown or other
  modified_base (360)..(360): a, c, t, g, unknown or other
  modified_base (379)..(379): a, c, t, g, unknown or other
  modified_base (396)..(396): a, c, t, g, unknown or other
  modified_base (406)..(406): a, c, t, g, unknown or other
  modified_base (437)..(437): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtntctcgtgggcgaaaggccaccatcaactgcaagtccagcccgagtntcttatcctcctcgacaataagaactatagcttgaccngcagcaaccaggacaacgtcctaaatgctcatttacnggcatctggtccggaatcccggggtcctggaccgattccgttggcaggtcgggtcnggggccagtattcacttcncacatcagcagcctacngtcagaaagntgtggctagttttatttgatgacaatattancgctctccgctcgtaccgtttcgggacggtaacgggaaccgtaagggtaggaaacggtacttaaaccgaaaacggtaaacctaacgggttaggtctacggacctaaacccttacgtcttcg

SEQ ID NO: 407234 - DNA, 657 bp, Homo sapiens
  misc_feature: GZ8MTXP02JFW55.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccaggccggggggtcctgagactgtcctgtgaagtctctggattgtatagcagagattggatgcacgtgggtccgccagacttcgagggaaagggtctgggagtggggtggacccaaacataaaaccagataggaagtgtagaagcaactatgtcggcctcgtggtggacgggggccctattaccactaactcctcccgaagaacgacagtcgacccaaagaacgttcgttagtatcgtgacaaaagtgggaacacggcctaggaacggacggaccgggaacgggaaccacggggtacctaccgttaaccgttagtttaacccgtgggttacggacccggtaacccggggtaatttaacggttcggtaacccgtttaacgggttacctacgtttccgggtacccggtttcccgggtacgggggtaacccccggg

SEQ ID NO: 407235 - DNA, 760 bp, Homo sapiens
  misc_feature: GZ8MTXP02H8IQ3.21.15.B04.1.454.CMB.2.raw
tcagtcgtcgctcgcacgaccggtgctcgatttagacagtatatatccgcgggggtctcagagaggagccttagccctggactccaaggcctttccacttggtgatcagcactgagcacagaggactcaccatggaattggggctgagctgggttttccttgttgctattttagaaggtgtccagagtgaggtgaagtggtggaggtcgggggagcgttggtccgaggccggggggtcctgagactgtcctgtgaagtctctggattgatagcagagattggatgcacgtcgggtccaccgagtacttacgaaggtaaaggtcgtaggggaggtcggggtacggaccaaactaacgtaaaaccgaaaggtaagtaggggaagttcggtaaggaaaacgctaaacgttagttcgggttacgggtccccttacggttaggtacggggtacgggggtcccgtaagtttaccaaactaaacgttacctacccgaaggaacggaacaggttacggacccgtaaaacgtaacgttacggtttacgtaacgttacgttaggaaccgtaaaagttacggaaaccgacggtacccgttaggaaaacggaccggaccggtaaacgggaaccgaccgggtaccttacccgttaacttaacgttttaccgtaggtttaccggaccggtaacccggggtaattacggtacggtaaccgttacggttaccgtaagtttaccggcccggtttaccggttccgggggaaaccccgg

SEQ ID NO: 407236 - DNA, 604 bp, Homo sapiens
  misc_feature: GZ8MTXP02I077G.21.15.B04.1.454.CMB.2.raw
  modified_base (303)..(303): a, c, t, g, unknown or other
  modified_base (309)..(309): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagacctccctggctgtgtctcgtgggcgaaaggccaccatcaactgcaagtccagcccgagtgtcttatcctcctccgacaataagaactacttagcttggtaccagcagcaaccaggacaacgtcctaaatgctnattacnggcatctggtccggaatcccggggtcctgacccgtatttcggttggcacggtcgggtcgtggggaccaggtactttccgaccttcctaccaccatccaagccaacgccctaacgaggccttagaacgatggtgtcttaaggttttatttttgattgactaacgtattagtcgtcctctccgtctacgtacgtttccgggacgggtaagggacccgtaaggggtacggaacgtacgtaaaccaaaacggtaaccgttggtacggcgttacggacccgtaaccgtacttccgtttcg

SEQ ID NO: 407237 - DNA, 554 bp, Homo sapiens
  misc_feature: GZ8MTXP02H2JVE.21.15.B04.1.454.CMB.2.raw
  modified_base (279)..(279): a, c, t, g, unknown or other
  modified_base (297)..(297): a, c, t, g, unknown or other
  modified_base (304)..(304): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgaccccagtctccagactccctggctgtgtctctgggcgaaagggccaccatcaactgcaagtccagcccgagtgtcttatcctcctcgacaataagaactactagctggtaccagcagcaacnggacaacgtcaaatgctnatttacnggcatctggtccggaatcccggggtcctgaccgtattcgtggcaggtcgggtcttgggcagtatttccgactctcactatcagcacgcctacaggtctagaagatgtcgacttagttttattttgattgacctaatattagcgcccgtcgtccgactctacgtttcgggacgggtaacggtaccgaaagggttggaaacgtactaccgaaaacgacgtggtaacgccgttacgcctaaccgtactccgtg

SEQ ID NO: 407238 - DNA, 522 bp, Homo sapiens
  misc_feature: GZ8MTXP02JCEKB.21.15.B04.1.454.CMB.2.raw
  modified_base (307)..(307): a, c, t, g, unknown or other
  modified_base (392)..(392): a, c, t, g, unknown or other
  modified_base (501)..(501): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagaactacttagcttggtaccagcagcaaccaggacaacgtcctaaatgctcattacnggcatctgtccggaatccggggtcctgaccgtattcgtgcaggcggtctgggacagtactttcactctcacatcagcagcctagngctagaagatgtgctagtttatttgattgacaactattagcgccgtctccgtctacgtacgtttcgggcggacgggtaccgaagggtgaacgacgtaacgaaacgtacngtgactcgactactatcttcg

SEQ ID NO: 407239 - DNA, 534 bp, Homo sapiens
  misc_feature: GZ8MTXP02J1YOU.21.15.B04.1.454.CMB.2.raw
  modified_base (307)..(307): a, c, t, g, unknown or other
  modified_base (333)..(333): a, c, t, g, unknown or other
  modified_base (399)..(399): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttatcctcctccgacaataagactactagcttggtaccagcagcaaccaggacaacgtcctaaattgctcatttacnggcatctgtccggatcccggggtccngaccgatcgtgcagcgggtctgggcagactttcactctcacatccagcacgcctagagctgaagtntggtgctagttttatttgattgacaagtattagtcgtccgcctcggcctcgtaccgtttcggcgggtaagggacaacgggtggaacgtacaaccgtaaaaggaccgtggtcggacgtcgacctaccacgttctcg

SEQ ID NO: 407240 - DNA, 611 bp, Homo sapiens
  misc_feature: GZ8MTXP02HVG4C.21.15.B04.1.454.CMB.2.raw
  modified_base (312)..(312): a, c, t, g, unknown or other
  modified_base (381)..(381): a, c, t, g, unknown or other
  modified_base (386)..(386): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtctccagactccctggctgtgtctcgtgggacgaaaggccaccatcaactgcaagtccagcccgagtgtcttatcctcctccgaacaataagaactacttagcttggtaccagcagcaaccaggacaacgtctaaatgctctatttacnggcatctgtccggatccggggtccctgaccgtattcgttggcaggcggtcgtgggcagtatttcactcncaccntcagcacgtcctacgaggtctagaagtagttcggtggtacttagtttttaatttttgtaattcgtactaaactatttaacgcgtcccgtcctacccggtcttaccgtaccgttttccggggacgggtaaacggggtacccgtaaaggggttcgaacggtaacgttaaccgaaaaccggttaacgtggttacgggacttacggaccctaaacctgtttacgttccg

SEQ ID NO: 407241 - DNA, 704 bp, Homo sapiens
  misc_feature: GZ8MTXP02GER83.21.15.B04.1.454.CMB.2.raw
  modified_base (247)..(247): a, c, t, g, unknown or other
  modified_base (311)..(311): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccaccatcaactgacaagtccagcccgagtgtcttatcctcctccganaataagaactacttagcttggaccagcagcaaccaggacaacgtcctaaatgctactatttacnggcatcgtcggtacccgggaatccccggggtcctgaccgtagtttcggtggcgaggtcggggtctaggggacagtactttccgactccgtacacctactaccgagccacgtaccctaacgacggtactaggaaagtagttgggtacggtaccgtttaaggtttttatttttaggtaacgttacgtaacctaaacgttagtttaacgtccggtacccggtacccttcccggtaccttaccggttaccggtttacccgggggaccggggtaaaccgggggtaaacccggttaaacgggggttagggaaacggtaaccgtaaaccggtaaaaccggttaaccgttggggttacgggtaccttacggaccctaaccgttacgtttccgtttacccgg

SEQ ID NO: 407242 - DNA, 701 bp, Homo sapiens
  misc_feature: GZ8MTXP02JOFGB.21.15.B04.1.454.CMB.2.raw
  modified_base (298)..(298): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcgggggagcttggtccaggccggggggtcctgagactgtcctgtgaagtctcgtggattgatagcagagattggatgcacgtgggtccnccgagacttcgaagggaaaggtctagggagtggggtggacccaaacaataaaacccaagatagggaaagttgagaaacgcaacttagtggtcggcccttcgtgggttagggacgggggtccctaatttccaaactaaactccgtacccgaagaacgacgaagtacgacccgaaacgtaaaccgttaccgttagttaacgttacgtacgtaacgtaaaacgttacggacgaaaaaacggcccgtaggaacggacggacccggaacgggaccgaaaccgggtccgttacgttacctttaacgtttaaccgttggttacggtaccggaacccggtaacgttaggtacggtaacgtacgttacgtacgttccggtaccggttacccgggttcggggtaaccccgggg

SEQ ID NO: 407243 - DNA, 573 bp, Homo sapiens
  misc_feature: GZ8MTXP02HLZIC.21.15.B04.1.454.CMB.2.raw
  modified_base (229)..(229): a, c, t, g, unknown or other
  modified_base (303)..(303): a, c, t, g, unknown or other
  modified_base (311)..(311): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctcagactccctggctgtgtctcgtgggacgaaaggccacatcaactgacaagtccagcccgagtntcttactcctcctacgaacaataagactacttagcttaggaccagcagccaacgagacaacgtactaatgctanatttacgngacatcgtcggaccggtacgtccggtctagaccgtgttcgtgcgaggtcggtcgtaggctagtcttaccactcacacctatcacgcacgcctagagtctaggagtagtgtagtactttagttttagtttgagtagtactaatattacgcgtccgtcgtccgtcttacgtacggttcgggacgggtacggtaacggtaagggtacgtaacgacgtaacgaaacgttacgtcggtacggactacgacctacgtacgtttactcg

SEQ ID NO: 407244 - DNA, 591 bp, Homo sapiens
  misc_feature: GZ8MTXP02JNN53.21.15.B04.1.454.CMB.2.raw
  modified_base (458)..(458): a, c, t, g, unknown or other
tcagtcgtcgctcgcacgaccggtgctcgatttagacagtatatatccgcggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccaccatcaactgcaagtccagcccgagtgtcttatcctcctcgaacaataagaactactagcttgtaccagcagacaaccaggacaacgtactaaatgactcattactggcatctgtccggaatccggggtcctgacctagttcgtggcaggcgggtctggggcagtactttcactctcaccatcagcacgcctacgaggctagaaagtatggtcggtacttaggttttatttttagtattgtacctaaactatttaancggtcccgtcctccgccttaccgtacgtttccgggtaccgggacggggaacctaaggggttacggaacggtaaacgtaccgaaaaccggtaacgtgggtacggtcgttacggacctaccgaacttccgttacg

SEQ ID NO: 407245 - DNA, 625 bp, Homo sapiens
  misc_feature: GZ8MTXP02FMWL2.21.15.B04.1.454.CMB.2.raw
  modified_base (311)..(311): a, c, t, g, unknown or other
  modified_base (419)..(419): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaagggccaccatcaactgcaagtccagcccgagtgtcttatccctcctccgacaataagaactacttagcttggtaccagcagcaaccaggacaacgtcctaaatgctcatttacnggcatctgtccgggaatcccggggtcctggaccgattcgtgcagtcgggtctgggacagtatttcacgtctcaccatcagtccagcctacgagtctagaaagagttgnggtacttaaggttttattttgtattgacctaaatattaagtcggacccgtcttccccggtacttaccgtacgtttacccggggacgggtacgggtaaacccgtaaaggggttacggaaacgggtaaacttaaccgaaaaacccggtaaaaccgttggggtacggtacccgttacgggaaccctaacccgtaacgttaccgtttccg

SEQ ID NO: 407246 - DNA, 670 bp, Homo sapiens
  misc_feature: GZ8MTXP02HKAET.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttcctgttgctattttagaaggtgtccagagtgaggtgaagtggtggaggtcgggggagcgttggtccgaggccggggggtccctgagactgtcctgtgagtctctggattgtatagcagagattgggatgcacgtcgggtccgccagtacttcgagggtaaagggtcgtggggtaggtcgggtcggaacccaaacgaataaaaccgaagagtagggaagtgtagaagactactagtcggtcggtcctacgtggtacggggaccgggggtaccgtagtacctaaacgaacgttcctaccgaagtacgacgtacgtacgacccgtaaaagtaccgttcgttagtacttcgtacgtaaccgtaaaggttcgaacgacggtccgaaggacggacgggaccgaagggtaccgaacggtctaccgttacttagttaccgtggtacgaccggacggttaactcggtacggtaaccgtcgtacgtacgttcggtacccggtccgggttacgggaccccggg

SEQ ID NO: 407247 - DNA, 644 bp, Homo sapiens
  misc_feature: GZ8MTXP02HBZO3.21.15.B04.1.454.CMB.2.raw
  modified_base (304)..(304): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcggggggagcttgggtccgaggcccggggggtcctgagactgtcctgtgaagtctctggattgtatagcagagagttggatgctacgtgggtccncgagacttcgagggaaggtctggaggtggggtacgaccaaagaactaaaccgaagagtaggaagtgtagagcactagtcgtcgcctgtggtgggacggggcctattccgaacgtaatcctacccgagtacgactagtacgacccgaaagtaccgttcgttagtactcgtagaactaaagtcggaactacgggtccgtaggacggacggaccgggaacggaccgaccggtactaccgttactaagtttaccgcggttacggaccggtaccgtaagttacggtacggtaaccgtacgttacgtacggttcggtacccggttccggtacgggggtaaccccgg

SEQ ID NO: 407248 - DNA, 567 bp, Homo sapiens
  misc_feature: GZ8MTXP02GH65T.21.15.B04.1.454.CMB.2.raw
  modified_base (309)..(309): a, c, t, g, unknown or other
  modified_base (401)..(401): a, c, t, g, unknown or other
  modified_base (435)..(435): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctctgggcgaaaggccaccatcaactgcaagtccagcccgagtgtcttactcctcctccgacaataagaactactagcttggtaccagcagcaaccaggacaacgtcctaaatcgctcatttacnggcatctgtccgggaatccggggtccctgaccgattcgtgcgagcgggtctggggcagtactttcactctacaccatccagtccagccctanacgggctgaaagtactggagtctaaaggtttttnttttggtattgtaccaagtattagtcgcctctccgtctctacgtttcggggacggtacgggaccctaagggtcggaagtaccgtaacgaaaacgtaacgtggtcggtactcggaccaccgtaactctttccg

SEQ ID NO: 407249 - DNA, 596 bp, Homo sapiens
  misc_feature: GZ8MTXP02ISMD4.21.15.B04.1.454.CMB.2.raw
  modified_base (309)..(309): a, c, t, g, unknown or other
  modified_base (383)..(383): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaagggccaccatcaactgcaagtccagcccgagtgtcttactcctcctccgacaataagaactacttagcttggtaccagcagcaaccagacaacgtctaaatgctctattacnggcatctggtccggagtcccggggtcctggaccgtattcgtgcaggtcggtcgtgggctagtatttccacttcncacctatcagcacgcctacgaggtctaggaacgtagtggtacggtactttagtttttagtttttaggtattcgtactaaactatttacgtccgtccgtccttcccgtcttaccgtaccgtttcgggacgggtacggtaccgtaagggtacggaacgtacgtaaccgtaaacgtaacgtcggtacgtacgtacggacctacctacgttcgttcg

SEQ ID NO: 407250 - DNA, 654 bp, Homo sapiens
  misc_feature: GZ8MTXP02FOM1Q.21.15.B04.1.454.CMB.2.raw
  modified_base (269)..(269): a, c, t, g, unknown or other
tcagtcgtcgctcgcacgaccggtgctcgatttagacagtatatatccgcgggggtctcagagaggagccttagccctggactccaaggcctttccacttggtgatcagcactgagcacagaggactcaccatggaattggggctgagcgtggtttcgtgtagctatttagaaggtgtcagagtgaggtgaagtggtggagtcgggggagcttggtccaggccggggggtcctgagactgtcctgtgaagtctctggattggtataggnagagtagttggatgacgtacgtcgggtcccgaccgtacgtacgttagaaggggtaaacgggtcgtaggggagggtggggtacggaacccaaacgtaaacgtaaaaccgaaaggtaagtaaggggtaacgtagtacgaagctaacgtagtacggttacggtcccgtacggtgggtacggggaccgggggtacctattaccgaaactaacgtccgtaacccgaagaacgaacgtagtacgaccgtaaaagtaacgttcgttagtatcgtagaactaagagacgacgacgagagacgacggacggacgacgactactactatactacgtcgacgacgtacgtagtacgtaacgtacgtacgtacgtcgtccgtccggtacggtaccgg

SEQ ID NO: 407251 - DNA, 701 bp, Homo sapiens
  misc_feature: GZ8MTXP02FR8IA.21.15.B04.1.454.CMB.2.raw
  modified_base (299)..(299): a, c, t, g, unknown or other
  modified_base (311)..(311): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagacctccctggctgtgtctgtgggacgaaaggccaccatcaactgcaagtccagcccgagtgtcttatccctcctcgacaataagaacttatagcttaggaccagcagacaacaggaccaactactaaatnctatatttacgnggctatccgtaggtccgggaacgtccccgggtcctacggaccttacgttcggtcggactagggtcggttcgtagggctagtactttaccaccttctaccacgtactaccgagaccgtacgtacccgtaacgacggtacgtaaggtaaacgtaacgttgggtaccggtacggtttttaaaagtttttttggttttacgttaagttaacggtaaccttaaaaccggtttaatttaacccgccgggtaccccttaccgtttccccggtcttaccccgggtttaccggtttacccgggggacggggtaaaccggggtaaaccgttaagggggaaccgggtaataaccgtaaacgaaacgtacggttgacggtctacgacctaactcgtcttacg

SEQ ID NO: 407252 - DNA, 627 bp, Homo sapiens
  misc_feature: GZ8MTXP02FVWRG.21.15.B04.1.454.CMB.2.raw
  modified_base (278)..(278): a, c, t, g, unknown or other
  modified_base (317)..(317): a, c, t, g, unknown or other
  modified_base (386)..(386): a, c, t, g, unknown or other
  modified_base (513)..(513): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagacctccctggctgtgtctcgtgggcgaaaggccaccatcaactgcaagtccagcccgagtgtcttactccctcctccgaactaataagaacttactagcttaggtaccngcagcaaccaggaacaacgtcctaaattgctcatttacnggcatcgtgtccgggaactcccggggtcctggaccgtagttcggtggcgacggtcggggtctggggacngtactttcacctctacaccgatcgagaccacgccctacgacgggtctaggtaaagagttggtacggttcttaaagttttttattttaggtatcgtacctaaagtatttacgtgcccgtcttcccggnttacccgtacggtttccggggaacgggtacgggaaaccgttaagggacggtaaaggtactaaaccgaaaacggtaacgtgggtacgacgtacggaccttaacacgttctttccg

SEQ ID NO: 407253 - DNA, 706 bp, Homo sapiens
  misc_feature: GZ8MTXP02HHABT.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggaggtcgggggagcgttggtccgaggccggggggtccctgagactgtcctgtgagtctctggattgtatagcagagattggatgcacgtgggtccgccagacttcgagggaaaggtcgtaggaggtgggtcggaccaaacaataaaacccgaaagagtaggaagtcgtagaaagcaactatcggtggccttcgtggtgggacgggggccgtatttacaaacctaagttctacccgaagacgaaccgtagtacgacccgaaaaggtaaaccgttcggtttacgtaagttaccgttaggtaaacctaaaaggtttcggaaacctacgggtaccccttaagggaaacggaaccggggacccggtaaacggggaacccgaccggggtaccttcccgttacgttaacgtttaaccgtcggttacggacccggtaacccggtaacttacggtcggtaaccgttacgtcgttaacgttcggccgttacccggttcgggggaaaccccgg

SEQ ID NO: 407254 - DNA, 562 bp, Homo sapiens
  misc_feature: GZ8MTXP02IF4BM.21.15.B04.1.454.CMB.2.raw
  modified_base (301)..(301): a, c, t, g, unknown or other
  modified_base (311)..(311): a, c, t, g, unknown or other
  modified_base (367)..(367): a, c, t, g, unknown or other
  modified_base (403)..(403): a, c, t, g, unknown or other
  modified_base (411)..(411): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaagggccaccatcaactgcaagtccagcccgagtgtcttatcctcctcgacaataagaactacttagcttggtaccagcagcaaaccaggaccaacgtcctaaatnctcatttacnggcatctgtccgggaacgtcccggggtcctgaccgtattcgttggcaggcgggtcngggcagactttcactctacaccatcagcacgcctanagcagaangtgtagcttaagttttactttgtaatgactaagtattagtcgaccgtctaccgtcttacctacgtttccgggacgggtaaggaccgtaggggttggaacgtactaaccgaaaacgtacgtggtcggactacggacctaccgtattcgttcg

SEQ ID NO: 407255 - DNA, 621 bp, Homo sapiens
  misc_feature: GZ8MTXP02IEY3M.21.15.B04.1.454.CMB.2.raw
  modified_base (261)..(261): a, c, t, g, unknown or other
  modified_base (298)..(298): a, c, t, g, unknown or other
  modified_base (343)..(343): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttcctgtgctattttagaggtgtccagagtgaggtgaaagtggtggaggtcggggggagcgttggtccgaggccggggggtcctggagactgtcctgtgagtctntggattgtatagcagagattggatgcacgtgggtccnccgagtacttcgaagggaaaggtctggagtgggtaggacccaaanaactaaaccgaaagataggaagtgtagagctaactatgtcggcctcgtggtcggaggggcctattccgaataaactcgtacccaagacggaacagtacgaccaaagaaaccgttcgttagtactgtacgaacgaaagttcggaactacggtccgaggaacgacgggaccggaaacggaccggacgtctcttacttaacgttcgtagtacgccggtaacgtaagtcgtacgggaacttacggtactacggttcgcccggttacggtacggggaacccgg

SEQ ID NO: 407256 - DNA, 607 bp, Homo sapiens
  misc_feature: GZ8MTXP02HM84E.21.15.B04.1.454.CMB.2.raw
  modified_base (395)..(395): a, c, t, g, unknown or other
  modified_base (505)..(505): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgcttattttagaaggtgtcagagtgaggtagaagtggtggaggtcgggggagcttggtccgagggccggggggtcctgagactgtccgtgtgaagtctcgtggtattgtatagcagagtattgggatgctacgtcgggtccgccagacttcgaagggaaaggtccgtgggaggttggggtcggaacccaaacgaactaaaaccgaaggtagtagggaaagtgtaggaaancgaatagtggtacggtcctgttggaggtacgggggccgtattacgaactaactctaccgaagacgacgagtcgaccaaagtaaccgtgtgtaatctagacaaagtcgaancgcgagacgacgacgacgacgacgtcttactactagttacacgtacggacgtacgtatacggtacgtcgtacgtactcgtcgtccggttaccggacggaccg

SEQ ID NO: 407257 - DNA, 572 bp, Homo sapiens
  misc_feature: GZ8MTXP02FO1GP.21.15.B04.1.454.CMB.2.raw
  modified_base (309)..(309): a, c, t, g, unknown or other
  modified_base (565)..(565): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccaccatcaactgcaagtccagcccgagtgtcttactcctcctaccgacaataagaactacttagcttggtaccagcagcaaccaggacaacgtctaaatgctcattacnggcatcgtgccggaatcccggggtcctgaccgtattcgtgcaggcggtctggggacagtatttcgactctacgaccatcagcagaccctagaggtactaggaaagtatgggtaggtctttaagttttattttggtattgactaacgtatttacgcgacccgtcttcccgcttacgtacgtttccggggacggtacggtaaccggaagggttcggaaagtacgtaaccgaaacgtacgtgtcggatacgacaacctntcgttcg

SEQ ID NO: 407258 - DNA, 717 bp, Homo sapiens
  misc_feature: GZ8MTXP02HCUC0.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgcttattttagaaggtgtccagagtgaggtgaaagtggtggaggtcggggggagcgttgggtccgaggccggggggtccctggagactgtcctgtgaagtctcgtggattgtatagcagagtattggatgcacgtcgggtccaccagtaccgttcgaagggtaaagggttcgtaggggtaggttggggtacggaccccaaaacgtaacgttaaaaacccgaaaggtaagtaaggggtaaaggttcggttaaagggaaaacggtccctaaaccgttaaggttacgggttaccgggtccccgttcgggttaggggttacggggacggggggtacccttaagtttaccgaaaccgtaaactccgttaacccgaaggaacgaccgaggtacgaacccgtaaagtaacgttacgttagtaactccgtagaactaaagtcggaacacggtaccaggaggacggccggaagaccgacgtctcgttacttaacgttcgacgtcgaccgacggtatcgtcggtaacttacggactacgtcggccgtcggtacgggacccgg

SEQ ID NO: 407259 - DNA, 619 bp, Homo sapiens
  misc_feature: GZ8MTXP02FYTA9.21.15.B04.1.454.CMB.2.raw
  modified_base (231)..(231): a, c, t, g, unknown or other
  modified_base (320)..(320): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggacgaaagggccacatcaactgacaagtccagcccgagtntctatccctcctccgaacaataacgaactactagcttaggtaccagcagacaaccaggaaccaacgtacctaaatgctactatttacgnggcatcgtcggtccggggaacgtcccggggtcctacggtaccgtatttccggttggcgtacggtcgggtacgtagggactagtactttcgaccttctacacatacagtccagacctagaggtctagaagtagttggtacggtcttaaggtttttatttacgtatacgtactaaactattacgtcgactccgtcgtcctaccgtacgtttcgggacggtaacgggtaaccgtaaggggtagaacgtaactaaccgtaaacgacgttaaggcggacttacggactaccgtattcccgtttg

SEQ ID NO: 407260 - DNA, 562 bp, Homo sapiens
  misc_feature: GZ8MTXP02HH2XT.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggagcttggtccaggccggggggtcctgagactgtcctgtgaagtctctggattgtatagcagagattggatgcacgtgggtccgccagacttcgaggaaagggtctaggagtggggtgaccaaacaataaaccaagagtggaagtgtagaagcactatgtacgccgtctggtcgacgggggccgtattacgacaactctccgaagacgtacagtcgaccaaagtaactcgttagtatctgacaagttgactagcctagacgacgcgaggaccgacggtctactctacgttactcgtcgacgaccgatagtcgaacgtcgtactacgtcgccgtcgtacggggtacccgg

SEQ ID NO: 407261 - DNA, 594 bp, Homo sapiens
  misc_feature: GZ8MTXP02HZ775.21.15.B04.1.454.CMB.2.raw
  modified_base (321)..(321): a, c, t, g, unknown or other
  modified_base (394)..(394): a, c, t, g, unknown or other
  modified_base (442)..(442): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggacgaaagggccaccatcaactgacaagtccacgcccgagtgtcttactccctcctccgaacaaataaagaactacttagcttggtaaccagcagacaaccgaggacaacgtactaaatgctcatttacnggctatctggtccggagtcccgggtcctgaccgtattcgtgcaggcggtctgggacagtacttcactctcacntccagcacgcctacgaggtctagaaagtgtgtcggcttaaggtttttntttttaggaatttcgactaaacgtatttaacgtgacccgtcgttacccggtcttccgtacgttttaccgggacggggtaacgggtaaccggtaagggtaggaaacgtacgaacgaaaacgtacgtggtcggactcggaccaccgtgtcttcg

SEQ ID NO: 407262 - DNA, 605 bp, Homo sapiens
  misc_feature: GZ8MTXP02JIVX8.21.15.B04.1.454.CMB.2.raw
  modified_base (228)..(228): a, c, t, g, unknown or other
  modified_base (234)..(234): a, c, t, g, unknown or other
  modified_base (244)..(244): a, c, t, g, unknown or other
  modified_base (306)..(306): a, c, t, g, unknown or other
  modified_base (313)..(313): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagactccctggctgtgtctcgtgggcgaaaggccacatcaactgcaagtccagcccgagtntcttancctcctcganaataagaactctagcttggtaccagcagcaaccaggacaacgtcctaaatgctcatttacgnggcatcnggtccgggtaactccggggtcctggaccgtagtttcgtggccagggtcgggtctgggactggtaatttcgacttcctacacctagtccagccagacccttagagggtaccttaggaaagtgttagggtacgtacgttaaaggtttttatttttaaaggctttacggaacctaaacgttatttacgcgtcccggtcctcgtcctacgttacggttcggacgggtacggtaaccgtagggtaccggatacgtaacgaaacgtactggacgtctacggacccacgtctcgttacg

SEQ ID NO: 407263 - DNA, 564 bp, Homo sapiens
  misc_feature: GZ8MTXP02I0KIO.21.15.B04.1.454.CMB.2.raw
  modified_base (385)..(385): a, c, t, g, unknown or other
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgtgctattttagaaggtgtccagagtgaggtgaaagtggtggagtcgggggagcttggtccaggccggggggtccctgagactgtcctgtgaagtctctggattgtatagcagagaattggatgcacgtgggtccgccagacttcaggaaagggtctggagtgggtggaccaaacgaataaaacccgaagatgggaaagtgtgaaacgcaactatgtggcctnggtgaggggccgattcacaatctccagagacagtgaccaaagactcggtatatctagcaaaatggacaggaccctaggagacgccggaaggacaacgggctcttactagtttaacctggtacgaccgaccggtaataagtcggctaaacggtctacgttgtccgtcgtcggggaacccg

SEQ ID NO: 407264 - DNA, 587 bp, Homo sapiens
  misc_feature: GZ8MTXP02JVYW6.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgttgctattttagaaggtgtccagagtgaggtgaaagtggtggagtcgggggaggcttggtccgaggccggggggtccctgagactgtcctgtgaagtctctggattgtatagcagagattggatgcacgtgggtccgccagacttcgagggaaaggtcgtggaggtgggtggaccaaacaataaaccgaagataggaagtgtagaagcactatgtcggcctcgtggtggacgggggccgtagtttacacgtaactcctaccagagacgagtcgaccaaagtaacgtcgttagtatcgtagactaaagtggacgagtacctgacgacggaccggaacggacgaccgggtctccgttactattaccgtgtcgacggtaccgagtacgtggtaacctcgtacgtagttcgcgttccgacggtaccgg

SEQ ID NO: 407265 - DNA, 614 bp, Homo sapiens
  misc_feature: GZ8MTXP02G19FG.21.15.B04.1.454.CMB.2.raw
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgcctacggggacttcgtgatgacccagtctccagacctccctggctgtgtctcgtgggacgaaagggccaaccatcaaactgcaagtccagcccgagtgtctatcctcctcgacaataagaactactagcttaggtaccagcagcaaaccaggacaacgtcctaaatgctacaatttacgtggcatctggtccgggaaatccggggtacctcggaccgacttcggttggcaggtcgggtctggggactaggtatttaccacttcacacctaagtccaaagccaagaccctaacaacggacctaggaaacgagtggtagggtacttaaggttttatttttaggtattgacctaaatatttaaagtcggcccgtctcccgacttccgtaaccgtttcggaccggggacgggaacccgaaaagggtcggaaagacgtaaccaaaaggaccttaagcggacctagaccaccctataccgtttg

SEQ ID NO: 407266 - DNA, 748 bp, Homo sapiens
  misc_feature: GZ8MTXP02GCHII.21.15.B04.1.454.CMB.2.raw
  modified_base (237)..(237): a, c, t, g, unknown or other
  modified_base (341)..(341): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatcgacccagtcctccagacctccctggctgtcgtctcgtgggacgaaaggccacatcaactgacaagtccacgcccgtagtntacttactccctcctaccgaactaaataacgaacttacttagcttcggaaccagcacgaccaaaccgaggaaccaacgtacctaaatcgactctaagtttacgnggtactacgtcgtcggtacccgggtaacgttcccggggtccctagaccgtacgtttccggttcggacgtacggggtccggggtcgtacggggacctaagttaacgttttccaaacccttcctacctaaacccgtagttaccgtaacggaccctaacggtaccccgttaaacggaccgggttacgaaagggtaaacgttaaggttcgggttaccggtacgttttaaaggtttttttatttttagggaactttacgaacctaaaacttagtttaccgtccggtaccgttcccttaccggtacttaccgttaacggttccggggacggtaacggaccgtaaagggtacgaaagtaccgtaaacgaaacggtacgttggaacgtcgtacgtacctactacgtcgtttaccg

SEQ ID NO: 407267 - DNA, 711 bp, Homo sapiens
  misc_feature: GZ8MTXP02JHDVB.21.15.B04.1.454.CMB.2.raw
tcagtcgtcgctcgcacgaccggtgctcgatttagacagtatatatccgcggggggtctcagagaggagccttagccctggactccaaggcctttccacttggtgatcagcactgagcacagaggactcaccatggaattggggctgagctgggttttccttgtgctattttagaaggtgtcagagtgaggtgaaagtggtggaggtcgggggagcgttgggccaggccggggggtccctggagctggtcctggtgagtctcgtggtattgtatagcagagattggatcgacgacgtcgggtccgccgagtacttccgaaggaaacggggtcgtggggaaggtggggtcggggtacccaacgaaacgttaaaaacccaaagtacgttagggaaagtggttaggaagaccatttaagtacgttcggccgttcgtggtaggggacgggggacccgtaagtttaccaactaaattcccacccaaggaaacgacgaagtacgaccgaaaaacggtaacccgtttgttaggtaacttccgtaagaaccgtaaaaggttcgaacccgtaagccgtaagacggagacccgaagggtaccacgggctcccggttataaaactttcgacgggtcacccgggtaccggtaaattaccggttgaaacccggttaggttccacgttttcggcccgtttaccggggtacgggggtaaaccccgg

SEQ ID NO: 407268 - DNA, 622 bp, Homo sapiens
  misc_feature: GZ8MTXP02HILCY.21.15.B04.1.454.CMB.2.raw
  modified_base (251)..(251): a, c, t, g, unknown or other
  modified_base (433)..(433): a, c, t, g, unknown or other
  modified_base (496)..(496): a, c, t, g, unknown or other
tcagtcgtcgctcgcacgaccggtgctcgatttagacagtatatatccgcgggggagctacaacaggcaggcaggggcagcaagatggtgttgcagacccaggtcttcatttctctgttgctctggatctctggtgccgtacggggacttcgtgatgacccagtctccagacctcctggctgtgtctcgtgggacgaaaggccaccatcaactgacaagtccagcccgagtgtcttactcctcctccgaanaataagaactacttagcttaggtaccagacagcaaaccaggaacaaacgtcctaaaattgctactaatttactgggctatctggtaccgggaatcccggggtcctggaccgtattcggttggcgtaggcgggtcgtgggacagtactttcgacctctacaccatcagcctacgccctaacgnggctaggaaagtagtcgaggtactaagtttttatttgtattagacctaaatattagcgtaccnccgttccgcttaccgtaacggtttccggggacgggtaaacggggtaccgaaaggggttcggaaagttacgaaaccgtaaaaaccgacgttaaggtgacccgtcgacctaacccatttcccgttacg

SEQ ID NO: 407269 - DNA, 661 bp, Homo sapiens
  misc_feature: GZ8MTXP01BTZ28.52.66.F11.1.454.CMB.2.raw
  modified_base (273)..(273): a, c, t, g, unknown or other
  modified_base (283)..(283): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttaattttaaaaggtgtccaatgtgacgtgcaactggtggagtcgtgggggagcttgaaacagccgtgggggtccctgagactctcctgtagaacctctggcttcacgtttagngtctatgacntgagttgggtccgcaggcgtccgggggaagggctggagtggtctcaatgatcgagtgatgatggacgtagaccaaacaaaacgtcgcccgactacccggtaggaacggggccgtagaccaaccctattccaccgaagacgaactaagttacgaaggaccactactaactacctgaccaactcaaacacgaactcgaacccgaccccggcggaaccgaccggtcccgttaccttaaagtttaccgtaggttaaaggtaaaaacggaacggaacccgggtacccgcggtacgggaacggaacgggtacgacccggaaggaacggggaagaacgttcctaaccgttacgttttacggaacccgtttaacgggtaacggggg

SEQ ID NO: 407270 - DNA, 596 bp, Homo sapiens
  misc_feature: GZ8MTXP01B52QJ.52.66.F11.1.454.CMB.2.raw
  modified_base (220)..(220): a, c, t, g, unknown or other
  modified_base (254)..(254): a, c, t, g, unknown or other
  modified_base (456)..(456): a, c, t, g, unknown or other
  modified_base (563)..(563): a, c, t, g, unknown or other
tcagcgcagtacgacacgaccggtgctcgatttagtcacgcgagaaggggagagaggagcccagccctgggatttcaggtgttttcatgtggtgatcaggactgaacagagagaactcaccatggagtctgggctgacgtggtctttttcttgtggcttaattttaaaaggtgtccaatgtgacgtgcaactggtggagtcgtgggggaggcttgaaacngccgtgggggtcctgagactctcctgtagacctntgcttcacgtttagagtctatgacatgagttgggtcccgccgaggcgtaccgggggaagggctgggagtggtctcaatgatcagtgatgatggacgtagacccaacaaaatccgcccgacctccgtagaacggggtccgtagccacctatccaccagagacaattacgaaagactactactactacctgacaaactccaaanacgacgtacgaacccgacccgacgaccgtccggacctacttaattacgtagtaaacgtaaaacgacggaaccggccgaggaggaacgaggacgacgaggaaggtaanactaacacttacttacgaacgttaacgggtggg

SEQ ID NO: 407271 - DNA, 623 bp, Homo sapiens
  misc_feature: GZ8MTXP01EEHCQ.52.66.F11.1.454.CMB.2.raw
  modified_base (298)..(298): a, c, t, g, unknown or other
  modified_base (564)..(564): a, c, t, g, unknown or other
  modified_base (590)..(590): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttattttaaaaggtgtccaatgtgacgtgcaacgtggtggagtcgtgggggagcttgaaacagccgtgggggtccctgagactctcctgtacgaacctctggcttcacgtttagagtctatgacatgagttcgggtccnccgaggccgtccgggggaagggctgggagtggtctcaatgatcgagtgagtgacgtggacgtagaccaaacaaaataccgccgaccgtacccggtaggaacggggccgtagccaacctatcctaccaagaacgaacaaagttacggaaaggtaccacttactaacttaccagaccaaacctcaaaacgacgacctacgaacccaccccggcggtaaccaccggtcctacttaagttacgtagtaagtaaaacgcggaaccgaccgngtacggacgagacgacgaggagtaanaactaacacttcgttacgaacgttaacggcggg

SEQ ID NO: 407272 - DNA, 574 bp, Homo sapiens
  misc_feature: GZ8MTXP01DVAWO.52.66.F11.1.454.CMB.2.raw
  modified_base (512)..(512): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggctattttaaaaggtgtccaatgtgacgtgcaacgtggtggagtcgtggggggaggcttagaaacagccgtgggggtccctgagactctcctgtagaacctctggcttcacgtttagagtctatgacatgagttggtccgcaggcgtccggggaagggcgtggagtgggtctcaatgatcagtgagtgagtggagtagaccaacaaaagtccgccgacgtccggtagaaggggcccgtagccaccatctaccgagagactaatcgaagacactactactacctgacaactacaaacagactacgaccacccgcgacgacggcctacgtattactagtaagtaaagagaacgacgngtggagaggagaccgaggaagaagaactctaactacgtttacgaacgttaacggtaacgggg

SEQ ID NO: 407273 - DNA, 603 bp, Homo sapiens
  misc_feature: GZ8MTXP01A1RXH.52.66.F11.1.454.CMB.2.raw
  modified_base (261)..(261): a, c, t, g, unknown or other
  modified_base (431)..(431): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttaattttaaaaggtgtaccaatgtgacgtgcaacgtggtggagtcgtgggggaggcttagaaacagccgtgggggtccctgagactctcctgtacgacctntggcttcacgtttagagtctatgacatgagttcgggtccgccgagggccgtccgggggaagggctagggagtgggtctacaagtgatcgagtgatgagtggacgtagaccaaacaaaacgtccgacccgacgtacccggtaggaacggggccgtgaccaccatcacaganacaatcgaagaccactactactacctagacaaactcaaacacgacgtacgaccgacccgacggaccaccggccgtactaactactagtaaagtaaaacgacgaacggaccgcgtagggacgaggacgaccgaggacggaatactcactacgttacgaacgttcggaacgggg

SEQ ID NO: 407274 - DNA, 658 bp, Homo sapiens
  misc_feature: GZ8MTXP01BAOEF.52.66.F11.1.454.CMB.2.raw
  modified_base (220)..(220): a, c, t, g, unknown or other
  modified_base (282)..(282): a, c, t, g, unknown or other
  modified_base (299)..(299): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttaattttaaaaggtgtccaatgtgacgtgcaactggtggagtcgtggggagcttgaaacngccgtgggggtcctgagctctcctgtagacctgtggcttcgtacgtttagagttctatgacngtggaggttcgggtccnccgagggccgtccggggggaagggcgtgggaggtcgggtctacaagtgatcgagtgagtgatggacgtagaccaaacgaaaactccgcccgtactaccgggaggaacgggccgtcaccaccatccacgaagacgaactaagttacggaaagacctaactaccttaatacccgtgaccaaacctacaaacacgacgtacgaccccgaccccggcggaaccgccggtacccgttacttaagttaacgtacggtaaacgtaaaaacggacggaacccggtcgacggtagggacggagggaacgaccgaaggaacggaacaatccgtaacttacgttacggtaaccgttaacggtaacggggg

SEQ ID NO: 407275 - DNA, 607 bp, Homo sapiens
  misc_feature: GZ8MTXP01B1JXV.52.66.F11.1.454.CMB.2.raw
tcagcgcagtacgacacgaccggtgctcgatttagtcacgcgagaagggggagagaggagcccagccctgggatttcaggtgttttcatgtggtgatcaggactgaacagagagaactcaccatggagtctgggctgacgtggctttttcttgtggctattttaaaaggtgtccaatgtgacgtgcaactggtggagtcgtggggggaggcttgaaacagccgtggggggtccctgagactctcctgtagacctctggcttcacgtttagagtctatgacatgagttgggtccgccaggcgtccgggggaagggctgggagtgggtctcaatgatcagtgatgatggacgtagaccaacaaaatcgacccgactacccggtaggaacgggggcccggtgaccacccagtcctaccaagagacaaagttccgaagaccactactatacctcgacaactcaaacagactcgaccacccggcggaccaccggcccgtactaacttacgtagtaagtaaaaaggaacggaacggaccgagtcgggaacgagggacgcccgaggaacgggtaagaactctaaccgtatttcggaacgttaaccggtcggggg

SEQ ID NO: 407276 - DNA, 664 bp, Homo sapiens
  misc_feature: GZ8MTXP01A99I6.52.66.F11.1.454.CMB.2.raw
  modified_base (518)..(518): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttaattttaaaaggtgtccaatgtgacgtgcaactggtggagtcgtgggggagcttagaaacagccgtggggggtccctgagactctcctgtagaacctctggtcttctacgtttagagttctatgactagtggaggttcgggtcccgccgaggggtccggtacccggggggaaaggggtcgtagggaggttcgggtactcgaaagttgattacgagtgaagtgagtgggacgtagaccaaacaaaatccggacccgacgtacccggtagggaacgggccggtcgaccacctatccaccgaaagagaaactaagttacgaaagacctactacctaactaccgtacaccaactaccaaanacgacgtacgacccgacccgcggaacccaccggtcctacttaagttactagtaaagtaaaacggacgaacgggcccgagtacggaacgacggacgccgaaggacgtaacgaactcgtaacgtacttacgaacgttaacgggcgggg

SEQ ID NO: 407277 - DNA, 630 bp, Homo sapiens
  misc_feature: GZ8MTXP01ALEOC.52.66.F11.1.454.CMB.2.raw
  modified_base (471)..(471): a, c, t, g, unknown or other
  modified_base (594)..(594): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtcttttttcttgtggctaattttaaaaggtgtccaatgtgacgtgcaactggtggagtcgtgggggagcttagaaacagccgtggggggtccctgacgactctcctgtacgaacctctggtcttcacgtttagagtctatgacagtggagttgggtcccgcgagggccgtaccggggggaagggctgggaggtggtctacaatgatcgagtgatacggagtagggactagaccaaacaaaacgtccgaccgactccgggtagaacggggccgtgaccaccagtcacaagacaacaagttcgaaagctactactactaccagacaacncaaacagtacgcgaaccgacccggacggaccgacggtcccgttattaacgttacgtaggtaaagaaaacggacggaaccggacccgaggacgggaacggaggacgccgaaggttacggaatanaacctaacgttacgttacgaacgttcggaacggggg

SEQ ID NO: 407278 - DNA, 606 bp, Homo sapiens
  misc_feature: GZ8MTXP01BG4KQ.52.66.F11.1.454.CMB.2.raw
  modified_base (407)..(407): a, c, t, g, unknown or other
  modified_base (429)..(429): a, c, t, g, unknown or other
  modified_base (529)..(529): a, c, t, g, unknown or other
  modified_base (570)..(570): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggctttttcttgtggctattttaaaaggtgtccaatgtgacgtgcaactggtgagtctggggagctgaaacagccgtgggggtccctgagactctcctgtagaacctctggcttcacgtttagagtctatgacatgaggttcgggtccgcgaggcgtccgggggaagggctggaggtggtctacgaatgatcagtgatgagtggacgtagaccaacaaataccgccgaacgtccgtaggaacgggcgggtgccaccatcacaganactaatcgaagcactctatccngacactacaaccagccgtagaccgaccccggcggaacctccggggccttctaatttaaccgtggttaaacgtaaaaacggaacggtaacccgggacccgngtacgggacggaaacgggagacccgaggttagggaataacnccgtaactcgtttagaaccgttaaccggtaaggggg

SEQ ID NO: 407279 - DNA, 669 bp, Homo sapiens
  misc_feature: GZ8MTXP01DIIGW.52.66.F11.1.454.CMB.2.raw
  modified_base (284)..(284): a, c, t, g, unknown or other
  modified_base (609)..(609): a, c, t, g, unknown or other
  modified_base (623)..(623): a, c, t, g, unknown or other
  modified_base (635)..(635): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttattttaaaaggtgtccaatgtgacgtgcaacgtggtggagtcgtgggggaggcttgaaacagccgtgggggtccctgagactctcctgtagaacctctggcttcacgtttagagtctatgacntgtagtcgggtcccgccgagggccgtaccggggggaaggggtcgtggggaggttgggtctacaaagttgaattcgaggtgagtggaagttcggggacgtaacgacccaaactaaaaaacgtacccggacccgtaaccgtacccgggtagggaaccgggggcccggtacggacccaacctacgttcccgtaccgaaacgaacgaaactaaacgttacgggaaacggtactaaccgttactaactaccctgaacccaactaccaaacacgacgtacgaccacccggcgaccgaccggtcctatatactagtagaaagacgaacgcgngtaggacgaggacncgaggaaggaanaactcgaactcgttacgaacgttaacggtcgggg

SEQ ID NO: 407280 - DNA, 791 bp, Homo sapiens
  misc_feature: GZ8MTXP01CHAEG.52.66.F11.1.454.CMB.2.raw
  modified_base (222)..(222): a, c, t, g, unknown or other
  modified_base (276)..(276): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttattttaaaaggtgtccaatgtgacgtgcaacgtggtggagtcgtgggggagcttagaaacngccgtggggggtccctgagactctcctgtacgacctctggtcttcacgtttagngttctatgacagtggtaggttcgggtccgccgagggccggtcccggggggaaggggtcgtgggaggttcggggtctacgaagtgatcgagttgagtggactagggacgtagacccaaacaaaacgtccgacccgacgttcccgggaggaacggggccgtacgacccaacccgtattacccgacaaaggaaccgtaaacgtaaacgttaccgggaaaggtaccctaacgttacctaaactttacccgacggtaacccaaaccgtaccaaacgtaacggaacccgtaccggaaaccccggaccccgggaccggaaacccgtccccgggtccttaacgttaaccgtttaacgtagggttaaaacggtaaaaacgggaccgggtaaccccgggtaaccggttaccgggtagggggaaacccgggaacggggggcccaaaggggttaagggaaactaacgttccgttaaaccgtttacgtttacggaacccggtttccggggttaacgggggaacccggg

SEQ ID NO: 407281 - DNA, 655 bp, Homo sapiens
  misc_feature: GZ8MTXP01AYG83.52.66.F11.1.454.CMB.2.raw
  modified_base (223)..(223): a, c, t, g, unknown or other
  modified_base (581)..(581): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttaattttaaaaggtgtccaatgtgacgtgcaactggtggagtcgtgggggaggcttagaaacngccgtgggggtccctgagactctcctgtagaacctctggcttcacgtttagagtctatgactatggagttcgggtcccgccgagggccgtccggggggaagggcgtgggagtggtctacaatgatcagtgatgatggacgtagaccaaacaaaatccggacccgtacgtacccggtaggaacggggcccggtagaccaccctatccaccgaagacgaacaagttacgaaacggacctactactaacgtaccctagaccaaacctacaaacacggactacggaacccaccccggacggaaccacccgggtccttataacgttacgtaggtaaagtaaaaacggaggaacccggaccggngtacgggaacggaacggacgccgaggaacggtaagaaactctaacgttacgttagaaccgttcggtaacggggg

SEQ ID NO: 407282 - DNA, 619 bp, Homo sapiens
  misc_feature: GZ8MTXP02GULAW.52.66.F11.1.454.CMB.2.raw
  modified_base (221)..(221): a, c, t, g, unknown or other
  modified_base (296)..(296): a, c, t, g, unknown or other
  modified_base (556)..(556): a, c, t, g, unknown or other
  modified_base (591)..(591): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttaattttaaaaggtgtccaatgtgacgtgcaactggtggagtcgtgggggagcttgaaacngccgtgggggtccctgagactctcctgtagacctctggcttcacgtttagagtctatgacatgagttcgggtccnccgaggcgtccggggaagggctggagtgggtctcaatgatcagtgatgatggacgtagacccaacaaaatccgaccgactccggtaggacgggggccgtgaccaccagtcctaccaagacgaactaaagttacgaaacggacctaactactaactaccctagaccaaacctacaaacagacctacgaacccaccccgggacggaacctacccgggccttactagttaaccgtgtaaagtaaaaggaacgaccggacccgngacgggaacggaggacgacgaaggaggaagtaacnctaactacgtttagaccttaggacgggg

SEQ ID NO: 407283 - DNA, 615 bp, Homo sapiens
  misc_feature: GZ8MTXP02HT0CF.52.66.F11.1.454.CMB.2.raw
  modified_base (385)..(385): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggctattttaaaaggtgtccaatgtgacgtgcaactggtggagtcgtgggggaggcttgaaacagccgtgggggtcctgagactctctgtagacctctggtcttcacgtttagagtctatgacatgagttggtcccgcaggcgtcggggaagggctggagtggctcgaatgatcagtgatgagtggacgtagacaacaaaagtcgaccgactccgaggacgggccgtanccgaccatccaccagaacgaacaaagttacgaaacggactactactaactaccctagaccctaaacctacaaaacgacgaacctacgaacccaacccggcggaacccgaacggtcccgtaacttaacgttacgtagttaagaaaaaacgacggaccggaccgtcgacgggaaccgaggacgccgaaggaggaacaatcgaacttacgtttacgaaccgttacggacgggg

SEQ ID NO: 407284 - DNA, 634 bp, Homo sapiens
  misc_feature: GZ8MTXP02JFSY7.52.66.F11.1.454.CMB.2.raw
  modified_base (294)..(294): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggctttttcttgtggctattttaaaaggtgtccaatgtgacgtgcaactggtggagtcgtgggggaggcttgaaacagccgtgggggtccctgagactctcctgtagaacctctggcttcacgtttagagtctatgacatgagttgggtccnccaggcgtccggggaaggggctggaggtgggtctcaatgatcagtgattgatggacgtagaccaacaaaatccgaccgactaccggtagacgggggccgtgaccaccatcctaccagaacgactaaacgttacgaaacggaccactactactacctcgacaactacaaacagtacacgaccaccccggacggaaccaccggggacctctaattacctagtaaaggtaaaagaacggaaccggaccggcgtacgggaaccggagggacgacccgaagggaaaggaaggaaaacttaccgtaaccgttaacgtttacggaaacccgtttacggaaccggggg

SEQ ID NO: 407285 - DNA, 613 bp, Homo sapiens
  misc_feature: GZ8MTXP02JGXLK.52.66.F11.1.454.CMB.2.raw
tcagcgcagtacgacacgaccggtgctcgatttagtcacgcgagaagggggagagaggagcccagccctgggatttcaggtgttttcatgtggtgatcaggactgaacagagagaactcaccatggagtctgggctgacgtggtctttttcttgtggcttaattttaaaaggtgtccaatgtgacgtgcaactggtggagtcgtgggggaggcttagaaacagccgtggggggtccctgagactctcctgtagaacctctggcttcacgtttagagtctatgacatgagttgggcccgccaggccgtccggggaaggggctggagtgggtctcaatgatcagtgatgatggacgtagaccaacaaaatcgccgactccggtagacgggggccgtgacaccatcctaccagacgactaaagttacgaaggtaccacttactactacctagacaaactcaaacagacctacgacccacccggacggaaccaccgggcctacttagttactaggtaaagtaaaagaacggaccggaacgcgtacggaacgacgggacgaccgaaggaaggtaacgaactacgtacttacgtttacgaaccgtacggtaaccggggg

SEQ ID NO: 407286 - DNA, 579 bp, Homo sapiens
  misc_feature: GZ8MTXP02G4KER.52.66.F11.1.454.CMB.2.raw
  modified_base (294)..(294): a, c, t, g, unknown or other
tcagcgcagtacgacacgaccggtgctcgatttagtcacgcgagaagggggagagaggagcccagccctgggatttcaggtgttttcatgtggtgatcaggactgaacagagagaactcaccatggagtctgggctgacgtggtctttttcttgtggcttattttaaaaggtgtccaatgtgacgtgcaactggtggagtcgtgggggaggcttgaaacagccgtgggggtccctgagactctcctgtagacctctggcttcacgtttagagtctatgacatgagttgggtccnccaggcgtccggggaagggctggagtgggtctcaatgatcagtgatgatggacgtagccaacaaaatcgccgactccgtgacggggccgtgccaccatctaccagagaccaagttcgaaaggacacgtactactacctgaccaactcaaacagacctcgaccaccccgacggaccacggacctctacttactagtaagtaaaagacgaacggaccgtgacggacgacggacgaccgaaggtaacgggaagaaactcaacttacgttacgacgttacggaacgggg

SEQ ID NO: 407287 - DNA, 662 bp, Homo sapiens
  misc_feature: GZ8MTXP02G7TIR.52.66.F11.1.454.CMB.2.raw
  modified_base (292)..(292): a, c, t, g, unknown or other
  modified_base (325)..(325): a, c, t, g, unknown or other
  modified_base (354)..(354): a, c, t, g, unknown or other
  modified_base (385)..(385): a, c, t, g, unknown or other
tcagcgcagtacgacacgaccggtgctcgatttagtcacgcgagaagggggagagaggagcccagccctgggatttcaggtgttttcatgtggtgatcaggactgaacagagagaactcaccatggagtctgggctgacgtggtctttttctgtggctattttaaaaggtgtccaatgtgacgtgcaactggtggagtcgtgggggaggcttgaaacagccgtgggggtccctgagactctctgtagaacctctggcttcacgtttagagtctatgacatgagttgggtccnccaggcgtccggggaagggctgggagtgggtcncaatgatcagtgatgatggactagccaanaaatcgaccgactccggtagaggggccggtnaccaccgatcctacagacgaacaaagttcgaaaggactaactctactaccctagaccaaactacaaacacgtaacacgaacccgaccccggaccgggaaccgtaaccccgggtcccgttacttaactttaaccgtacggtaaagtaaaaacgaacgggaaaccggacccggtcgtaacgggaacgggaacggacggaaacccgtaaaaggggaaacgaaacgtacctaaccgtttaactttacgggaaacccttacggggtacgggggaaacccggg

SEQ ID NO: 407288 - DNA, 592 bp, Homo sapiens
  misc_feature: GZ8MTXP02HR037.52.66.F11.1.454.CMB.2.raw
  modified_base (271)..(271): a, c, t, g, unknown or other
tcagcgcagtacgacacgaccggtgctcgatttagtcacgcgagaagggggagagaggagctcagccctgggattttcaggtgttttcatgtggtgatcaggactgaacagagagaactcaccatggagtctgggctgacgtggtctttttcttgtggctattttaaaaggtgtccaatgtgacgtgcaactggtggagtcgtgggggaggcttgaaacagccgtgggggtccctgagactctcctgtagaacctctggcttcacgtttanagtctatgacatgagttggccgccaggcgtccgggggaagggctgggagtggtctcaatgatcagtgatgatggacgtagcaacaaaatcgccgactccgtggaacgggcccggtgcccaccatcctaccgagagacaattacgaaaggacactctaataccctgaccaactcaaactacggactggacccacccggcgaaccgaccgggcctactaattaccgtagtaaggtaaaaagacggaccggtaccgacgtacggggaacgacgggaacgccgaaggtaacggagaaactcgaacttacgtttagacgttacggg

SEQ ID NO: 407289 - DNA, 658 bp, Homo sapiens
  misc_feature: GZ8MTXP02H1UIF.52.66.F11.1.454.CMB.2.raw
  modified_base (620)..(620): a, c, t, g, unknown or other
tcagcgcagtacgacacgaccggtgctcgatttagtcacgcgagaaggggagagaggagcccagccctgggattttcaggtgttttcatgtggtgatcaggactgaacagagagaactcaccatggagtctgggctgacgtggtctttttctgtggcttattttaaaaggtgtccaatgtgacgtgcaactggtggagtcgtgggggagcttagaaacagccgtgggggtccctgagactctctgtagacctctggtcttctacgttagagtctatgacagtgaggttcggcccgccgaggccgtccgggggaaggggctgggaggttgggtctacgaatgatcgagtgattgagtgggaacgtagaccaaacaaaaactccgacccgtacgtcccggtaggacggggccgtagacccaccgattccgaccaaggaacgtaaaccaagttaacggaaacggtacaaccttactaactacccgtacgaacctaaactacaaacaacgtaccacgacccgaacccgcgggaaccgacgcccgttacttaaagtaccttaggtaaagtaaaaacgaacgaccggaacccgtgaacggaccgaaggccgaccgtaagagggaanaacgtcctaacttacgtttcgaaccgttacggacgggg

SEQ ID NO: 407290 - DNA, 539 bp, Homo sapiens
  misc_feature: GZ8MTXP02ID7TS.52.66.F11.1.454.CMB.2.raw
  modified_base (295)..(295): a, c, t, g, unknown or other
  modified_base (353)..(353): a, c, t, g, unknown or other
  modified_base (359)..(359): a, c, t, g, unknown or other
  modified_base (363)..(363): a, c, t, g, unknown or other
  modified_base (374)..(374): a, c, t, g, unknown or other
  modified_base (382)..(382): a, c, t, g, unknown or other
  modified_base (387)..(388): a, c, t, g, unknown or other
  modified_base (393)..(393): a, c, t, g, unknown or other
  modified_base (395)..(395): a, c, t, g, unknown or other
  modified_base (404)..(404): a, c, t, g, unknown or other
  modified_base (417)..(417): a, c, t, g, unknown or other
  modified_base (429)..(429): a, c, t, g, unknown or other
  modified_base (484)..(484): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtcttttttcttgtggcttaattttaaaaggtgtccaatgtgacgtgcaactggtggagtcgtgggggagcttgaaacagccgtgggggtccctgagactctctgtagaacctctggcttcacgtttagagtctatgacatgagttgggccncaggcgtaccggggaagggctggagtgggtctacaatgatcagtgatgatgacggtanacaaanaaancgacgactcgngacggcgnccacnncacananacatacganacatactactcanacacacaaacanacacgaaccaccgacgaccacgctatacttactagtaagaaaagaacgacgacgngagacgacgacgacgaagaagaagactactactacgtttacgacgtacggacggg

SEQ ID NO: 407291 - DNA, 597 bp, Homo sapiens
  misc_feature: GZ8MTXP02GCFM4.52.66.F11.1.454.CMB.2.raw
  modified_base (294)..(294): a, c, t, g, unknown or other
  modified_base (372)..(372): a, c, t, g, unknown or other
  modified_base (395)..(395): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggctttttcttgtggctattttaaaaggtgtccaatgtgacgtgcaactggtggagtcgtgggggaggcttgaaacagccgtgggggtccctgagactctcctgtagaacctctggcttcacgtttagagtctatgacatgagttgggtccnccaggcgtccggggaaggggctggagtgggtctcaatgatcagtgatgatggacgtgaccacaaaatcgccgactcgngagggccgtgcaccatctcaganacaatcgaagacactctataccctgaccaaactcaaacgagacctcgaccaccccggcggaaccacccggcccgttataactttaacgtagtaagtaaaaacggaaaggaccggaaacccggtcgtacggggaacgacgggacgacccgaaggaacggaagtaaatccgtaacttaacgtttcgaaccgtacggtacggggg

SEQ ID NO: 407292 - DNA, 753 bp, Homo sapiens
  misc_feature: GZ8MTXP02IASIU.52.66.F11.1.454.CMB.2.raw
  modified_base (302)..(302): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggctatttaaaaggtgtccaatgtgacgtgcaacgtggtggagtcgtgggggagcttgaaacaggccgtggggggtccctggagactctcctgtacgaacctcgtggtcttcacgtttagagtctatgacagtgaggttcggtccnccgaggccggtaccgggggaaggggcgtgggacgggttcgggtctacgaaagtgactacgaggtgagtgagtaggacgtagaacccaaaactaaaacgtccgaccgtacgtccgggacgggacggggccggtacgaccctaaacccgtacgtcccgtaacagggaaacctaaaccgtaaacgttaccgggaaacgaacctaccctttaactaaccgttacccgacgaaccctaaaccgtaaccaaaacgaccgtaaaccgaccggaaacccccgaaccccggggccgggaaacccgtaccccggggtacccttaacttaacgtttaccggttaaggtaaaaccgtaaaaaggacccggacggaaccccggtggaaacggaacgggacggaccgacgaaggtacggaaactactaactaccgttaacgttacgaacgttacgggaaccgggg

SEQ ID NO: 407293 - DNA, 628 bp, Homo sapiens
  misc_feature: GZ8MTXP02ID9DF.52.66.F11.1.454.CMB.2.raw
  modified_base (488)..(488): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttaattttaaaaggtgtccaatgtgacgtgcaactggtggagtcgtggggggaggcttagaaacagccgtgggggtccctgagactctcctgtagacctctggcttcacgtttagagtctatgacatgagttggtccgccaggcgtccggggaagggctggagtgggtctacaatgatcagtgatgagtggagtagccaacaaaagtcgccgactccgtaggacggggccgtgaccaccagtcctaccaagagacaattacgaacggacactactaactacctagaccaactacaaacacgtacacgaacccgaccccggacggaaccnccggacccgttattaacttaacgttaggtaaagtaaaaaggaacggaaccgggaccgacgtacgggaaccgaaggaccgaccgaaggaacggaagtaaactaccgtaacttaaccgtttcgaacctttacggaccggggg

SEQ ID NO: 407294 - DNA, 636 bp, Homo sapiens
  misc_feature: GZ8MTXP02IIF4Z.52.66.F11.1.454.CMB.2.raw
  modified_base (225)..(225): a, c, t, g, unknown or other
  modified_base (433)..(433): a, c, t, g, unknown or other
  modified_base (455)..(455): a, c, t, g, unknown or other
  modified_base (473)..(473): a, c, t, g, unknown or other
  modified_base (482)..(482): a, c, t, g, unknown or other
  modified_base (491)..(491): a, c, t, g, unknown or other
  modified_base (513)..(513): a, c, t, g, unknown or other
  modified_base (521)..(521): a, c, t, g, unknown or other
  modified_base (569)..(569): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttaattttaaaaggtgtaccaatgtgacgtgcaacgtggtggagtcgtgggggaggcttagaaacngccgtgggggtccctgagactctcctgtaacgacctcgtggtcttcgtacgtttagagtctatgacagtggtaggttcgggccgacgaggccggtaccggggaagggcgtagggaggttgggtcactaagtgtaatcgaggttgagtgacgtaggaacgtacgaccaaaacgaaacgtaccgccgacttaccggaggacggggtccgnaccaccagtctacaagactaanaagtacgaagtacacttntaacgtacnaacaaactnaaacagacacgacccgacccgngggaaccnccggtcttacgttattacgagttaaacgaaaagacggacgacgtacgnggaaacggacgacgacaaggtaaggaacaacgttactacgttaacgtttcaaacgttacggacgggg

SEQ ID NO: 407295 - DNA, 610 bp, Homo sapiens
  misc_feature: GZ8MTXP02HOA0E.52.66.F11.1.454.CMB.2.raw
  modified_base (258)..(258): a, c, t, g, unknown or other
  modified_base (299)..(299): a, c, t, g, unknown or other
  modified_base (499)..(499): a, c, t, g, unknown or other
  modified_base (585)..(585): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttaattttaaaaggtgtccaatgtgacgtgcaactggtggagtcgtgggggagcttagaaacagccgtgggggtccctgagactctcctgtacgacctntggcttcacgtttagagtctatgacagtgagttgggtcccncgaggccgtccgggggaagggctgggaggtgggctacgaatgaatcaagtgatggactgggacgtagaccctaaaacaaaaacgtccgacccgtacgttccggaggacggggtccgtgacccaccgatccgaccagaagaactaaagtaccgaaacgacctaacttctaactaccctagaccctaactacaaacagaccncgaccgacccggacgactaccgggcctacgtatacgtagtaaagtaaaagacgacgaccgtgacggacgagacgcaaggtaagaanactactactagtcgacgtacggcgg

SEQ ID NO: 407296 - DNA, 725 bp, Homo sapiens
  misc_feature: GZ8MTXP02JP1XH.52.66.F11.1.454.CMB.2.raw
  modified_base (221)..(221): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttattttaaaaggtgtccaatgtgacgtgcaactggtggagtcgtgggggagcttagaaacngccgtgggggtccctgagactctctgtagacctctggcttcacgtttagagtctatgacatgagttgggtccgcaggcgtccggggaagggctggagtgggtctcaatgatcagtgatgagtggacgtagacccaaacaaaataccgacccgtacgtcccggtagggaacgggggtcccggtaggacccaacccagttacccgtacccgaaaggaacgtaaaccctaaaagtttacggaaaacggaacctaacccttaccttaactaaaccccttcggaaacctaaacctaccaaaaccgtaggaaacctacggaaccccgaacccccgggaccgggtaacccaacccggggtccccgtttacttaaacgtttaccgtaaggttaaacggtaaaaaacgaacggaaacccgggaccgtacgtaacggggaaaccggagggaacgacccgaaagggacgggaaagaactacgtacttaacgttacgtaaccgtacggtacggggg

SEQ ID NO: 407297 - DNA, 665 bp, Homo sapiens
  misc_feature: GZ8MTXP02ITHDI.52.66.F11.1.454.CMB.2.raw
  modified_base (251)..(251): a, c, t, g, unknown or other
  modified_base (634)..(634): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttctgtggcttattttaaaaggtgtccaatgtgacgtgcaacgtggtggagtcgtgggggagcttagaaacagccgtgggggtccctgagactctcctgtanacctctggcttcacgtttagagtctatgacatggagttcgggtccgccgaggccgtaccgggggaaggggcgtgggaggtcgggtctacaagtgatcgagttgatgagtggaagtacgaccgaaacaaaacgtccgacccgtacgtaccggtaggacgggggtccgtacgaccgaaccacgtcacccgaaggaacaaccgtaaagtacgaaacgtaccaacttactaacgtaacctcgaacaaaccacaaacacgaaactcgaaccgcccccgaggtaaccgacccggtaccgttactaattaccgtagtaaaacgtaaaacgaacggtaacggacccgaggtaacgggaaccgaggaccgacgaaggtaagaacgtaaaacnccgtaacttacgtacgaacgtacggtacggg

SEQ ID NO: 407298 - DNA, 616 bp, Homo sapiens
  misc_feature: GZ8MTXP02JVAD6.52.66.F11.1.454.CMB.2.raw
  modified_base (254)..(254): a, c, t, g, unknown or other
  modified_base (472)..(472): a, c, t, g, unknown or other
  modified_base (586)..(586): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggctttttctgtggctattttaaaaggtgtccaatgtgacgtgcaactggtggagtcgtgggggagcttgaaacagccgtgggggtccctgagactctcctgtacgaacctntggcttcacgtttagagtctatgacatgagttcgggtccgccgaggcgtccggggaagggcgtggagtgggtctcaatgatcagtgatgagtggacgtagccaacaaaactacgaccgactccgtagggacggggccgtgaccaccatctccaagacgactaaacgttcgaaacggccaacgttctacgtaaccctgaaccctaaccgacaaaaccgngaactcggaacccacccgggacggtaacccgacgggtacccgtacttaacgttacctaggtaacgtaaaaagccggaacggacctgtacggacggaagacgacgaggaaggaanaactcgacttacgttcgactacggtcgggg

SEQ ID NO: 407299 - DNA, 759 bp, Homo sapiens
  misc_feature: GZ8MTXP02HMIN3.52.66.F11.1.454.CMB.2.raw
  modified_base (220)..(220): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttctgtggcttattttaaaaggtgtccaatgtgacgtgcaactggtggagtcgtgggggagcttagaaacncgccgtgggggtccctgagactctcctgtagacctctggtcttcacgtttagagtctatgacagtgtaggttcgggtcccgcgtagggccggtaccgggggaaggggctgggaggtcgggtctacaagtcgatcgagtgagtgagtggacgtacaccaaacaaatccgcctacgtccggtagggaccggggtccgtagacccaacctacttaccgacaacggaacgtaaactaaacgttaccgaaacggtacctaaccgttctaactacccgtagaaccctaaactacaaacgtacgtaacgtaccggaacccgccccgggaaccggaaccgtaccccggggtaccctttaacgtaaacttttaacccggtaaggttaaaacggtaaaaaacggggaccggttaaaccccgggaaccggtacggtaacggggaaaccgggaaacggaccgaaccggttaaagggaacgggtaaaacgtaaacttaccccggtaaaacttttaacggttacgaaaccggtttaccggggtaaaccggggg

SEQ ID NO: 407300 - DNA, 636 bp, Homo sapiens
  misc_feature: GZ8MTXP02HEJMI.52.66.F11.1.454.CMB.2.raw
  modified_base (335)..(335): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggctttttcttgtggcttattttaaaaggtgtccaatgtgacgtgcaactggtggagtcgtgggggaggcttagaaacagccgtggggggtccctgagactctcctgtacgacctctggcttcacgtttagagtctatgacatgagttggtcccgcgaggcgtccggggaagggctggagtgggtctcaagtnatcagtgatgatggacgtagaccaacaaaatccgaccgacgtccggtaggacggggtccggtagaccaacccgatcctacccaaggtaaacgaactaaacgttaccggaacgggaccctaacgttactaactaccctacgaccaaacctacaaaacacgaacctacgacccgacccggcgggaaaccgaccgccgtactaacttacgtagttaaaggaaaagaacggaaccggacgcgtacggacgacggacgaccgaaggaagtaagaactactacgttacgttagacgtacggacgggg

SEQ ID NO: 407301 - DNA, 712 bp, Homo sapiens
  misc_feature: GZ8MTXP02I0OLO.52.66.F11.1.454.CMB.2.raw
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggctattttaaaaggtgtaccaatgtgacgtgcaactggtggagtcgtgggggaggcttggaaacagccgtgggggtcctgagactctcctgtacgaacctctggtcttacgtacgtttagacgttactatggacagtggtaggttcggtcccgaccgagggccggtaccgggggaagggtcgtagggaggttcgggtctacgaatgactcgagtgagtgagtacggagtagaccaaagaaaactaccgaccgacttccggaaggacgggggtcccgtagaccctaccgtacgttacccaccgaaggaaacgtaacttaaacggttaacggaaacggtaacctacccttataccctaaccgttaggaaccccttaaataacccaaaacgaccgaaccgttaaccggacccgacccccgggtacgggaaacccgacccgggttccgtaacttagttaaacctaggtaaaacgtaaaacgacggtaccggacccgagtaccggaggaacgcgaacgaggtacggaagtaactctacgtacttacgacgtacggacggg

SEQ ID NO: 407302 - DNA, 599 bp, Homo sapiens
  misc_feature: GZ8MTXP02G4APW.52.66.F11.1.454.CMB.2.raw
  modified_base (296)..(296): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggctttttcttgtggctattttaaaaggtgtccaatgtgacgtgcaactggtggagtcgtgggggaggcttgaaacagccgtggggggtccctgagactctcctgtagaacctctggcttcacgtttagagtctatgacatgaggttgggtccncgaggcgtccggggaagggctggaggtgggtctcaatgatcagtgatgagtggacgtagaccaaacaaaatcgccactccgtaggacggggccgtgccaccatctaccagacgactaagtcgaaggacaactctaactacctagaccaactacaaacacgtaccacgaacccgacccggacggaaccgaccgggtcctacgtaacttacgtagtaagtaaaaagacggacggaccgcgtacgggacgaggacgaccgaggtaaggaagtaactcgtaactacgttacaccgtacggtacgggg

SEQ ID NO: 407303 - DNA, 573 bp, Homo sapiens
  misc_feature: GZ8MTXP02ID785.52.66.F11.1.454.CMB.2.raw
  modified_base (214)..(214): a, c, t, g, unknown or other
  modified_base (248)..(248): a, c, t, g, unknown or other
  modified_base (254)..(254): a, c, t, g, unknown or other
  modified_base (260)..(260): a, c, t, g, unknown or other
  modified_base (264)..(264): a, c, t, g, unknown or other
  modified_base (323)..(323): a, c, t, g, unknown or other
  modified_base (378)..(378): a, c, t, g, unknown or other
  modified_base (398)..(398): a, c, t, g, unknown or other
tcagcgcagtacgacacgaccggtgctcgatttagtcacgcgagaaggggagagaggagcccagccctgggatttcaggtgtttcatgtggtgatcaggactgaacagagagaactcaccatggagtctgggctgacgtggtctttttctgtggctattttaaaaggtgtccaatgtgacgtgcaatggtgagtcgtgggggagtcttgaaacnggcctgggggtccctgagactctctgagacctcnggtctnacgttnagtntatgacatgagtggtcgcgagcgtccggaagggcgtggaggtggtgtcgaagtgagtanagtagatgagtggtagtagacacaaataacgaccgactccgttacgagggccggngacgacgacctacacacganacaacgtacgacgacactactactactacgacactacaacacgacacgacgaccgacgaccgaccgacgtacgtacgtacgtagtaacgtaaacgaaacggaacggacggacgacggaacggacggacgacgaagagaacgaactaacgtacgtacgtacgtacgtacggtacgg

SEQ ID NO: 407304 - DNA, 685 bp, Homo sapiens
  misc_feature: GZ8MTXP02JY9QQ.52.66.F11.1.454.CMB.2.raw
  modified_base (224)..(224): a, c, t, g, unknown or other
  modified_base (259)..(259): a, c, t, g, unknown or other
  modified_base (285)..(285): a, c, t, g, unknown or other
  modified_base (345)..(345): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtctttttcttgtggcttaattttaaaaggtgtccaatgtgacgtgcaacgtggtggagtcgtgggggaggcttagaaacnggccgtgggggtccctgagctctctgtacgacctntgtcttctacgttagagtctatgacntggagttgggcccgcgaggcggtccggggaagggctgggagtgggtctcaatgatcagtnagtgagtggacgtagaccaaactaaaacgtccgaccgtactccggtagggacgggggccgtacgacccaactactccgtaccgaagaacgtactaaagttaccggaaacggtacctaaccttctaaaccttacctagaaccctaactaaccaaaacgcgtaacctaccggaccccgacccgggaccggaacccgtaccggtccccgttattaacgttacgtaggttaaaggaaaaaacgacggtaccggtaaccggcggaacggggaaccgaagggaccgaccggaaggtaaggaacgtaactacctaacgtttattaccggaaccgttacggaccgggg

SEQ ID NO: 407305 - DNA, 636 bp, Homo sapiens
  misc_feature: GZ8MTXP02JFKQW.52.66.F11.1.454.CMB.2.raw
  modified_base (273)..(273): a, c, t, g, unknown or other
  modified_base (283)..(283): a, c, t, g, unknown or other
  modified_base (296)..(296): a, c, t, g, unknown or other
  modified_base (328)..(328): a, c, t, g, unknown or other
  modified_base (405)..(405): a, c, t, g, unknown or other
  modified_base (597)..(597): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtcttttttcttgtggctaattttaaaaggtgtccaatgtgacgtgcaactggtggagtcgtgggggagcttgaaacagccgtgggggtccctgagactctcctgtacgacctctggcttcacgtttagngtctatgacntgagttcgggccncgaggcgtccggggaaggctggagtggtctanaatgatcagtgatgatggacgtagacccaacaaaacgtccgaccgacgtccggtagggacggggccgtagaccaccntcctaccgaagaacgactaaagttacggaaagtacctactactacgtaaccctgaacccaaactacaaaccgacgtaccgacgaacccgacccccggacggtaccgaccggtcctacttacgtactaggtaaagaaaacgacggaaccggtaccgagacggggacgaacgggacgaccgaagaacgggtaanactaaccgtacttacgtttacgacggttacggacggggg

SEQ ID NO: 407306 - DNA, 668 bp, Homo sapiens
  misc_feature: GZ8MTXP02FSW6Z.52.66.F11.1.454.CMB.2.raw
  modified_base (301)..(301): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggcttttttcttgtggcttaattttaaaaggtgtccaatgtgacgtgcaactggtggagtcgtgggggaggcttgaaacagccgtggggggtccctgagactctctgtacgaacctcgtggcttcacgtttagagtctatgacatgaggttcgggtccncgaggcgtaccggggaagggcgtggaggtgggtctacaatgatcgagtgatgatggaacgtagaccaaacaaaactcgacccgtacgtccgtaagggacggggccgtagcacccgatcaccgaagacgaactaagtacgaaacggacaactactactacctagacaaacctacaaacgtagaacgtacgaacccgaccccggacgggaacccgtaacccggtccgtaacctttaacgttaacgtagttaaaacgaaaaagggaaaccggaacggaaacccggtgacgggaaaccggaggaaccgaccaaggaaggtaaacgtaaataccgaaaactttacgtttacgaaaccgtacggttacggggg

SEQ ID NO: 407307 - DNA, 681 bp, Homo sapiens
  misc_feature: GZ8MTXP02F54OY.52.66.F11.1.454.CMB.2.raw
  modified_base (309)..(309): a, c, t, g, unknown or other
tcagcgcagtacgacacgaccggtgctcgatttagtcacgcgagaagggggagagaggagcccagccctgggattttcaggtgttttcatgtggtgatcaggactgaacagagagaactcaccatggagtctgggctgacgtggtcttttttcttgtggctaattttaaaaggtgtccaatgtgacgtgcaacgtggtggagtcggtgggggaggcttgaaacaggccgtgggggtccctggagactctcctagtagaacctcgtggcttacacgtttagagttctatgactagtgtaggttgggtccnccgaggccgtaccgggggaaaggggctgggaggtcggggtctacgaaaagtgaactgaaagtgagttagaagtaggggaaacgtagaccaaaaccgaaaaaagttaccgacccgtaaacgtcccggttaaggaacgggggtcccgtaggaccctaacccccattaccgtacccaagaaccgaaaccgtaaattacgaaaacgacacgttacaacgtaccctagaccaaactcaaacacgactacgaccaccccggacggaacacccggtcgtactattaactgaaagtaaaagaaacgaccgtaccgagtggaacgacgggacgaccgagaaggttaaagaactcaaacgttccttagaacctgaacggggg

SEQ ID NO: 407308 - DNA, 512 bp, Homo sapiens
  misc_feature: GZ8MTXP01AZA82.9.81.H04.1.454.CMB.2.raw
  modified_base (222)..(222): a, c, t, g, unknown or other
  modified_base (237)..(237): a, c, t, g, unknown or other
  modified_base (297)..(297): a, c, t, g, unknown or other
  modified_base (501)..(501): a, c, t, g, unknown or other
  modified_base (509)..(509): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtnctttaataactatgtctcctggtaccaacagcaccaggcaaagtcccaaatcatgattangagtcaataagcgcctctgggtcctgatcgcttctctggctccaagtctaggacaacgacggccctccctgaccgtctcgtcgggctccgaggctgacgatgaggctgattatactgcaggctcatatgcaggcaccactaatgtcttcggaagtcgggaccacggttcaaccgtcttaggttcacgcccaagcccaaaccccncttcgtcnctc

SEQ ID NO: 407309 - DNA, 539 bp, Homo sapiens
  misc_feature: GZ8MTXP01DJR2A.9.81.H04.1.454.CMB.2.raw
  modified_base (282)..(282): a, c, t, g, unknown or other
  modified_base (373)..(373): a, c, t, g, unknown or other
  modified_base (499)..(499): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtatttaaaggtgtccagtgtgaagtgcagctggtggagtctgggggaggcttggtgcagcctggcacctccctgagactctcctgtgccgcctctggattcatgttgatgattangccatgcacgtgggtccggcaagttccagggggaagggcctgggagttggggtctcgagggttattacgttgggagtagcctaaactaccncgaggctaagtgcgggactcgtgtgaggggccgattcaccatctccagagacaacgccaagaacctcctaatatctagacaaaatgaaatggtctgagagttggaagacacggtccttgtattacngttgacaaaagataacggaaacccaggttgaacgcgtaag

SEQ ID NO: 407310 - DNA, 551 bp, Homo sapiens
  misc_feature: GZ8MTXP01D2BYW.9.81.H04.1.454.CMB.2.raw
  modified_base (392)..(392): a, c, t, g, unknown or other
  modified_base (395)..(395): a, c, t, g, unknown or other
  modified_base (406)..(406): a, c, t, g, unknown or other
tcagtgatacgtctcacgaccggtgctcgatttagtagtgtagattcgcgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaaataagcggccctctgggggtccctgatcgcttctcctggctccaagtctggcaacacggcctccctgaccgtctctgggctaccgngcngagagtagagntgtattatactgcacgctctatatgcgacgaccaaccaactaatacgtcgttacggtaacggtacggaccgtaccggttaccgtaccgtaccgttacgttcgacgaacccgaaccgaacccaaccccaccttactccgttcgtcc

SEQ ID NO: 407311 - DNA, 536 bp, Homo sapiens
  misc_feature: GZ8MTXP01C09WH.9.81.H04.1.454.CMB.2.raw
  modified_base (236)..(236): a, c, t, g, unknown or other
  modified_base (263)..(263): a, c, t, g, unknown or other
  modified_base (297)..(297): a, c, t, g, unknown or other
  modified_base (428)..(428): a, c, t, g, unknown or other
tcagtgatacgtctcacgaccggtgctcgatttagtagtgtagattcgcgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaanagcacccaggcaaagtccccaaatcatgatttangagtcaataagcggccctgtgggcctgatcgctctcctggctcaagtctggcaacacggcctccctcgaccgtctctcgggctcacggcgtgacgagtgagggctgtattattactgcaggtctctatatncgacgcgacccaaccaactacgtcgttcggtaacggtacgggacggaccggaccgtaccgtccgttacgttcgacgaaccgaccgaaccgaccaccactcgaacgtcc

SEQ ID NO: 407312 - DNA, 497 bp, Homo sapiens
  misc_feature: GZ8MTXP01AXR9B.9.81.H04.1.454.CMB.2.raw
  modified_base (236)..(236): a, c, t, g, unknown or other
  modified_base (371)..(371): a, c, t, g, unknown or other
  modified_base (379)..(379): a, c, t, g, unknown or other
  modified_base (424)..(424): a, c, t, g, unknown or other
  modified_base (487)..(487): a, c, t, g, unknown or other
  modified_base (494)..(494): a, c, t, g, unknown or other
tcagtgatacgtctcacgaccggtgctcgatttagtagtgtagattcgcgggggtctcaggaggcagcgctctcaggacgtcaccaccatggcctgggctctgctcctcctcaccctcctcactcagggcacagggtcctggacccagtctgccctgactcagcctccctccgcgtccgggtctcctggacagtcggtcaccatctcctgcactggaaccagcagtgacattggtncttataactatgtctcctggtaccaacagcacccaggcaaagtccccaaactcatgatttatgaggtcaataagcggccctctggggtccctgatcgcttctcctggctccaagtctaggcaacacggcctcccngaccgtcnctgggctcaggctgacgatgagctgattatactgcaggctcatangcacgcaccatatcgtcgtggaagtcggacctacgcgaccgtcagcacgaaccacgcccaccncttctcnctc

SEQ ID NO: 407313 - DNA, 559 bp, Homo sapiens
  misc_feature: GZ8MTXP01EX6QG.9.81.H04.1.454.CMB.2.raw
  modified_base (309)..(309): a, c, t, g, unknown or other
  modified_base (370)..(370): a, c, t, g, unknown or other
  modified_base (539)..(539): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtcgtgggggaggcttgggtgcagcctggccacctccctgagactctcctgtcgccgcctctggattcatgttgatgattatgccatgcacgtggggtccgnaagttccgaggggaggcctgggagtgggtctcgaggtacttacgtggagtagcaactaccncaggctatgcggactcgtagtgaggggccagttcacatctaccagacgacaacgccaaagaacctccctatatcctagacaaatgaatggtctagagtagttggaacggacgacggtcctttgtaactttacgttggttcgaacgaaaagacgtaacggaaaaccccgngggttacggaacgcgtaagg

SEQ ID NO: 407314 - DNA, 512 bp, Homo sapiens
  misc_feature: GZ8MTXP01DXBYX.9.81.H04.1.454.CMB.2.raw
  modified_base (237)..(237): a, c, t, g, unknown or other
  modified_base (247)..(247): a, c, t, g, unknown or other
  modified_base (300)..(300): a, c, t, g, unknown or other
  modified_base (363)..(363): a, c, t, g, unknown or other
  modified_base (499)..(499): a, c, t, g, unknown or other
  modified_base (506)..(506): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggncttataactntgtctcctggtaccaacagcacccaggacaaacgtccccaaatcatgatttangaggtcaaataagccggccctgtgggtccctgactcgcttctctggctcaagtctaggcaacncggccctcctgaccgtctcgtgggctcaggctgacgatgagctgattatactgcaggctcatatgcaggccacccataatgtcttggaagtcgggacctacggttcaccgtcaggttcacgcccaagcccaacccnttcgtcncttccg

SEQ ID NO: 407315 - DNA, 565 bp, Homo sapiens
  misc_feature: GZ8MTXP01DTROX.9.81.H04.1.454.CMB.2.raw
  modified_base (222)..(222): a, c, t, g, unknown or other
  modified_base (236)..(236): a, c, t, g, unknown or other
  modified_base (241)..(241): a, c, t, g, unknown or other
  modified_base (291)..(291): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcggtcaccatctcctgcactggaaccngcagtgacattggncttanaactatgtctctgtacaacagcaccagcaaagtcccaaatcatgatttangagtcaataagcgcctcgtcgggtcctgactcgcttctcctggctcaagtctcgcaacgacgccctccctgaccgtctcgtcggctccgaggctgacgatgagctgattatactgcaggctacatatcgcacggaccaacccactaaacgtcgtaccgttcgggaaacgtcggggaacctacgggttcctaaccggttccgttagggttccaacggaaccccaaacgggtaaccccaaaacccccgtacgttaccgttaaccttaaccgttccg

SEQ ID NO: 407316 - DNA, 531 bp, Homo sapiens
  misc_feature: GZ8MTXP01AIIRX.9.81.H04.1.454.CMB.2.raw
  modified_base (238)..(238): a, c, t, g, unknown or other
  modified_base (302)..(302): a, c, t, g, unknown or other
  modified_base (320)..(320): a, c, t, g, unknown or other
  modified_base (425)..(425): a, c, t, g, unknown or other
  modified_base (434)..(434): a, c, t, g, unknown or other
  modified_base (439)..(439): a, c, t, g, unknown or other
  modified_base (517)..(517): a, c, t, g, unknown or other
  modified_base (526)..(526): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcggtcaccatctcctgcactggaaccagcagtgacattggtncttataactatgtctcctggtaccaacagcacccaggacaaacgtccccaaactcatgatttangaggtcaataagcgcctntggggtccctgatcgcttctcctggctccaagtctaggccaacaccgggccctccctcgaccgtctcgtgggctccaggctgacgatggaggctgattattacgngcagtctanatagngcacgacaccatagtgtcgtaggaagtcggaccgtacgccgtacgtcgttacggcaccgaacccacgaacccaacccncgttcgtcncgtcg

SEQ ID NO: 407317 - DNA, 552 bp, Homo sapiens
  misc_feature: GZ8MTXP01DPA6O.9.81.H04.1.454.CMB.2.raw
  modified_base (238)..(238): a, c, t, g, unknown or other
  modified_base (299)..(299): a, c, t, g, unknown or other
  modified_base (403)..(403): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttaataactatgtctcctggtaccaacagcaccagaacaaacgtcccaaatcatgattangagtcaatagcgcctgtgggtcctgactcgcttctcctggctcgaagtctaggacaacgaccggccctaccctgacccgtctcgtcgggcctcgaggctgacgntgagtctgattatactgcaggtctcatagtgacgacggccaacccataagttcgtacgttacgggaaggtcgggacctacggttccgaaccgtccttagggttccacggccccaaacggcccaaacccctattcgtaaccaacttcccg

SEQ ID NO: 407318 - DNA, 610 bp, Homo sapiens
  misc_feature: GZ8MTXP01BBG9D.9.81.H04.1.454.CMB.2.raw
  modified_base (238)..(238): a, c, t, g, unknown or other
  modified_base (299)..(299): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctctggtaccaacagcacccaggacaaagtccccaaatcatgatttangaggtcaataagccgcctcgtggggtcctgactcgcttctcctggctccaagtctaggacaacgcgccctccctgacctctcgtggctccgaggctgacgatgaggtctgtattactacgtgccagggcttacattacgcgccacggaccaaacccctataaacgttcgttaccgtttcggggaaacggtcggggttaaccccgtaacggggttacccaacccgggttccgttaacgggttcccaacggtaacccccggaaacggcccccaaaacccccgtcggttacccgtccgttaaccctttccccgg

SEQ ID NO: 407319 - DNA, 706 bp, Homo sapiens
  misc_feature: GZ8MTXP01EDWE2.9.81.H04.1.454.CMB.2.raw
  modified_base (292)..(292): a, c, t, g, unknown or other
  modified_base (315)..(315): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttccttttgggtattttaaaggtgtccagtgtgaagtgcagctggtggagtcgtgggggagcgttggtgcagcctggccacctccctgacgactctcctgtcgccgtcctctggattcattgttgatgtattangccagtgcagtcggggtcccganaacggttccgaagggggaacgggtccgtgggtagttgggtctacgtaggttacttacgtggagtacgcaacctaccaagacggtctagtcggaccgggtactcggtagggtacggacgggggtaccctacgttaccgaaccgtacttacccgtaccgaacggaacggaacccaaaacccgaacccgaaaacggtaaaccccttaccccgttaaattaaccgttaccttacggaacctaaaacgtgtaaaccggttcgggtacgtagggtaaggtacggttagggaacggtaaccgttacggtccgtttagttaacgttacgttacgttagaaaccgaaaaggtacgtaaccgggtaaaccccgaggggttacgtaaccggaacgttaaggg

SEQ ID NO: 407320 - DNA, 525 bp, Homo sapiens
  misc_feature: GZ8MTXP01C6OYV.9.81.H04.1.454.CMB.2.raw
  modified_base (238)..(238): a, c, t, g, unknown or other
  modified_base (301)..(301): a, c, t, g, unknown or other
  modified_base (474)..(474): a, c, t, g, unknown or other
  modified_base (512)..(512): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcacccaggacaaagtccccaaaatcatgatttangaggtcaataagccggccctcgtggggtccctgatcgcttctcctggctcgaagtctaggcaacacggcctccctgacccgtctctgggctccgaggctgacgagtcgaggtctagtattatactgcagctcatatgacagcaacccataatcgtactgggaaagtcggaccncggttcaccgtcttacggcacgcccaacggccaacccnttcgtcaacttcc

SEQ ID NO: 407321 - DNA, 585 bp, Homo sapiens
  misc_feature: GZ8MTXP01ARKQO.9.81.H04.1.454.CMB.2.raw
  modified_base (287)..(287): a, c, t, g, unknown or other
  modified_base (304)..(304): a, c, t, g, unknown or other
  modified_base (367)..(367): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttccttttgggtattttaaaggtgtccagtgtgaagtgcagctggtggagtcgtgggggagcttggtgcagcctggccacctccctgagactctcctgtcgccgcctctggattcatgttgatgattangccatgcagtgggccgnaagttccgaggggacggctgggagtgggtctcgaggttacttacgttggagtagcaactaccngagggctagtcgcggactcgtggtgacgggggccgtattccaccatcctacaacgacgaaccaaccgacaaacgtaaccctacccgtaatactctacgactaaagtgaaagttggtacgtagagtaaggttggaacggtacgaccgggtaccttaggttattaacgttgttagaacgaaaagacgtaacggaaaccccgtgggacggaacgcgtaagg

SEQ ID NO: 407322 - DNA, 597 bp, Homo sapiens
  misc_feature: GZ8MTXP01ENES8.9.81.H04.1.454.CMB.2.raw
  modified_base (238)..(238): a, c, t, g, unknown or other
  modified_base (303)..(303): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcggtcaccatctcctgcactggaaccagcagtgactattggtnactttaataactatgtctcctggtaccaacagcaccaggcaaacgtccccaaactcatgatttangagtacaataagcgcctcgtggggtccctgatcgcttctccgtggctaccgaagtctaggaccaacgaccggtccctcccgtgtacccgttctcgtcgggcctcgaggtctgacgagtgaggtctagtattatactgacaggtctcattagtcgcgacggaccaacccgactaagttcgttaccgttacgggaaacggttcgggaaccgtacgggttccgacccggttccgttacgggttccaccggaaccccgaaacggccccaacccgtacttcgtcccttaacgtttcccg

SEQ ID NO: 407323 - DNA, 519 bp, Homo sapiens
  misc_feature: GZ8MTXP01CTF9W.9.81.H04.1.454.CMB.2.raw
  modified_base (236)..(236): a, c, t, g, unknown or other
  modified_base (297)..(297): a, c, t, g, unknown or other
  modified_base (358)..(358): a, c, t, g, unknown or other
  modified_base (366)..(366): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggncttataactatgtctctgtaccaacagcacccaggcaaacgcccccaaactcatcatttangagtcactaagcggcctctaggggtttctattcgcttctctcggctcaagtctgaacaacncgcctccngacaatctctgggctcaggctgaggacgaggctgattatactgctgctcatatgcagatggtagactactccgtgtacgtcgggcggagggaccagggtcgcccggttacgttgggttccaaggcccaaggcctcgcccccttcggctaaccg

SEQ ID NO: 407324 - DNA, 688 bp, Homo sapiens
  misc_feature: GZ8MTXP01EIMUO.9.81.H04.1.454.CMB.2.raw
  modified_base (243)..(243): a, c, t, g, unknown or other
  modified_base (331)..(331): a, c, t, g, unknown or other
  modified_base (541)..(541): a, c, t, g, unknown or other
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagccctccctccgcgtccgggtctccgtggacagtcggtcaccatctcctgcactggaaccagcagtgactagttggtntactttaataactattcgtctccgtaggtaaccaaacacgccaacccaagaaccaaaacgtacccccaaaactcaattgtaattttanaggtaaggtacaaaagttaacggcccggtccccgttcggtcgggggttcccctaggtacttcgtcctttcctccgtcggtactaccgaaagtcctacgggaacctaaccgcccgggtccccttccccgtacggtacccgttcgtcgttacggggccttacccgaggtcctaggaaccgtagttacggaaggtctaggtaatttattacgngacacgtctatatacgcgacgacgaccctaacctatagttcgtacggtagggtaacggtcgggaccgtacggttaccgtaccgttcgttacggccgaacccgaacccgaaccgaacccctaaccctcttccgtaaccgttccgtccg

SEQ ID NO: 407325 - DNA, 528 bp, Homo sapiens
  misc_feature: GZ8MTXP01AI8G2.9.81.H04.1.454.CMB.2.raw
  modified_base (238)..(238): a, c, t, g, unknown or other
  modified_base (266)..(266): a, c, t, g, unknown or other
  modified_base (362)..(362): a, c, t, g, unknown or other
  modified_base (408)..(408): a, c, t, g, unknown or other
  modified_base (410)..(410): a, c, t, g, unknown or other
  modified_base (412)..(412): a, c, t, g, unknown or other
  modified_base (414)..(414): a, c, t, g, unknown or other
  modified_base (423)..(424): a, c, t, g, unknown or other
  modified_base (428)..(428): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttaataactatgtctcctggtaccaanagcacccaggcaaagtccccaaatcatgattatgaggtcaataagcgcctgtcgggggtcctgatcgcttctcctggctcaagtctagggccaacnccgggccctcctgacccgtctctgggcctccgagggctggactagngngntntattatatnnagcnatatgcgacgaccaccactagtcgtcgtaggtaacggcggacgtacgacgtaccgtcgttacgcgacgaaccgaccgaaccgacccacttctcttcgtcg

SEQ ID NO: 407326 - DNA, 540 bp, Homo sapiens
  misc_feature: GZ8MTXP01BBB9Y.9.81.H04.1.454.CMB.2.raw
  modified_base (223)..(223): a, c, t, g, unknown or other
  modified_base (238)..(238): a, c, t, g, unknown or other
  modified_base (265)..(265): a, c, t, g, unknown or other
  modified_base (296)..(296): a, c, t, g, unknown or other
  modified_base (314)..(314): a, c, t, g, unknown or other
  modified_base (435)..(435): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtncttataactatgtctctggtaccaacngcaccaggcaaagtccccaaatcatgattangagtcaaataagcgcctntcggggtccctgactcgcttctccgtggctccaagtctaggacaacgacggccctcccgtcgaccgtctcgtcgggctccgaggctagacgagtcgagctgattatactgcaggctcatangcgacgaccaccatagtcgtacgtaggaacgtcggaccgtacgccgtaccgtcgttacgcaccgaacccgaacgaaccccaaccctcgttcgtccttaacgtccg

SEQ ID NO: 407327 - DNA, 562 bp, Homo sapiens
  misc_feature: GZ8MTXP01C0YQO.9.81.H04.1.454.CMB.2.raw
  modified_base (174)..(174): a, c, t, g, unknown or other
  modified_base (295)..(295): a, c, t, g, unknown or other
  modified_base (383)..(383): a, c, t, g, unknown or other
  modified_base (466)..(466): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcacatggagttggactgacctggtatttctttggtatttaaaggngtcagtgtgaagtgcagctggtggagtcgtgggggagcttggtgcagcctggcacctcctgagctctcctgtgccgctctggattcattgttgatgtattatgccatgcacgtgggtccgnaaagttccgagggaagggcctggagtgggtctcgtaggtattacgtggagtagctaaactaccaagagggaccttagcgacggtactntggtggaacggggcctaattcaacctagtacctaccaagacgaaaccaacgacctaaagaacctacccgtataattcagaaanaatagagtagtgtagagtagtagaagacgacgtacgttagtagtagttagttagaacgaaagaacgtaacggaaccgacggacggtaacgcgtaag

SEQ ID NO: 407328 - DNA, 794 bp, Homo sapiens
  misc_feature: GZ8MTXP01C0ZWB.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtcgtggggggaggcttgggtgcagccctggccacctccctgacgactctcctgtcgccgcctctggattcatgttgatgattatgccatgctacgtcggggtcccgacaaggttcccgaagggggaacggggccgtggggaggttgggttcctacgtagggtttaactttaccggtttagggacggttaacgccgtaaaacccgttaacccgaacgacgggtccttaaagtcgggaccgggtaccttcgggtgggttacgggacgggggtacccgtaacgtttacccgaacccgtacttacccgttaccccgaaaggaaccgaaacccgaaaacccggtacccaaaaaccggtaaaccccttaaccccgttaaacttaaaccgttaccctaggtaaacctaaaaacgttacggtaaacgttacggggttacgtaaggggtaacggttaagggtttaagggaaacggggtaaacccgttaccggggttaccctttaggtttaaacgtttaccgttaggttaacgttaaccgtaaaaaggtacgtaaccggggaaaaccccgtaggggttacgggtaaccgcgtaaggg

SEQ ID NO: 407329 - DNA, 626 bp, Homo sapiens
  misc_feature: GZ8MTXP01EI0AG.9.81.H04.1.454.CMB.2.raw
  modified_base (238)..(238): a, c, t, g, unknown or other
  modified_base (306)..(306): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtntcttaataactatgtctcctggtaccaacagcacccaggacaaaacgtccccaaaatcatgtatttangagtacaaataagcggccctcgtcggggtccctgactcgcttctcctggctacgaagtcgtaacggccaacgccggccctacccgtcgacccgtctcgtgggcctccgaggctgaccgatcggaggtctagtaattacttacgtgccaggtctctaattatcgcacggacctaaccccataagttcgttaccgttcggggaaacggttcgggaacccgtacgggttccgtaacccggttccgttaagggcccaaaccgggaaccccgtaaacgggaacccccaaaaccccgtccgttacggtaacccttccgtttccccg

SEQ ID NO: 407330 - DNA, 756 bp, Homo sapiens
  misc_feature: GZ8MTXP01EOGVO.9.81.H04.1.454.CMB.2.raw
  modified_base (638)..(638): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttccttttgggtattttaaaggtgtccagtgtgaagtgcagctggtggagtcgtgggggagcgttggtgcagccgtggccaccctcctgacgacctctcctgtcgccgtcctcgtggtattcattgtttagatgtatttatcgcctatcgcgtacgtcggggtacccgacgtaacggttcccggagggggtaaccgggtccgtagggggtacggtttcggggtccttacggtaacgggtttaatttaccggtttaggggacgttaacgccctaaaacccgttaacccaacggtaacgggtacctaagtcgggacccgggtacttcgggttagggtacgggtacgggggtacccttaacgttaccgaacccgtattaccccgtaccgaaaggaaccgaaaccgaaacccgaaccctaaaacgtaaccccttacccgttaaattacttaaccgttacgaaactaaagtgtaaagttacggtntaggtaagtacgttaggaacggtacttacgggttcgtttagttagttaacgttggttacgaaccgtaaaagtacggtaacccgggaaaccccggtggggttacggaaccgcggtaagg

SEQ ID NO: 407331 - DNA, 641 bp, Homo sapiens
  misc_feature: GZ8MTXP01CMJBQ.9.81.H04.1.454.CMB.2.raw
  modified_base (288)..(288): a, c, t, g, unknown or other
  modified_base (308)..(308): a, c, t, g, unknown or other
  modified_base (372)..(372): a, c, t, g, unknown or other
  modified_base (394)..(394): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtcgtgggggaggcttggtgcagcctggcacctccctgagactctcctgtcgccgcctctggattcattgttgatgattangccatgcacgtggggccganaagttccgaggggacgggcctgggagtgggtctcgaggtacttacgtggagtagcaaactaccncgaggctagtcgcggacttcgnggtggacgggggccagttaccacctatcctaccgaagaacgaaccaaaccgaccaaacgtaacccttaccccgtaattacttccgtacgaactaaattggaaagttgggtactaggagtaggttcgggaacgggtaaccgttaccgggtaccctttaggttaaactttcgttacgggttgaaacgtaaaaacggtacgttaacccggggaaaaccccgtagggggttaccggtaaccgccgtaaggg

SEQ ID NO: 407332 - DNA, 578 bp, Homo sapiens
  misc_feature: GZ8MTXP01BDQE8.9.81.H04.1.454.CMB.2.raw
  modified_base (240)..(240): a, c, t, g, unknown or other
  modified_base (308)..(308): a, c, t, g, unknown or other
  modified_base (448)..(448): a, c, t, g, unknown or other
  modified_base (556)..(556): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgactagttggtntctttaataactatgtctcctaggtaccaacagccaccaggacaaacgtccccaaatcatgtatttangaggtacaataagccgcctcgtcgggtccctgactcgcttctctggctacaagtctaggaccaacgaccgccctcccgtgacccgtctcgtcgggctcgaggctgacgatgaggtctagattatctgcagtctctattancgcgacggaccaacccgataacgttcgtacgttcgggaaggttcgggacctacggttccgacccggttacgttacggttccacgaaccccaacggcccctaaaccccncgttacgtccttaaccttcccg

SEQ ID NO: 407333 - DNA, 561 bp, Homo sapiens
  misc_feature: GZ8MTXP01B15XR.9.81.H04.1.454.CMB.2.raw
  modified_base (304)..(304): a, c, t, g, unknown or other
  modified_base (365)..(365): a, c, t, g, unknown or other
  modified_base (374)..(374): a, c, t, g, unknown or other
  modified_base (384)..(384): a, c, t, g, unknown or other
  modified_base (387)..(387): a, c, t, g, unknown or other
  modified_base (399)..(399): a, c, t, g, unknown or other
  modified_base (402)..(402): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctggtggagtcgtgggggagcgttggtgcagcctggccacctccctgagactctcctgtcgccgcctctggattcatgttgatgatatgccatgcacgtgggtccgnaagttccgaggggaggcctggagtggtctcgaggttacttacgtggagtacgcaactaccngaggctagngcgactctgnggngggcatcgaccntcnccagacgacaaccgacaacgaacctccctaatactactcgactaaagtgaaagttggtctaggaggtaggttgaacgggtacttaccgggtccttgttaaacttcgttgttcggacaaaaggcgtaacggaaaccccgtgggacggaacgttcgtaagg

SEQ ID NO: 407334 - DNA, 578 bp, Homo sapiens
  misc_feature: GZ8MTXP01EYWJ7.9.81.H04.1.454.CMB.2.raw
  modified_base (239)..(239): a, c, t, g, unknown or other
  modified_base (305)..(305): a, c, t, g, unknown or other
  modified_base (343)..(343): a, c, t, g, unknown or other
  modified_base (390)..(390): a, c, t, g, unknown or other
  modified_base (448)..(448): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattgggtncttaataactatgtctcctggtaccaacagccacccaggacaaaacgtccccaaatcatgatttangaggtcaataagcggccctgtgggtcctgatcgcttcnctggctccaagtctacgggacaaccgcggcccttcctcgaccgttcncgtcgggctcgaggctgacgatcggaggtctagatttattactgctaggcttacaatntcgcaggaccaacccgataagtggttaccttggggaaacgttcgggaacccacgggttccgaacccggttcgttacgggttccacgccccgaaaggaacccaaccccgtattctccgttaacctttcccg

SEQ ID NO: 407335 - DNA, 509 bp, Homo sapiens
  misc_feature: GZ8MTXP01BZDQJ.9.81.H04.1.454.CMB.2.raw
  modified_base (298)..(298): a, c, t, g, unknown or other
  modified_base (438)..(438): a, c, t, g, unknown or other
  modified_base (459)..(459): a, c, t, g, unknown or other
  modified_base (496)..(496): a, c, t, g, unknown or other
  modified_base (503)..(503): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcggtcaccatctcctgcactggaaccagcagtgacattggtgcttataactatgtctcctggtaccaacagcaccaggcaaagtccccaaactcatgatttangaggtcaataagcggccctgtggggtccctgatcgcttctcctggctccaagtctgggcaacgcggccctccctgaccgtctcgtgggctcgaggctgacgatggagctgattatactgcaggctcatatgcagcacccntaatgtctggaagtcggaccncggttcaccgtcttggttcacgcccaggcccaacccnttcgtcncttccg

SEQ ID NO: 407336 - DNA, 517 bp, Homo sapiens
  misc_feature: GZ8MTXP01C39RN.9.81.H04.1.454.CMB.2.raw
  modified_base (223)..(223): a, c, t, g, unknown or other
  modified_base (239)..(239): a, c, t, g, unknown or other
  modified_base (428)..(428): a, c, t, g, unknown or other
  modified_base (504)..(504): a, c, t, g, unknown or other
  modified_base (512)..(512): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaaccngcagtgacattgggtncttataactatgtctctggtaccaacagcacccaggcaaacgtccccaaaactcatgatttatgagtcaaataagcgccctcgtggggtccctgatcgcttctcctggctcaagtctggcaacacggcctccctgacccgtctcgtgggctccgaggctgacgatgaggctagattatactgcaggctnatactgcagcacccaatatgtcgtaggaagtcggactcgcgtaccgtcgttacggcacgaacccaacgcccaaccncttcgtcncgtcg

SEQ ID NO: 407337 - DNA, 663 bp, Homo sapiens
  misc_feature: GZ8MTXP01C7V0O.9.81.H04.1.454.CMB.2.raw
  modified_base (408)..(408): a, c, t, g, unknown or other
  modified_base (417)..(417): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttccttttgggtattttaaaggtgtccagtgtgaagtgcagctggtggagtcgtgggggagcttggtgcagcctggccaccctccctgacgacctctcctgtcgcccgcctctggtattcattgtttgatgtattatcgcctatcgcacgtcgggggtcccggactaacggttcccggaagggggaacgggtccgtggggtaggttcgggtctgtagggttacttacggtaggagtacgccaaactaccngaggctagngcggtactcgtgggtgacggggtcctacgttcacctacgtctaccgagaacgaaccaacgtacccaaacgtaaccccttacccgtaattactactacgtaacaaagttagtaaagttacggtacgtaggtaagtaggttacggaacggtaacggttaccgggtacctttagtaacgtttacgttagttagaaacgtaaaaggtacgtaaccgggaaaaccccgagggttacgggaacgcgtaaggg

SEQ ID NO: 407338 - DNA, 503 bp, Homo sapiens
  misc_feature: GZ8MTXP01D8BC0.9.81.H04.1.454.CMB.2.raw
  modified_base (236)..(236): a, c, t, g, unknown or other
  modified_base (296)..(296): a, c, t, g, unknown or other
  modified_base (417)..(417): a, c, t, g, unknown or other
  modified_base (428)..(428): a, c, t, g, unknown or other
  modified_base (490)..(490): a, c, t, g, unknown or other
  modified_base (497)..(497): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcggtcaccatctcctgcactggaaccagcagtgacattggtncttataactatgtctcctggtaccaacagcaccaggcaaagtccccaaatcatgatttangagtcaatagcggcctcgtgggtcctgatcgcttctcctggctccgagtctgcaacgcgcctccctgacctctcgtgggctccaggctgacgatgagctgattatactgcagtctcattangcagcaacccntaatgtcgttcggaagtcgggaacctcggttcaccgtcttaggcacgcccaagcccaacccnttgtccncttccg

SEQ ID NO: 407339 - DNA, 585 bp, Homo sapiens
  misc_feature: GZ8MTXP01BRY6N.9.81.H04.1.454.CMB.2.raw
  modified_base (405)..(405): a, c, t, g, unknown or other
  modified_base (563)..(563): a, c, t, g, unknown or other
  modified_base (579)..(579): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtcgtgggggaggcttgggtgcagcctggcacctccctgagactctcctgtcgccgcctctggattcatgttgatgattatgccatgcacgtggggtccgctaagttccgagggggaacgggcctgggaggtgggtctcgagggttacttacgttgggagtagcaaaccttaccaacgaggctatcggcggtactcgngtggacggggccgattcgaccatacctcagagacaacgaccaagaacctcctatatctagacaaatgaagtggtcgtgaaggtagttggaaggtaccttacggggtcctttagtacttattggttcgttaacgaaaaggtactaacgggaaaccccgngggttacggtaaccgngtaagg

SEQ ID NO: 407340 - DNA, 553 bp, Homo sapiens
  misc_feature: GZ8MTXP01D6KTD.9.81.H04.1.454.CMB.2.raw
  modified_base (242)..(242): a, c, t, g, unknown or other
  modified_base (255)..(255): a, c, t, g, unknown or other
  modified_base (313)..(313): a, c, t, g, unknown or other
  modified_base (444)..(444): a, c, t, g, unknown or other
  modified_base (458)..(458): a, c, t, g, unknown or other
  modified_base (462)..(462): a, c, t, g, unknown or other
  modified_base (538)..(538): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcggtcaccatctcctgcactggaaccagcagtgaactatttggtntctttaataactntcgtctctggtaaccaacagccaacccaggaccaaaacgtccccaaatcatgatttangagtcaaataagccgccctcgtcggggtccctgactcgtcttctcgtggctcgaagtctaaggaccaacgccggccctccctagcccgtctcgtcgggcctcgaggctagacgagtgaggtctagtaattntactgcaggtctanatangcagccaaccatatcgtcgtggaagtcggaccgtacggttccacgtcgttaggccacgcccaagccccaacccgtnttctccaacttcccg

SEQ ID NO: 407341 - DNA, 544 bp, Homo sapiens
  misc_feature: GZ8MTXP01BR3DU.9.81.H04.1.454.CMB.2.raw
  modified_base (285)..(285): a, c, t, g, unknown or other
  modified_base (306)..(306): a, c, t, g, unknown or other
  modified_base (373)..(373): a, c, t, g, unknown or other
  modified_base (525)..(525): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctggtggagtctgggggagcttggtgcagcctggccacctccctgagactctcctgtcgccgcctctggattcatgtttgatgattangccatgcacgtggggtcccgnaagttccagggggaaggcctgggagtgggtctcgagggttacttacgttggagtagccaacgtaccncaggcctatggcggtactctgtgaggggccgagttcaccagtctccagagacaacgaccaagacctcctatatctagacaaagtgaatggtctgagtagttgaagtacgacggtccttgtattcttgttgacaaagataacggaaaccccgnggttacggaacgcgtaagg

SEQ ID NO: 407342 - DNA, 569 bp, Homo sapiens
  misc_feature: GZ8MTXP01BFFQU.9.81.H04.1.454.CMB.2.raw
  modified_base (223)..(223): a, c, t, g, unknown or other
  modified_base (238)..(238): a, c, t, g, unknown or other
  modified_base (300)..(300): a, c, t, g, unknown or other
  modified_base (450)..(450): a, c, t, g, unknown or other
  modified_base (549)..(549): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtncttataactatgtctcctggtaccaacagcacccaggacaaagtccccaaatcatgatttangagtcaataagccggccctcgtggggtccctgactcgcttctctcggctccaagtcctagggaccaacgaccggtccctcccgtcgacccgttctcgtcgggcctcgaggctgacgagtgaggctagattactactgcaggtctcattangacgacggccaacccataaacgtcgtcttacgggaaaggtcgggacctacgggttaccacccgtcgttacggttcacgaaccccaacggccccaacccncgttacgtccgaaccttccg

SEQ ID NO: 407343 - DNA, 561 bp, Homo sapiens
  misc_feature: GZ8MTXP01BT8RE.9.81.H04.1.454.CMB.2.raw
  modified_base (237)..(237): a, c, t, g, unknown or other
  modified_base (298)..(298): a, c, t, g, unknown or other
  modified_base (444)..(444): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcggtcaccatctcctgcactggaaccagcagtgacattggtncttaataactatgtctcctggtaccaacagcaccaggcaaacgtcccaaatcatgatttangagtcaataagcggcctcgtgggtccctgactcgcttctctggctccaagtctaggaccaacgaccggtccctccctgacccgtctcgtcgggcctccgaggctgacgagtggaggtctgtaattattactgacaggctacattancgcacgacaacccataagtcgtcgttacggaaggtcggacctacggttccgaaccgtcgttacggttccaccgaacccaacggaaccccaaccctcgttacgtccgttaacttcccg

SEQ ID NO: 407344 - DNA, 663 bp, Homo sapiens
  misc_feature: GZ8MTXP01CU8I6.9.81.H04.1.454.CMB.2.raw
  modified_base (294)..(294): a, c, t, g, unknown or other
  modified_base (433)..(433): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttgggtattttaaaggtgtccagtgtgaagtgcagctggtggagtcgtgggggagcttggtgcagcctggccacctccctgacgacctctcctgtcgcccgccttcgtggattcattgtttgatgatttancgccatgctacgtggggtcccgataaaggtccgaagggggtaacgggtccgtaggggtaggtcgggttctcgtaggttacttacggttggagtacgcctaaaccgtaccaacgtagggtctaagtcggaccggacttgnggtgggacggggtacctattccaaccgtatccgtacccgaaggaacaaccgaaccgaaccgaaacgtaacccttaccgtaattactccgtaagacctaaaagtgaaagttcgggtataggaagtagtgggaacggtaccgttcgggtcctttaggttaaccttaggttacgttacgaaacgtaaaaggacgtaacccggaaaccccgtagggttacgaaccgttgtaagg

SEQ ID NO: 407345 - DNA, 613 bp, Homo sapiens
  misc_feature: GZ8MTXP01AXR47.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctggtggagtcgtgggggaggcttgggtgcagcctggccacctccctgagactctcctgtcgccgcctctggattcattgttgatgattatgccatgcacgtggggtccgctaacgttccgagggggaacgggccgtgggagtgggtctcgtaggtacttacgttggagtagcaaactaccaagagggctagtcggcgtactcgtgtggacggggccgtattccaccatcctaccgagacgaacaacgaccaaacgtaacctaccctaatacttcagaacaaagtgaaagttcggtactggagtaggttggaacggtaccgacgggttccctttaggttaactttacgttcggttagaaaccgtaaaaaggtcgttaaccgggaaaaccccgtgggttacggaaccgttcgtaagg

SEQ ID NO: 407346 - DNA, 611 bp, Homo sapiens
  misc_feature: GZ8MTXP01DKM4N.9.81.H04.1.454.CMB.2.raw
  modified_base (226)..(226): a, c, t, g, unknown or other
  modified_base (242)..(242): a, c, t, g, unknown or other
tcagtgatacgtctcacgaccggtgctcgatttagtagtgtagattcgcggggggggtctcaggaggcagcgctctcaggacgtcaccaccatggcctgggctctgctcctcctcacccctcctcactcagggcacagggtcctgggtccagtctgccctgactcagccctccctccgcgtccgggtctcctggacagtcggtcaccatctcctgcactggaaccngcagtgactattggtncttaataactatgtctcctggtaaccaacagccacccaggacaaacgtaccccaaactcatgatttatgagtacaataagccggtcctcgtcggggtccctgactcgtcttctcctggctaccgaagtcgtacggaccaacgaccggtcccttcccgtgacccgttctcgtcgggcctccgaggctagacgatgagctagtattatactgacaggtctactatatcgaccgagaccaacccataaagttcggtacgttacgggaaacggtcgggaaccctacgggttcctaacccggttcgttaacgggttcaaccggccccgaaacggaaccccaaaccccgtcttaccgttaaccaaccctttcccg

SEQ ID NO: 407347 - DNA, 528 bp, Homo sapiens
  misc_feature: GZ8MTXP01A9WUF.9.81.H04.1.454.CMB.2.raw
  modified_base (222)..(222): a, c, t, g, unknown or other
  modified_base (238)..(238): a, c, t, g, unknown or other
  modified_base (244)..(244): a, c, t, g, unknown or other
  modified_base (249)..(249): a, c, t, g, unknown or other
  modified_base (439)..(439): a, c, t, g, unknown or other
  modified_base (517)..(517): a, c, t, g, unknown or other
  modified_base (524)..(524): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattgggtnctttanaactntgtctcctggtaccaacagcacccaggcaaagtccccaaaactcatgatttatgaggtcaataagcggccctcgtggggtccctgatcgcttctcctggctccaagtctaggcaacgaccggccctccctcgaccgtctcgtgggcctcgaggctgacgatggaggctgtattatactgcaggctcatangcagccaacccactaatcgtacttcggaagttcgggacctacggcaccgtcttaggttcacgcccaaggcccaacccnttcgtcnctcc

SEQ ID NO: 407348 - DNA, 636 bp, Homo sapiens
  misc_feature: GZ8MTXP01CJMVU.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttggtatttaaaaggtgtccagtgtgaagtgcagctggtggagtcgtgggggagcttggtgcagcctggccacctcctgagctctcctgtcgccgcctctggtattcattgtttgattgattatcgccatgccgtacgtcgggggtcccgacgtaaacggttccggaagggggaacgggtccgtgggacgttgggtctacgtaggttactttacggttggagtacgcctaaactaacccgaagaggtcctagtcggccggacttcgtggtacggacggggccgtacttccaacctacgtacctaccgaagacgaacaaaccgtaaccaaacgtaacccttaccgtaattactacctagaactaaagtagaaagtggtctaggaagtaggttggaagtacgacggtccttagttaaattcgttagttgaacgaaaagtgtaaccggaaacccgtagggttacgaacgcgtaagg

SEQ ID NO: 407349 - DNA, 523 bp, Homo sapiens
  misc_feature: GZ8MTXP01B576A.9.81.H04.1.454.CMB.2.raw
  modified_base (266)..(266): a, c, t, g, unknown or other
  modified_base (299)..(299): a, c, t, g, unknown or other
  modified_base (422)..(422): a, c, t, g, unknown or other
  modified_base (506)..(506): a, c, t, g, unknown or other
  modified_base (517)..(517): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtacccaanagcacccaggcaaagtccccaaatcatgattangagtcaatagcgcctgtcggggtcctgatcgcttctctggctccaagtctggcaacgacggcctccctgaccgtctcgcgggctccgaggctgacgatggaggctgattattactgcaggctnatagtgcaggcaccataatcgtcgttggaagtcgggaccacggttcgacccgtccttagggttccacgcccaacggcccacccncttcgtaaccncgttcc

SEQ ID NO: 407350 - DNA, 569 bp, Homo sapiens
  misc_feature: GZ8MTXP01CV52S.9.81.H04.1.454.CMB.2.raw
  modified_base (224)..(224): a, c, t, g, unknown or other
  modified_base (240)..(240): a, c, t, g, unknown or other
  modified_base (306)..(306): a, c, t, g, unknown or other
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacagttggtncttaataactatgtctccgtggtaccaacagcaacccaggacaaagtcaaccaaactcatgattangagtacaatagccgcctcgtcgggtcctgactcgtcttcctcgtggctacaagtctcggcaacaccggccctcccgtgaccgtctcgtcggctcgaggctgacgagtgagtctgtattatactgcagctacatagtcgacgaggaccaacctaagtaatcgttacgtaacgggtaaacgttcggggtaaccacgggttaccaccggttaccgttcggaaccaaccgacccgaacggacccaacccttactcgcccttaacccg

SEQ ID NO: 407351 - DNA, 616 bp, Homo sapiens
  misc_feature: GZ8MTXP01BHGY3.9.81.H04.1.454.CMB.2.raw
  modified_base (294)..(294): a, c, t, g, unknown or other
tcagtgatacgtctcacgaccggtgctcgatttagtagtgtagattcgcggggagctctgggagaggagcccccagccctgagattcccaggtgtttccattcagtgatcagcactgaacacagaggactcaccatggagttgggactgacctggtattttccttttgggtattttaaaggtgtccagtgtgaagtgcagctggtggagtcgtgggggagcttgggtgcagcctggccaccctccctgacgactctcctgtcgccgcctcgtggattcattgtttgatgattangccatgctacgtggggtccgactaacggtccgagggggacgggccgtgggaggtgggtctcgtagggttacttacgttggagtacgcaactaccaagaggtctagtcgcggtactcgtggtggacggggccgtattccaccattaccgaccaagacgaaccaaacccgtacaaacgtaaccctccgtaattactcctagaactaaagtgaagttggtctaggagtacggttggaacggaccgttacggtccttagtaatttacgagttacgaacgtaaaaggtcgtaacccggaaacccgtggggttacggaacgcgtaagg

SEQ ID NO: 407352 - DNA, 667 bp, Homo sapiens
  misc_feature: GZ8MTXP01BQLGU.9.81.H04.1.454.CMB.2.raw
  modified_base (276)..(276): a, c, t, g, unknown or other
  modified_base (304)..(304): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtcgtgggggagcttggtgcagcctggccacctccctgagactctcctgtgccgctctggattcatgttnatgattatgccatgcacgtgggtccganaagttccgagggggacggcctgggagtgggtctcgtaggtacttacgttgggatagcctaaacgtacccaagagggctaagtcggacgggtactcgtgggtcggacgggggcctattccgacctatccgtaccgaagacgaaccgaaaccgacctaaacgtaaccccttacccgtaattaaccttaccgtaggtaacctaaagttcgaaagttgggttccgttagggaacggtacggtttagggaacgggtaccgaacggggttccctttagttaacgtttaaccgttggttacggaaacccgtaaaaggtacggttaaccgggaaaaccccgtgggggttacggaaccgttaacgtaacggg

SEQ ID NO: 407353 - DNA, 649 bp, Homo sapiens
  misc_feature: GZ8MTXP01B35DP.9.81.H04.1.454.CMB.2.raw
  modified_base (319)..(319): a, c, t, g, unknown or other
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgactatttgggtgtacttaataactatcgtcctccgtaggtaaccaacacgccaacccaggacaaaacgtccccaaatcatagatttagngacggtacaaagtaacgccggtaccctcgtcggggtccctgactcgtcttctccgtggctcgaagtctacggacaacgcggtccctccgtcgaccgtctcgtgggtcctccgaggctggaaccgtagtacgggaggtccttaggtaactttacgtttaccgtcgacctacggtactacgtaactacgacgaccgaccgacccaaaccgtacgtaacgttcgtaccggttacgggaacggtcggacccgtacggttccgtaaccggtcgttacgccaccgtaacccgacgtaaccccaacccgtcttaccgtaacccgttaacccgtcccg

SEQ ID NO: 407354 - DNA, 606 bp, Homo sapiens
  misc_feature: GZ8MTXP01AFTSH.9.81.H04.1.454.CMB.2.raw
  modified_base (425)..(425): a, c, t, g, unknown or other
  modified_base (446)..(446): a, c, t, g, unknown or other
  modified_base (584)..(584): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttgggtattttaaaggtgtccagtgtgaagtgcagctggtggagtcgtgggggagcttgggtgcagcctggccacctcctgacgtactctccgtgtcgcccgtcctgtaggtacttcagttggtttagatcgtaattagtcgacctatcgcctacgtcgggggtacccgactaacggttcccgagggggaacgggtccgtaggggacgttcggggtactcgtaggttacttaccggtggacgtacgctaaaccgtaccaagngtctagtcgcggtactgtggnggacgggtctatcactatccacagacaaccacgactaagaccctcgtatcgtcagactaaagtgaattggatggaagtggtacggaacgacgcggtcttgtaagttcttggacaacgaaagtcgaaaccgggaaccgngggttacgaaccgttgtaaggg

SEQ ID NO: 407355 - DNA, 608 bp, Homo sapiens
  misc_feature: GZ8MTXP01AZXAW.9.81.H04.1.454.CMB.2.raw
  modified_base (290)..(290): a, c, t, g, unknown or other
  modified_base (386)..(386): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctggtggagtcgtgggggagcttggtgcagcctggccacctccctgagctctcctgtcgccgcctcgtggattcattgtttgatgtaatttcncgctatcgcgtacggtcgggtccgacgtacggtcggagggacggtcgtggtaggtcggtctagtagttacttagtaggagtacgacctaaacaccngagtctagtcgcgtctgtggtcggacggtcctactacactactaccgacgaacgacgaaccaaccgaacctaaactacccttacgtaatactacgacaacgtaagtagtaagtagtgtaggtaggtaggtaggtaacggtacggttacgtacgttacgttacgttagttacgttacgaacgaaagtaacgtaaccggaaccggacggacggtaacgcgtaag

SEQ ID NO: 407356 - DNA, 550 bp, Homo sapiens
  misc_feature: GZ8MTXP01EKRVX.9.81.H04.1.454.CMB.2.raw
  modified_base (240)..(240): a, c, t, g, unknown or other
  modified_base (302)..(302): a, c, t, g, unknown or other
  modified_base (424)..(424): a, c, t, g, unknown or other
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcggtcaccatctcctgcactggaaccagcagtgactattgggtntcttaataactatgtctcctggtaccaacagcaccaggcaaacgtcccaaatcatgatttangagtacaataagcggcctcgtggggtccctgactcgcttctctggctcaagtctaggcaacgacgccctcctcgaccgtctcgtgggcctcgaggtctgacgagtgaggtctgtattatacngcaggctcatactgacgacggccaacccataagtcgtcgttcggaaacggtcggaccgtacggttccgaccgtccgttaggttcacgcccgaacggcccaaacccgcttcgtccgttaacttcccg

SEQ ID NO: 407357 - DNA, 597 bp, Homo sapiens
  misc_feature: GZ8MTXP01CHC9J.9.81.H04.1.454.CMB.2.raw
  modified_base (223)..(223): a, c, t, g, unknown or other
  modified_base (238)..(238): a, c, t, g, unknown or other
  modified_base (304)..(304): a, c, t, g, unknown or other
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcggtcaccatctcctgcactggaaccngcagtgacattggtncttataactatgtctcctggtaccaacagccacccaggacaaacgtccccaaactcatgtatttangaggtacaaataagccggccctcgtcggggtccctgactcgcttctccgtggctacgtaagtcctagggaccaacgaccggtccctcccgtagacccgtctcgtcgggcctaccgaggctgacgatggaggtctagaatttacttactgacgaggtctacattacgcgacgacggaccaacccaataacgtcgttcgttacggaagggtcggacctaccgggttctaaccgtccgttaggttccacgaaccccgaaacggccccaaacccgtcttcgtaaccttaacttcccg

SEQ ID NO: 407358 - DNA, 646 bp, Homo sapiens
  misc_feature: GZ8MTXP01DOI1X.9.81.H04.1.454.CMB.2.raw
  modified_base (239)..(239): a, c, t, g, unknown or other
  modified_base (307)..(307): a, c, t, g, unknown or other
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcggtcaccatctcctgcactggaaccagcagtgactattgggnactttaataactatcgtctcctggtaaccaacagccacccaggacaaacgtccccaaatcatgattangagtcaatagcgcctcgtgggtcctgactcgcttctcctggctacgaagtctaggaccaacgccggtccctcccgtcgacccgttcgtcgtcgggcctccgaggcctagaccgtagtaggaggtctagtattaactacgtgacaggtccttagtaactagtcgacgacggaccaaccctaataagttcgtaccgttaacgggaaacggttcgggaacccgtacgggttaccaaccccggttccgttaaaccggggttccaaacccgggaaccccgaaaacccgggtaacccccaaaacccccggtacgttcgtaaccccgttaaccgtttaacccccgg

SEQ ID NO: 407359 - DNA, 647 bp, Homo sapiens
  misc_feature: GZ8MTXP01DM35O.9.81.H04.1.454.CMB.2.raw
  modified_base (488)..(488): a, c, t, g, unknown or other
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcggtcaccatctcctgcactggaaccagcagtgactattggtgtacttaataactattcgtctccgtaggtaccaacacgccaccaggacaaacgtaccccaaactcatagtaatttagtagaagtacaaaagtaacgccggtacccttcgtcggggtcctgtactcgtcttctcctcggctacgaagtcgtacggacaacgaccggccctcccgtcgtaccctcgtcgtcggcctcgaggtctaggacgtagtggaacggtctagtaactttagttactgactaggcttanaacttagcgaacgacgacccaacccaaatgttacgttccgttaagggaacggtcggaaccgtaccgttcccgtaacccgtacgttacgggaccacccgggaaccccgaaaacccggccccctaaaaccccgtcggttcctaaccttaaccgtttccccg

SEQ ID NO: 407360 - DNA, 707 bp, Homo sapiens
  misc_feature: GZ8MTXP01DWGDU.9.81.H04.1.454.CMB.2.raw
  modified_base (305)..(305): a, c, t, g, unknown or other
tcagtgatacgtctcacgaccggtgctcgatttagtagtgtagattcgcggggagctctggggagaggagccccagccctgagattcccaggtgtttccattcagtgatcagcactgaacacagaggactcaccatggagttgggactgacctggtattttcctttgggtatttaaaggtgtccagtgtgaagtgcagcgtggtggagtcgtgggggagcgttggtgcagcctggccacctcctgacgtactctctgtcgccgctctggattcatgttgatgattatgcatgcacgtgggccganaagttccgaggggaacgggtcgtgggagttcgggtctcgtaggttacttacgtagggacgtacgctaaaccgtaccaacgagggtcttagtcggaccggtacttcgggtagggtcgggtaacgggggtccctacgttaccgacctaacttacccgtacccgaaaggaaccgaaaccgaaacccgaacccgtaaaacggtaaccccttaacccgttaaacttaacgttaccttaacggaactaaaagtagtaaacgttacgggtacgttagggaaggtaaggttacggggaaacggtaacgttaccgggttccttttaaggttaaacgtttacgttaggttacgaaaccgtaaaaggaccgtaaccgggaaaccccggtagggttacgggaacgttcgtaagg

SEQ ID NO: 407361 - DNA, 563 bp, Homo sapiens
  misc_feature: GZ8MTXP01BLNMP.9.81.H04.1.454.CMB.2.raw
  modified_base (365)..(365): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctggtggagtcgtgggggagcttggtgcagcctggcacctccctgagactctcctgtcgccgcctctggattcatgttgatgattatgccatgcacgtgggtccgcaagttccgagggacgggcctgggagtgggtctcgaggtattacgttggagtagcaactaccngaggctagtgcggtactcgtgtggacggggccattcgaccatcctaccgagacgaacaacgaccaaagtacctacccgtaatacgtctagacaaatgaatggtctgagtagttggaagtacgcgggtccttgtacttacttggttcgaacgtaaaagtacgtaacggaaaaccccgagggttacggaacgcgtaaggg

SEQ ID NO: 407362 - DNA, 617 bp, Homo sapiens
  misc_feature: GZ8MTXP01A110G.9.81.H04.1.454.CMB.2.raw
  modified_base (280)..(280): a, c, t, g, unknown or other
  modified_base (378)..(378): a, c, t, g, unknown or other
tcagtgatacgtctcacgaccggtgctcgatttagtagtgtagattcgcggggagctctgggagaggagccccagccctgagattcccatgtgtttccattcagtgatcagcactgaacacagaggactcaccatggagttgggactgacctggtattttcctttggtattttaaaggtgtccagtgtgaagtgcagctggtggagtcgtgggggagcgttggtgcagcctggccacctccctgacgactctcctgtcgcccgctctggatcattgtttnatgtattatgccatgcacgtgggtccgagtaacggtccgaggggaacggccgtaggagtggtctgtacggtattacgtggagtagactaactaaccanaggctagtcggcggactcgtggtggacggggacctattccgactacttccaccaaggacaaccgaacgtaccaaacgtaacccttaccctaattactaccgtaagaactaaagtagaaagttcgtagtaggtagtaaggttaagacggttacgtaccgggttcttaagttacttacgttgttaacgaaactaaaacggtaacgtaacgggaaaccccgttagggtaacggaacgtaacg

SEQ ID NO: 407363 - DNA, 802 bp, Homo sapiens
  misc_feature: GZ8MTXP01CZL5Y.9.81.H04.1.454.CMB.2.raw
  modified_base (313)..(313): a, c, t, g, unknown or other
  modified_base (774)..(774): a, c, t, g, unknown or other
tcagtgatacgtctcacgaccggtgctcgatttagtagtgtagattcgcggggagctctggggagaggagccccagccctgagattcccaggtgtttccattcagtgatcagcactgaacacagaggactcaccatggagttgggactgacctggtattttcctttgggtatttaaaggtgtccagtgtgaagtgcagcgtggtggagtcggtggggggaggcgttgggtcgcgacggtccgtcggaccctacccgtccgtaggaacgtcctccttccgttcggtccgcccgtccctacgtaggtaacctttntagttgttagtattagtacttacgcgtactagtcgtacgtacgggttccggggtaccccggtaacggtaacgggtaccggggaacgggggtaaccgggtcggtaggggtacgggttcggtaccgtaggttaacggtttaccgttacggtagggtacgtaccgtacccgaaaacccgtaaccgaacggtacggtacgtacgggtccgggtacggtacgttcgggtaggggtacggggtaccgggtacctaactaccgaactacgtaccgaacgaacgaaccgaaccgaaccgtaactaaaccgtacccttacgtaactacgtacgaagtaaactaagttaggtacgtacgtgtaaggtaggttacgggtaacggaaacgggtaccgttccggttacgtttagttaacgttcgttaaggaacgttaaaaacgtaaacggtaccggaacccggtaaacccgggngggttaaccggtaacgttaaggtaacgg

SEQ ID NO: 407364 - DNA, 629 bp, Homo sapiens
  misc_feature: GZ8MTXP01BFPV7.9.81.H04.1.454.CMB.2.raw
  modified_base (239)..(239): a, c, t, g, unknown or other
  modified_base (269)..(269): a, c, t, g, unknown or other
  modified_base (307)..(307): a, c, t, g, unknown or other
  modified_base (397)..(397): a, c, t, g, unknown or other
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttaataactatcgtctcctaggtaccaanacgcacccaggacaaacgtccccaaatcatgtatttangaggtacaaagtaacgccggtccctgtcgggggtccctgactcgtcttctccgtcggctccgaagtctacggaccaacgccggcctcccngaccgtctcgtcgggctccgaggctagacgagtggaggtctagtacttatacctgacaggctacaattcgacgccgacggaccctaacccgaataagttcggtaccgttacgggaaaggttcggggaacccgtaccggttaccgtaacccggttaccgttacgggttccaacccggaacccgaaccgggaacccccaaacccctagttccgtaacccttaaccgtttccccg

SEQ ID NO: 407365 - DNA, 693 bp, Homo sapiens
  misc_feature: GZ8MTXP01B4U2G.9.81.H04.1.454.CMB.2.raw
  modified_base (686)..(686): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttggtattttaaaaggtgtccagtgtgaagtgcagctggtggagtcgtgggggagcttggtgcagcctggccacctccctgacgacctctcctgtcgccgtcctcgtggtattcagttgttagattgattatcgcctatcgctacggtcggggtcccgacgtaaacggttccggaagggggaacgggtccgtaggggtacggttcgggtctacggtacggttaactttacggtaggaacgttaacgccgtaaaacctaacccgaacgagggtaccttaaggtccggcggtaccttcgttcgggtacggggacggggtacctagttacccaaccgtaacgttcccaacccgaagaacggaaccaaaccgttaccaaacgtacccttaccctaattacgtacctacgaactaaagtgaaacgttggtcgttaggagtacggttaggaacggccttacggttccttagtaacttcttaggttcgaaacgtaaacgcggtaaccggaaaacccgtggacggaaccgngtaacgg

SEQ ID NO: 407366 - DNA, 607 bp, Homo sapiens
  misc_feature: GZ8MTXP01BDB4X.9.81.H04.1.454.CMB.2.raw
  modified_base (224)..(224): a, c, t, g, unknown or other
  modified_base (240)..(240): a, c, t, g, unknown or other
  modified_base (250)..(250): a, c, t, g, unknown or other
  modified_base (269)..(269): a, c, t, g, unknown or other
  modified_base (302)..(302): a, c, t, g, unknown or other
  modified_base (590)..(590): a, c, t, g, unknown or other
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccnggcagtgacattggtncttataactntcgtctcctggtaccaacngcaccaggcaaacgtcccaaatcatgatttagngagtcaatagccgcctcgcgggtccctgactcgtcttctccgtggtctaccgaagtctagggacctaacgaccggtccctcccgtgtaccccgttctcggtcgggcctaccgacggtctggaccgtagtacgggagtcgttagtaacttacgttactgacaggggtccttagattacgtgaccgacggacccaaaccctagtaacgttcgttaccggttacgggaagtcgggaaccctacgggttcctaaccggtcttaacgggttcacgaacccgaagcccaaccgnttcgtcttaacgtcccg

SEQ ID NO: 407367 - DNA, 664 bp, Homo sapiens
  misc_feature: GZ8MTXP01BE2M1.9.81.H04.1.454.CMB.2.raw
  modified_base (289)..(289): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtatttaaaaggtgtccagtgtgaagtgcagctggtggagtcgtgggggagcttggtgcagcctggccacctccctgacgactctcctgtcgccgtcctctggattcattgttgatgtattangccatgctacgtgggtcccgacgtaagttccggagggggaacgggtcctggggtagttgggtctcgaggttacttacggtgggagtacgacctaaacgtaccaacgagggtcttagtcggtaccggtacttcggtagggtcgggacggggccgtagttaccaccgtacttacccgtaccgaagtaacggaacaaaccggaccaaaacgtaaccctaccccggttaaatacgttacctaggtaacctaaagtagtaaagttcggtacgtagggtaggtaggttcggaacgggtacgttaccgggtccttaggttaacttcgttagttgaacgaaagtacggtaacggaaacccgtggggttacgaacggctaaggg

SEQ ID NO: 407368 - DNA, 568 bp, Homo sapiens
  misc_feature: GZ8MTXP01EVF95.9.81.H04.1.454.CMB.2.raw
  modified_base (239)..(239): a, c, t, g, unknown or other
  modified_base (422)..(422): a, c, t, g, unknown or other
  modified_base (455)..(455): a, c, t, g, unknown or other
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttaataactatgtctcctggtaccaacagcaccaggacaaacgtacccaaactcatgtatttatagaggtcaaataagcggccctcgtcggggtccctgatcgcttctcgtggctacgaagtctacggacaaccgaccggccctacccgtcgtaccgtctcgtcgggcctcgaggctggacngtgacggctgtattactactgcaggtctcattngcgacgccaacccatacgtgtcgttagggaaggtacggaccctacggttccaccgttcgttaagccgaacgaacccgacgaaccccaccctattcgtaacttccgttaacccg

SEQ ID NO: 407369 - DNA, 763 bp, Homo sapiens
  misc_feature: GZ8MTXP01A3OI6.9.81.H04.1.454.CMB.2.raw
  modified_base (695)..(695): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttccttttggtattttaaaaggtgtccagtgtgaagtgcagctggtggagtcgtgggggagcttggtgcagccgtggccacctccctgacgtactctcctgtcgccgtcctcgtgtattcattgttgattgattactcgccagtcgacgtacggtcggggttccccggataacggttccgaagggggtaacgggccgtaggggacggttgggtcctacggtaaggttactttacggttagggaagttacgccaaaaccgttaacccgaagtacgggtcctaaagtccgggtcggtaaccttcgtagggtacggggaacgggggtccctaacttacccaaccctaaacgttccccgtaaccgaaacggaaaccgaaacccgaaaccggaaccccttaaaaacgacccctttaaccccgttaattaacccggttacttaacggaaaccttaaagtcggtaaaagttcggggttctaagggagggttaaggttcgggaaacgtcggttaaaccgggttccctttagttaaccgtttacgnggttaacgaaaccgtaaaagtccgtaaacccgggtaaaacccgggtcgggttacgtaacgcggtaagg

SEQ ID NO: 407370 - DNA, 712 bp, Homo sapiens
  misc_feature: GZ8MTXP01COBF9.9.81.H04.1.454.CMB.2.raw
  modified_base (289)..(289): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttccttttgggtattttaaaggtgtccagtgtgaagtgcagctggtggagtcgtgggggagcttggtgcagcctggccacctccctgacgactctcctgtcgccgcctctggattcattgttgatgattangcctagtcgcacgttcgggggtcccgactaaggttccggagggggtaacgggtcccgtaggggtagttcggggttactcgtaggttactttacggtgggaagtacgcctaaacttacccaagtacggtacctagtcggcggtacttcgtgggtacgggacgggggccgtactttaccgaccctagttaccctaccgaacgacgaaaccccgaaaccgacccaaacgtaaccccttaccccgttaagttaccttacctaacggtactaaaacgttcggtaaagttcgggtacgtaggaaggttacgggttagaacgggtaccgaccggggttaccttacggtttaacgttacgttacggttacgaaccgtaaaaggtacgtaaccgggtaaaaccccgtggggttacgaaccggcgttaacggg

SEQ ID NO: 407371 - DNA, 759 bp, Homo sapiens
  misc_feature: GZ8MTXP01CS0XK.9.81.H04.1.454.CMB.2.raw
tcagtgatacgtctcacgaccggtgctcgatttagtagtgtagattcgcgggggagctctgggagaggagccccagccctgagattcccaggtgtttccattcagtgatcagcactgaacacagaggactcaccatggagttgggactgacctggtattttcctttgggtatttaaaggtgtccagtgtgaagtgcagcgtgggtggagttcggtggggggaggtcgtttgggtgcgaggccctcgggacccacccttcccgtaggacgtacctcctccgtggtcgcccgtcctgtggattcagttgttgatgtattatcgacctatcgctacggtcggggtaccgagtaacggttccggaggggaacgggtccgtggggtagttgggtcctaggtaaggtttacttacggttagggtacgtaacgtaccctaaaacccgttaccgaaggtacgggtactaaacggtcgggaccgggtaccttggggtagggtacgggggtacgggggtaccttaacgttcccaaccgtaccgttaccgtaccgaaaggaacccgaaaccgaaaccgggtaacctaaaacggtaccccttacccttaaagttaacctccgtaacgtaaaccgtaaagtggttaacgttagggtacttagggaagtaggttacgggaacgtacgttacgttcttaggttaaacctgttacgttacggaacgtaaaaggtcgtaaccgggaaacccggtgggttacaaccggttcgtaagg

SEQ ID NO: 407372 - DNA, 500 bp, Homo sapiens
  misc_feature: GZ8MTXP02JDI8J.9.81.H04.1.454.CMB.2.raw
  modified_base (431)..(431): a, c, t, g, unknown or other
tcagtgatacgtctcacgaccggtgctcgatttagtagtgtagattcgcgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctcgtggggtccctgatcgcttctctgctcagtctggcacacgcctcctgaccgtctctgggctccaggctgacgatgaggctgattattactgcagctcatatgcaggcacccanaatgtcttcggaagtcggaccacggtcaccgtctacggtcagcccgaaggccaacccatcgtcactccg

SEQ ID NO: 407373 - DNA, 495 bp, Homo sapiens
  misc_feature: GZ8MTXP02FV9U3.9.81.H04.1.454.CMB.2.raw
  modified_base (298)..(298): a, c, t, g, unknown or other
  modified_base (317)..(317): a, c, t, g, unknown or other
  modified_base (337)..(337): a, c, t, g, unknown or other
  modified_base (484)..(484): a, c, t, g, unknown or other
tcagtgatacgtctcacgaccggtgctcgatttagtagtgtagattcgcgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccagacaaagtccccaaactcatgatttangagtcaataagcggccctntggggtccctgatcgcttcncctgctccaagtctggcacacggcctcctgaccgtctctgggctccaggctgacgatgaggctgattatactgcagctcatatgcaggcaccacaatgtcttcggaagtggacacggtcacgtctaggtcagcccaaggccaacccnctacgtcactc

SEQ ID NO: 407374 - DNA, 513 bp, Homo sapiens
  misc_feature: GZ8MTXP02IZGCY.9.81.H04.1.454.CMB.2.raw
  modified_base (236)..(236): a, c, t, g, unknown or other
  modified_base (421)..(421): a, c, t, g, unknown or other
  modified_base (424)..(424): a, c, t, g, unknown or other
tcagtgatacgtctcacgaccggtgctcgatttagtagtgtagattcgcgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcacccagacaaagtccccaaactcatgatttatgaggtcaataagcggccctctggggtccctgatcgcttctcctgctccaagtctggcacacgcctccctgaccgtctctgggcctccgaggctgacgatgaggctgattatactgctagctanatngcagacaccacatcgtcgttaggacgtcggacctacgtacaccgtcgtacgtccacgaacccgaacgacccaacccactcgtaccactc

SEQ ID NO: 407375 - DNA, 509 bp, Homo sapiens
  misc_feature: GZ8MTXP02F5KWI.9.81.H04.1.454.CMB.2.raw
  modified_base (237)..(237): a, c, t, g, unknown or other
  modified_base (417)..(417): a, c, t, g, unknown or other
  modified_base (435)..(435): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcacccaggcaaagtccccaaactcatgatttatgaggtcaataagcggccctctggggtccctgatcgcttctcctgctcaagtctggcacacggcctcctgaccgtctctgggctccaggctgacgatgaggctgattatactgcagctnatatgacaggccacccanaatgtcttcggaacgtgggaccacggtcaccgtcacggtcagcccaacggcccaaccccactcgtacacttccg

SEQ ID NO: 407376 - DNA, 525 bp, Homo sapiens
  misc_feature: GZ8MTXP02IANL9.9.81.H04.1.454.CMB.2.raw
  modified_base (237)..(237): a, c, t, g, unknown or other
  modified_base (341)..(341): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtnctttataactatgtctcctggtaccaacagcacccaggcaaagtccccaaactcatgatttatgaggtcaataagcggccctcgtggggtccctgatcgcttcnctgctcaagtctggcacacggcctccctgacccgtctctgggcctccgaggctgacgagtgaggctgattattactgcagctcatatgacaggcacccaacaatgtcttacggaacgtcgggaccacggtccaccgtcgtacgtcacgaacccaacggacccaacccgactcgtactactcccg

SEQ ID NO: 407377 - DNA, 546 bp, Homo sapiens
  misc_feature: GZ8MTXP02GZGQV.9.81.H04.1.454.CMB.2.raw
  modified_base (237)..(237): a, c, t, g, unknown or other
  modified_base (433)..(433): a, c, t, g, unknown or other
  modified_base (438)..(438): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctctggtaccaacagcaccaggacaaacgtaccccaaactcatgatttatgagtcaataagcgcctcgtcggggtccctgactcgcttctctgctcaagtctggcacaccggcctccctgacccgtctcgtcgggcctccgacggctgacgagtggacggctgtacttattactgcagcctanatagngcgacgaccaccaatatcgtacgtacggaacggtcggaccgtacggtaccaccgtaccgtacgtccaccgaacccgaacgaccccaacccgactacgtacctacctcc

SEQ ID NO: 407378 - DNA, 509 bp, Homo sapiens
  misc_feature: GZ8MTXP02HUV7B.9.81.H04.1.454.CMB.2.raw
  modified_base (237)..(237): a, c, t, g, unknown or other
  modified_base (358)..(358): a, c, t, g, unknown or other
  modified_base (438)..(438): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcaccaggcaaagtccccaaactcatgatttatgagtcaataagcggccctgtcggggtccctgactcgcttctcctgctcaagtctggcacncggcctccctgacctctcgtggctccaggctgacgatgaggtctagtattattactgcagtctcatatgcagccaaccanaatgtcttacggaagtcggaccacgtcaccgtcacggtcacgaaccgaagcccaacccgatcgacactccg

SEQ ID NO: 407379 - DNA, 586 bp, Homo sapiens
  misc_feature: GZ8MTXP02JUPV5.9.81.H04.1.454.CMB.2.raw
  modified_base (236)..(236): a, c, t, g, unknown or other
  modified_base (246)..(246): a, c, t, g, unknown or other
  modified_base (370)..(370): a, c, t, g, unknown or other
  modified_base (378)..(378): a, c, t, g, unknown or other
  modified_base (397)..(397): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggncttataactntgtctcctggtaccaacagcaccaggacaaacgtccccaaactcatgatttatgaggtacaataagccggcctcgtcggggtccctgatcgcttctcctggcctcagtctggcacgcgcctccngaccgtcncgtgggctcgagctgacgntgagctgtattagttactggcagtctacatagtgacgacggaccacccctaataacgttcggtacgttacgggtaaacgggtcggggaacccgtacggttacccgaacccggttacccgtaacgggttccaaccggaaccccgaaacggacccccaaaacccctccgtacggtaccctaccctttcccg

SEQ ID NO: 407380 - DNA, 505 bp, Homo sapiens
  misc_feature: GZ8MTXP02GW5BC.9.81.H04.1.454.CMB.2.raw
  modified_base (265)..(265): a, c, t, g, unknown or other
  modified_base (298)..(298): a, c, t, g, unknown or other
  modified_base (423)..(423): a, c, t, g, unknown or other
  modified_base (427)..(427): a, c, t, g, unknown or other
  modified_base (438)..(438): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacngcacccaggcaaagtccccaaatcatgatttangagtcaatagcggcctctggggtccctgatcgcttctcctgctccaagtctggcacacggcctcccgtgacccgtctcgtcgggctccgaggctgacgatgaggtctgtattattactgcagctnatangcaggcaccanatgtcttacggaagtgggaccacgtccacgtctacggcacgccaaaggcccaaactcactcgactcc

SEQ ID NO: 407381 - DNA, 497 bp, Homo sapiens
  misc_feature: GZ8MTXP02HAGUM.9.81.H04.1.454.CMB.2.raw
  modified_base (237)..(237): a, c, t, g, unknown or other
  modified_base (264)..(264): a, c, t, g, unknown or other
  modified_base (336)..(336): a, c, t, g, unknown or other
  modified_base (353)..(353): a, c, t, g, unknown or other
  modified_base (415)..(415): a, c, t, g, unknown or other
  modified_base (431)..(431): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctctggtaccaacngcacccaggcaaagtccccaaatcatgatttatgaggtcaataagcgccctcgtggggtcctgatcgcttcnctgctcagtctggcacncggcctccctgaccgtctctcgggctccgaggctgacgatgaggctgattatactgcagctnatatgcacgcacccanatgtcttggacgtcgggaccacggtcaccgtctacggtcacgccaacgccacccatcgtcactccg

SEQ ID NO: 407382 - DNA, 554 bp, Homo sapiens
  misc_feature: GZ8MTXP02JVLNN.9.81.H04.1.454.CMB.2.raw
  modified_base (304)..(304): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctgggtggagtctgggggaggcttggtgcagcctggcacctccctgagactctcctgtcgccgcctctggattcatgttgatgattatgccatgcacgtgggtccgnaagttccgagggagggcctgggagtggggtctcgaggttcttacgttggagtagcactacacgaggctatgcgactcgtggtggagggggcctagttccacctatcctccgagacgaaccaacgccaaagacctccctatactctagacaaatgaatgggtctggagtagttggacggtacacgggtccttgtactttacgtgtacgaacaaaagtacgtacggaaaaccccgaggtacggaccgatacg

SEQ ID NO: 407383 - DNA, 489 bp, Homo sapiens
  misc_feature: GZ8MTXP02I2J4L.9.81.H04.1.454.CMB.2.raw
  modified_base (236)..(236): a, c, t, g, unknown or other
  modified_base (241)..(241): a, c, t, g, unknown or other
  modified_base (383)..(383): a, c, t, g, unknown or other
  modified_base (420)..(420): a, c, t, g, unknown or other
  modified_base (478)..(478): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcggtcaccatctcctgcactggaaccagcagtgacattggtncttanaactatgtctcctggtaccaacagcaccaggcaaagtccccaaatcatgattatgagtcaatagcgcctcgtgggtcctgatcgcttctctgctcaagtctggcacgcgcctcctgccgtctcgtgggcctcaggctgacgntgagctgattatctgcagctcatatgcaggccaccanatgtcttaggaacgtcggaccacggtcaccgtctacggtcagcccaacggccaacccnctcgcactccg

SEQ ID NO: 407384 - DNA, 549 bp, Homo sapiens
  misc_feature: GZ8MTXP02JYM8N.9.81.H04.1.454.CMB.2.raw
  modified_base (236)..(236): a, c, t, g, unknown or other
  modified_base (324)..(324): a, c, t, g, unknown or other
  modified_base (452)..(452): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggncttataactatgtctcctggtaccaacagcacccaggacaaacgtccccaaatcatgtattatgagtcaatacgcgcctgtgggtccngatcgcttctctggctcgaagtctcggcaccgacggtccctccgtgacccgtcgtcgtcgggcctccgaggcgtagacgagtgagctagtattatactgcagctacatatgctaggtttcgttccttnttacaagtactagttcgggacggacgggtaccgaggcgtacggacccgttccgtaggaacgtcgacggacccgaacggtccgtccgcccccgtacgg

SEQ ID NO: 407385 - DNA, 506 bp, Homo sapiens
  misc_feature: GZ8MTXP02ILS3K.9.81.H04.1.454.CMB.2.raw
  modified_base (236)..(236): a, c, t, g, unknown or other
  modified_base (241)..(241): a, c, t, g, unknown or other
  modified_base (425)..(425): a, c, t, g, unknown or other
tcagtgatacgtctcacgaccggtgctcgatttagtagtgtagattcgcgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttanaactatgtctcctggtaccaacagcaccaggcaaacgtccccaaactcatgatttatgaggtcaaataagcggccctcgtggggtccctgatcgcttctcctgctcaagtctggcacgacggcctccgtgacccgtctcgtgggctcaggctgacgatgaggctgattatactgcagctcatangcagcaccacatgtcttcggaatcgggaccacggtcaaccgtctacggtcacgccaacggcccaacccactcgtacactcc

SEQ ID NO: 407386 - DNA, 525 bp, Homo sapiens
  misc_feature: GZ8MTXP02IMW3Y.9.81.H04.1.454.CMB.2.raw
  modified_base (223)..(223): a, c, t, g, unknown or other
  modified_base (238)..(238): a, c, t, g, unknown or other
  modified_base (265)..(265): a, c, t, g, unknown or other
  modified_base (377)..(377): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtncttataactatgtctcctggtaccaanagcaccagacaaacgtccccaaatcatgattatgagtcaatagcgcctcgtcgggtccctgactcgcttctccgtcgctcaagtctcggcacgcgtccctcctcgacccgtntcgtcgggcctcgagctgacgtagtggaggtctagtattatactgcagctcatatgcagcaaccatatgtacgtacggaagtcggacctacggtacaccgtcgtacgtcacgaacccgaacggcccaaccgtctcgtacctacttccg

SEQ ID NO: 407387 - DNA, 535 bp, Homo sapiens
  misc_feature: GZ8MTXP02FOIC8.9.81.H04.1.454.CMB.2.raw
  modified_base (237)..(237): a, c, t, g, unknown or other
  modified_base (247)..(247): a, c, t, g, unknown or other
  modified_base (297)..(297): a, c, t, g, unknown or other
  modified_base (337)..(337): a, c, t, g, unknown or other
  modified_base (425)..(425): a, c, t, g, unknown or other
  modified_base (445)..(445): a, c, t, g, unknown or other
  modified_base (520)..(520): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggncttataactntgtctctggtaccaacagcaccaggcaaacgtccccaaatcatgatttangagtcaataagccggcctgtcggggtccctgatcgcttcncctgctcagtctggacacgcgcctcctgaccgtctcgtgggcctcgacggctagacgatggacggtctagtattatacgtgcagcctntatatgcaggaccacccaanaactgtcgttacggaacggtcgggacctacgggtccacccgtacgtacggtcacgaacccgaacggcccaacccnctacgtcactttccg

SEQ ID NO: 407388 - DNA, 577 bp, Homo sapiens
  misc_feature: GZ8MTXP02GPV10.9.81.H04.1.454.CMB.2.raw
  modified_base (287)..(287): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagtggactgacctggtattttcctttggtattttaaaggtgtccagtgtgaagtgcagctggtggagtcgtgggggaggcttggtgcagcctggcacctccctgagacctctcctgtcgcccgcctcgtggattcattgttgatgattangccatgctacgtggggtccgactaagttccgaaggggacgggcctggggagtggggtctcgtaggtacttacgtggagtagcacgtaccagaggctagtcgcggtactcgtgtggacggggccgtattccgaccatcctcccgaagaacgaaccaaacgacctaaaacgaaaccctccctaatactctacgaacaaaagttgaaattggtactgagtagtagacgacgacggtcttagtacttctagtagaacgaaaagacgtaacggaaaacccaggtacgacgtacag

SEQ ID NO: 407389 - DNA, 558 bp, Homo sapiens
  misc_feature: GZ8MTXP02IQL0Y.9.81.H04.1.454.CMB.2.raw
  modified_base (238)..(238): a, c, t, g, unknown or other
  modified_base (264)..(264): a, c, t, g, unknown or other
  modified_base (543)..(543): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctctgtaccaacngcaccaggacaaacgtccccaaatcatgtatttatgagtacaaataacgcgcccttcgtcgggtcctgatcgtcttctctgctcagtcgtgcacgcgcctcctgacccgtctcgtcgggcctcgaggtctagacgtagtgacggtctagtaatttatacgtgactagtctacattagtcgacacggaccaacccaataacttcgttacgtacggtaacggtacgggaccgtacggtaccaccgttccgaggtccacgaacccgaacggcccaaaccctntacgtacacttcccg

SEQ ID NO: 407390 - DNA, 616 bp, Homo sapiens
  misc_feature: GZ8MTXP02HDF8N.9.81.H04.1.454.CMB.2.raw
  modified_base (500)..(500): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgactagttggtgacttataactatcgtctcctggtaccaacagcaccaggacaaacgtccccaaatcatgtatttatgaggtacaaatagccgcctcgtcggggtccctgactcgcttctccgtggcctacgaagtcgtcggacaccgaccgggtccctcccgtcgacccgttctccgttcgggccttccgacggtctaggacgtacgtggacggcttagtaatttactaactgacctagtcttacattacgtcgacgacgaccaaccctanaagttcggtacgtttacgggaaacggttcgggaacccgtacggtaccgacccgttacgtacggtccaaccgaacccgaaccggacccaaccccgtagtcgtacctaccgtttcccg

SEQ ID NO: 407391 - DNA, 562 bp, Homo sapiens
  misc_feature: GZ8MTXP02HGR7G.9.81.H04.1.454.CMB.2.raw
  modified_base (311)..(311): a, c, t, g, unknown or other
  modified_base (374)..(374): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtcgtgggggaggcttggtgcagcctggcacctccctgacgactctcctgtcgccgcctctggattcattgtttgatgattatgccatgcacgtggggtccggnaaggttccgaggggacgggcctgggagtgggtctcgaggtacttacgtggagtagcactaccngaggctagtgcgtactcgtgtggacggggcctagttccactatcgtaccagacgaacaacgaccaaacgacctacctatatctagacaaagtgaatggtctagagtagtcggaacggacgacggtcttaggtacttacgtgtagaacgaaaagtacgtaaccggaaacccgaggtacggaacgtcgag

SEQ ID NO: 407392 - DNA, 588 bp, Homo sapiens
  misc_feature: GZ8MTXP02F47RT.9.81.H04.1.454.CMB.2.raw
  modified_base (238)..(238): a, c, t, g, unknown or other
  modified_base (248)..(248): a, c, t, g, unknown or other
  modified_base (263)..(263): a, c, t, g, unknown or other
  modified_base (298)..(298): a, c, t, g, unknown or other
  modified_base (304)..(304): a, c, t, g, unknown or other
  modified_base (340)..(340): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactntgtctctgtaccaangcaccagacaaacgtccccaaactcatgtatttangagtanaataagcggccctcgtcggggtcctgactcgcttcnccgtgctacaagtctaggcacgccgcctccgtcgaccgtctcgtcgggctacgaggctgacgagtgaggtctagtattatactgacagtctcatacgtgacgacggaccaacccaagtaacttcggtacgttacgggaacggttcggggaaacctaccgggtacctaacccggtaccgttaacggtacccgaacggaaccccgaaaccggaccccaaaccccgtcttacggtccctaccgtttccccg

SEQ ID NO: 407393 - DNA, 565 bp, Homo sapiens
  misc_feature: GZ8MTXP02GGTDN.9.81.H04.1.454.CMB.2.raw
  modified_base (369)..(369): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctggtggagtcgtgggggaggcttggtgcagcctggcacctccctgagactctcctgtgcccgcctctggattcatgtttgatgattatgccatgcacgtggggtccgacaagttccgaggggaacgggcctgggagtgggtctcgaggtattacgtggagtacgcactacncgaggctagtcgcggactcgtgtgaggggcctagttcacatctaccagacgaacaacgaccaaagacctacctatactctagacaaagtgaatggtactagagtagttggacggacgacggtacttagtacttacgtagtacgtaaacgaaaagtacgtaaccggaaaacccgtagggtacggaaccgacgtaagg

SEQ ID NO: 407394 - DNA, 553 bp, Homo sapiens
  misc_feature: GZ8MTXP02GWG48.9.81.H04.1.454.CMB.2.raw
  modified_base (371)..(371): a, c, t, g, unknown or other
  modified_base (418)..(418): a, c, t, g, unknown or other
  modified_base (458)..(458): a, c, t, g, unknown or other
  modified_base (463)..(463): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctggtggagtcgtgggggagcttggtgcagcctggccacctccctgagactctcctgtcgcccgcctctggattcatgttgatgattatgccatgcacgtggtccgacaagttccgagggaagggcctgggagtggggtctcgtaggtattacgttggagtagcctaactaccngaggctagtcgacggactcgtggtagaggggcccaattcaccattcnccaagagaaccaacgacaaagtaacctcctaatatcgaanacaanagagtagtgtagagtagtagacgacgacgtacgtacgtacttacgtacgtagaagaaagaacgtaacgaaccgaacggacgacgacgacg

SEQ ID NO: 407395 - DNA, 573 bp, Homo sapiens
  misc_feature: GZ8MTXP02IV313.9.81.H04.1.454.CMB.2.raw
  modified_base (237)..(237): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggngcttataactatgtctcctgtaccaacagcaccaggacaaacgtccccaaatcatgatttatgagtacaataagcggcctgtcgggtccctgactcgcttctctgctcaagtctggacacgaccggccctccgtgacccgtctcgtcgggcctccgaggctggacgtagtggacggtctagtaacttagttactgacagtctacatagtcgacacggaccaacccgaactaagtcgttacgtacgggaacggtcgggacctacggtccaaccggtccgtacgggtccacggaaccccgaaacggaccccaaacccgtactacgtaccactttcccg

SEQ ID NO: 407396 - DNA, 562 bp, Homo sapiens
  misc_feature: GZ8MTXP02GFX4I.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaggtgtccagtgtgaagtgcagctggtggagtcgtgggggaggcttggtgcagcctggcacctccctgagactctcctgtgcccgcctctggattcattgttgatgattatgccatgcacgtgggtccgcaagttccgaggggacgggcctgggagtgggtctcgaggttacttacgtggagtagcactaccacaggctatgcggactcgtgtgaggggcccgtagttaccacctatcctaccgagaacgaccaaaccgaccaaacgaacctccctaatactcctagacaaatgaatggtctagagtagttaggacggacgacgggtcttagtagttactcgtagaacaaaagacgtaacggaaaccccgaggtacggacgactag

SEQ ID NO: 407397 - DNA, 685 bp, Homo sapiens
  misc_feature: GZ8MTXP02IQYZ5.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtatttaaaggtgtccagtgtgaagtgcagctggtggagtcgtgggggaggcttggtgcagcctggcacctccctgacgactctcctgtcgcccgcctctggattcattgtttgattgattatcgccatcgctacgtcgggtcccggactaagttccgaggggaacgggcctgggaggtggggtcctacgtagggttactttacgttgggagtacgcaacgttaccacgaggtctaagtcgccgggtacttcgtaggtggacgggggcctacgttaccacctacgttcctacccgaaggaacgaaaccgaaccgaccgaaaacggtaaaccccttaccctaattacttaccgttacgaacctaaaagtcggtaaagttcgggtacgttaggaaggtaggttggaaacgggtaccgtaacgggttccgtttaggttaacgtttaccgttagttacggtaaacgtaaaaaggtacgttaaaccgggaaaaccccggtagggtaccgggaacgtaccgtagg

SEQ ID NO: 407398 - DNA, 521 bp, Homo sapiens
  misc_feature: GZ8MTXP02HUXKV.9.81.H04.1.454.CMB.2.raw
  modified_base (237)..(237): a, c, t, g, unknown or other
  modified_base (247)..(247): a, c, t, g, unknown or other
  modified_base (318)..(318): a, c, t, g, unknown or other
  modified_base (426)..(426): a, c, t, g, unknown or other
  modified_base (507)..(507): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactntgtctcctggtaccaacagcacccaggcaaagtccccaaactcatgatttatgagtcaataagcggccctntggggtccctgatcgcttctcctggctcagtctggcacgacgcctcctcgacctctctcgggcctccaggctgacgatgaggctgattattactgcagccttcattangcaggcctacccacaatgtcgttacggaagtcgggaccacggtctaaccgtctacggtcacgcccaacggcccctaacccncgtacgtcacttcc

SEQ ID NO: 407399 - DNA, 531 bp, Homo sapiens
  misc_feature: GZ8MTXP02G0BWF.9.81.H04.1.454.CMB.2.raw
  modified_base (350)..(350): a, c, t, g, unknown or other
  modified_base (369)..(369): a, c, t, g, unknown or other
  modified_base (436)..(436): a, c, t, g, unknown or other
  modified_base (440)..(440): a, c, t, g, unknown or other
  modified_base (518)..(518): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgactattggtgcttaataactatgtctcctggtaccaacagccacccaggacaaacgtccccaaactcaatgatttatgaggtcaaataagcggaccctcgtcggggtccctgatcgcttcncctgctcaagtctggcacncgcctcctcgaccgtctctgggcctccgaggctgacgatcgaggtctagtattagtactgcagctanatangacgacgacaccatatcgtacgtacggacggtcggaccacgtccaccgtacgacgacacgaaccgaacgacccaaccncgtctactactcg

SEQ ID NO: 407400 - DNA, 541 bp, Homo sapiens
  misc_feature: GZ8MTXP02I5810.9.81.H04.1.454.CMB.2.raw
  modified_base (467)..(467): a, c, t, g, unknown or other
  modified_base (507)..(507): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtcgtgggggagcttggtgcagcctggcacctcctgagactctcctgtgccgcctctggattcatgttgatgattatgccatgcacgtgggtccgactaagttccgaggggaacgggcctgggaggtgggtctcgtaggtacttacgtggagtagcacctaccagaggctagtgcggactcgtggtgaggggccagttcaccatctccaagacgacaacgaccaaagaacctccctaatatctgacaaatgaaatggtacngagtagtgacggacacggtcctagtattacgtagtgaaanaaagacgtaacggaaccgaggtacgacgacgtag

SEQ ID NO: 407401 - DNA, 552 bp, Homo sapiens
  misc_feature: GZ8MTXP02GKVTB.9.81.H04.1.454.CMB.2.raw
  modified_base (237)..(237): a, c, t, g, unknown or other
  modified_base (538)..(538): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacatttggncttataactatgtctcctggtaccaacagcaccaggcaaagtccccaaaactcatgtatttatgagtacaagtaagccgcctcgtcgggtccctgtactcgtcttctccgtgcctacaagttctcggacacgcggccctcccgtcgacccgtctcgtcggcctccgaggtctagacgatggagtctagtaattatactgcagtctcatagtgacaggaccaacccataatgttctacgggaaagtcgggacctacggtccaccgttccgtaggccacgaacccgaacggaccccaaacccnctacgccacttccc

SEQ ID NO: 407402 - DNA, 510 bp, Homo sapiens
  misc_feature: GZ8MTXP02F3IEV.9.81.H04.1.454.CMB.2.raw
  modified_base (237)..(237): a, c, t, g, unknown or other
  modified_base (297)..(297): a, c, t, g, unknown or other
  modified_base (500)..(500): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggncttataactatgtctcctggtaccaacagcaccaggcaaagtccccaaatcatgatttangagtcaatagcggccctcgtgggtccctgactcgcttctcctggctcaagtctggcacgccgcctccctgacccgtctcgtgggcctccgaggcctagacgatggagtctagtattatactgcagctcatatgacaggacacccacatcgtcgttacggagtcggaccacggtcaccgtctagccacgcccgaacgcccaccnctcgcactcc

SEQ ID NO: 407403 - DNA, 540 bp, Homo sapiens
  misc_feature: GZ8MTXP02FVMXN.9.81.H04.1.454.CMB.2.raw
  modified_base (375)..(375): a, c, t, g, unknown or other
  modified_base (381)..(381): a, c, t, g, unknown or other
  modified_base (407)..(407): a, c, t, g, unknown or other
  modified_base (412)..(412): a, c, t, g, unknown or other
  modified_base (448)..(448): a, c, t, g, unknown or other
  modified_base (474)..(474): a, c, t, g, unknown or other
  modified_base (522)..(522): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtcgtgggggaggcttggtgcagcctggccacctccctgagactctcctgtgcccgcctctggattcattgtttgatgattatgccatgcacgtggggtccgctaagttccgaggggaagggcctggggagtgggtctcgaggttacttacgttggagtagcactacnagctangcgatcgtgtgagggccatcacatcncaganacacgaccaagaacctacctatatctagacaaagtnaatggtactagagtacgtgacggacncggtcttaggtacttacgtgtagaacaaaagtcgtaacggaaacccgngggtacggacgctaacgg

SEQ ID NO: 407404 - DNA, 651 bp, Homo sapiens
  misc_feature: GZ8MTXP02INDZN.9.81.H04.1.454.CMB.2.raw
  modified_base (223)..(223): a, c, t, g, unknown or other
  modified_base (252)..(252): a, c, t, g, unknown or other
  modified_base (298)..(298): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgactattggtgctttataaacttntcgtctctgtaccaacacgccaccgagacaaactaccccaatcatntattatagagtacaagtacgccgtccctcgtcgggtcctgctcgtcttctccgtcgtcctaccgtagtcgtacggaccaccgtccggtccccttccgtacgtacccgttctcggtcggtcctccgacggtctacggacgtagtcggacggtcttagtaatttacgttacgtcgtacctacgtaccttatagttacgtacgaccgacggacccaaccgtaactaagttcggttacgtaacggggtaaacgggtacgggtaacccgtacggttaccgtacccggttaccgtacggtaccaaccgaaccccgtaaaccggaccccctaacccgtacgtaccgtacctacccttccg

SEQ ID NO: 407405 - DNA, 550 bp, Homo sapiens
  misc_feature: GZ8MTXP02JOUBM.9.81.H04.1.454.CMB.2.raw
  modified_base (306)..(306): a, c, t, g, unknown or other
  modified_base (367)..(367): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctggtggagtcgtgggggaggcttggtgcagcctggcacctccctgagactctcctgtcgccgcctctggattcatgttgatgattatgccatgcacgtggggtccganaaggttccgaggggacgggcctgggagtgggtctcgaggtattacgtggagtagcactacngaggctagtgcggactcgtggtggagggggcccgtagttccacctactctcccagacgaacacgaccaaagacctacctatatctagacaatgaatggtctagagtagtgacggacacggtccttagtattacgtgtacgaacaaaagacgtaaccggaaacccgaggtacggaccgactagg

SEQ ID NO: 407406 - DNA, 579 bp, Homo sapiens
  misc_feature: GZ8MTXP02FLDIQ.9.81.H04.1.454.CMB.2.raw
  modified_base (308)..(308): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtcgtgggggagcttggtgcagcctggcacctccctgagactctcctgtcgcccgcctctggattcattgttgatgattatgccatgcacgtggggtccgnaaggttccgaggggaagggcctgggaggtgggtctcgaggtacttacgttggagtagcactaccacgaggctatgcggtactcgtggtgacggggcccgagttcacccatcctaccaagacgaaccaaacgaccaaagaaccctaccctaatactcctagactaaaagtgaaagtcggtcgtaggagtagttaggaacggacgaacggtccttagtattacgtagtagaacgaaaagtacgtaacggaaaccccgaggtacggacgcgaag

SEQ ID NO: 407407 - DNA, 663 bp, Homo sapiens
  misc_feature: GZ8MTXP02HXBDW.9.81.H04.1.454.CMB.2.raw
  modified_base (306)..(306): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaggtgtccagtgtgaagtgcagctggtggagtcgtgggggaggcttggtgcagcctggcacctccctgagctctcctgtcgcccgcctctggattcatgtttgatgattatgccatgcacgtgggtccgntaagtccgaggggaggcctgggagtgggtctcgaggttacttacgttgggagtacgcaactaccacgagggtccttaatcgggaccgtaccttgtgggtcgggtacgggggcccgtactttccgaaccctacttaccctacccgaagaacgaacccaaaccggacccaaaacggtaaaccccttaccccttaattaactaccttacggaacctaaaagttacggtaaaagtttcgggtacttagggaagggttaaggtttacgggaacgggtaccgtaaccgggtacccgtttaggttaatttaccgtagtacgaacaaaagtacgtaacggaaacccgagggtacgacgacgtagg

SEQ ID NO: 407408 - DNA, 566 bp, Homo sapiens
  misc_feature: GZ8MTXP02GE8ST.9.81.H04.1.454.CMB.2.raw
  modified_base (239)..(239): a, c, t, g, unknown or other
  modified_base (249)..(249): a, c, t, g, unknown or other
  modified_base (474)..(474): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattgggtncttataactntcgtctctgtacaacagcaccaggcaaacgtccccaaactcatgtatttatgaggtacaataagccggtcctcgtcggggtcctgactcgcttctcctggcctaccaagtctcggacaccgaccggccctcccgtgacccgttctcgtcgggcctccgaggtcctagacgatggaggcttagtatttatactgcacgcttcatagtcgaccgaggaccacccaanaacgttgtacgttacggaagttcgggacccacggtcacccggtctacggtaccacgaacccgaacggacccaaaccctctacgtccacttcc

SEQ ID NO: 407409 - DNA, 663 bp, Homo sapiens
  misc_feature: GZ8MTXP02IFYM2.9.81.H04.1.454.CMB.2.raw
  modified_base (281)..(281): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctggtggagtcgtgggggagcttggtgcagcctggccacctccctgagactctcctgtcgcccgcctcgtggattcattgtttnatgattatgccatgctacgtcggggtccggactaaggtttcccggaaggggtaacggggtccgtaggggaggttcggggtctacgtaagggtttacctttacgttgggaagttacgctaacctaacccgacgtaggtactaagtcgaccgggtactcgtgggtaggacgggggaccgtagttcccgaacctaacgttccgttaccgaacggaacgaaaccgaaaccggaacccaaaacggtaaacccttaccctaattaactctacggaactaaagtagtaaagtggtacgtagtaggtagttaggacggacgtacggtacctttaggtacttacgtgtacaacgaaaagtacgtaacggaacccgaggtacgacgtacgag

SEQ ID NO: 407410 - DNA, 560 bp, Homo sapiens
  misc_feature: GZ8MTXP02ISEAS.9.81.H04.1.454.CMB.2.raw
  modified_base (236)..(236): a, c, t, g, unknown or other
  modified_base (241)..(241): a, c, t, g, unknown or other
  modified_base (264)..(264): a, c, t, g, unknown or other
  modified_base (379)..(379): a, c, t, g, unknown or other
  modified_base (431)..(431): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcggtcaccatctcctgcactggaaccagcagtgacattggtncttanaactatgtctcctggtaccaacngcacccaggcaaagtccccaaatcaatgattatgaggtcaaatagcggccctcgtggggtccctgatcgcttctcctgcctccaagtctggcacgacggcctccctgacccgttntcgtgggctccgaggctgacgatgaggctgtattatactgccagctcattangcgagccaccaatagtcgtacgtacgggaacggtcgggaccctacgggtaccaccggttccgtaacggtcaaccggaaccccgaaaaccggtacccccaaaaccccgtacttccggtacctaccttccg

SEQ ID NO: 407411 - DNA, 662 bp, Homo sapiens
  misc_feature: GZ8MTXP02HH33K.9.81.H04.1.454.CMB.2.raw
  modified_base (286)..(286): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtcgtgggggagcttggtgcagcctggcacctccctgagactctcctgtcgccgctctggattcattgttgatgattangccatgcacgtgggtccgcaagttccgaggggacgggcctgggagtgggtctcgtaggtactttacgtggaagttagcaactaccacgagggctaagtcggacggtactcgtggtgggacgggggaccctagttccacctatcctacccgaagacgaaccgaaccgacccaaacgaacccttacccctaattactaccgtagtaacccaaaagttacgtaaagttgggttacgttaggaaggtacggttaggaaacgggtaccgtaccggggttaccctttaggtttacgtttaaccgttggttaacgaaaccgaaaaaggtacgttaaaccgggaaaacccccgtaggggttaaccggacccgttacgtaacggg

SEQ ID NO: 407412 - DNA, 563 bp, Homo sapiens
  misc_feature: GZ8MTXP02F7AE5.9.81.H04.1.454.CMB.2.raw
  modified_base (238)..(238): a, c, t, g, unknown or other
  modified_base (418)..(418): a, c, t, g, unknown or other
  modified_base (444)..(444): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtntcttataactatgtctcctggtaccaacagcaccaggaccaaacgtccccaaactcaatgtatttatgaggtacaataagccggccctcgtcggggtccctgatcgtcttctcctggcctcaagtctcggacaccgccggccctcccgtcgacccgtctcgtcggcctccgagctgacgngtgagctagtattatactgcagtctnatatgcgacgacaacccataacgtgtacgtacggaagtcggaccacggtaccaccgtaccgtacggtaccacgaaccccgaacggaccccaaaccccgtactaccgtaccacgttcccg

SEQ ID NO: 407413 - DNA, 601 bp, Homo sapiens
  misc_feature: GZ8MTXP02HPS22.9.81.H04.1.454.CMB.2.raw
  modified_base (312)..(312): a, c, t, g, unknown or other
  modified_base (381)..(381): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttgggtattttaaaggtgtccagtgtgaagtgcagctggtggagtcgtgggggaggcttggtgcagcctggcacctccctgacgactctcctgtcgcccgcctctggattcattgtttgatgattatgccatgcacgtggggtcccganaaggttccgaaggggaacgggcctgggagtgggtctcgtaggtacttacgttggagtacgcaactaccngaggctagtcgcggtatcgtggtggaggggccgattcgaccatcctaccagacgaacaaccgaccaaagaacctccctaatactctagactaaagtagtaagtggtctaggtagtaggttaggtaacggacgtaccgggtacctttaggttaactttacgtagttacgaaacgaaaaggtacgttaacggaaaaccccgtagggtacggacggactacgg

SEQ ID NO: 407414 - DNA, 560 bp, Homo sapiens
  misc_feature: GZ8MTXP02FP217.9.81.H04.1.454.CMB.2.raw
  modified_base (238)..(238): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcacccaggcaaacgtccccaaactcatgtatttatgagtacaataagcgccctcgtggggtccctgatcgcttctcctggctacaagtctggacaccgacggccctccgtcgacccgtctcgtcgggctccgaggctagacgatgaggtctgtattatactgcagctcatatgacaggccaaccacaatcgtacgttacggaacggtcgggacctacgggtacctaccggtccgtaacggtcaaccgaacccgaaacggacccctaaaaccccgctacgtacctactttcccg

SEQ ID NO: 407415 - DNA, 586 bp, Homo sapiens
  misc_feature: GZ8MTXP02G0A2P.9.81.H04.1.454.CMB.2.raw
  modified_base (224)..(224): a, c, t, g, unknown or other
  modified_base (289)..(289): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtcgtgggggagcttggngcagcctggccacctccctgagactctcctgtcgcccgcctctggattcattgttgatgatttangcctatgctacgtggggtccgactaagttccgaggggaacgggcctgggagtgggtctcgtagtattacgtggagtagcactacagagtctagtgcgactcgtgtggaggggtccgtatcacatctaccgagacgaaccaacgacccaaacgtaaccctaccctaattactactagtaactaaagtagaagttggtactaggagtaggtagaacggacgacggtccttagttaacttacgtacgtacgaaacgtaaaagtacgtaacggaaaaccccgaggtacggacgacgtaagg

SEQ ID NO: 407416 - DNA, 640 bp, Homo sapiens
  misc_feature: GZ8MTXP02FZLL6.9.81.H04.1.454.CMB.2.raw
  modified_base (239)..(239): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgactattggtncttaataactatgtctcctggtaaccaacagccacccgaggaccaaacgtaccccaaaactcatgtaacttttatgaacggtacaaataacggccggtccccttacgtcggggtacccctgactccgtcctttcctccgtcggccttaccgaaacgttcgtcgggaccaaccgccgggtcccctcccgtacgacccgttctcgtcgggtcctccgacggctgacgatcgaggcttagtattactactgactagtctacattacgtgacacggaccaacccaataacgttgtaccgttaacgggaaacggttcggggaaccctaccgggtacctaccggttaccgttacggcaaccggaacccgaaacggaccccaaaacccgtctacgtcctaccttaccc

SEQ ID NO: 407417 - DNA, 629 bp, Homo sapiens
  misc_feature: GZ8MTXP02JTBH3.9.81.H04.1.454.CMB.2.raw
  modified_base (366)..(366): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtcgtgggggaggcttggtgcagcctggcacctccctgagactctcctgtcgccgcctctggattcatgttgatgattatgccatgcacgtgggtccgacaagttccgagggacgggctgggagtgggtctcgaggtattacgtggagtacgcactaccncgaggctagtcgacggtactcgtggtagggtacggggacccgtacgttacacctatacctaccgacggaacgaaccaaaccggaccaaaaccgtaaccttacccctaatactaccttagaacctaaaagtaggtaaagttcgggtactaggtaaggtaggttaggaacgggacgtacgggtacccgtttaggtaatttaccgtacgttagaaccgtaaaaggtacgtaacggaaaaccccggtagggacggacggacgtacgg

SEQ ID NO: 407418 - DNA, 604 bp, Homo sapiens
  misc_feature: GZ8MTXP02GHI9I.9.81.H04.1.454.CMB.2.raw
  modified_base (288)..(288): a, c, t, g, unknown or other
  modified_base (369)..(369): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtcgtgggggagcttggtgcagcctggccacctccctgacgactctcctgtgcccgcctctggattcattgttgatgattangccatgcacgtggggtccgataaggttccgaggggacggctgggagtgggtctgaggtacttacgtggatgcactaccagnggctagtcgcgtactcgtggtggaggggcctagtcaccactctcccgaagacgaaccaaaccgaccaaaacgaaccctaccctaatactcgtacgaactaaaagtgtaaagtcgggtactaggtaaggtaggtttaggaacgggtaccgacggttccgtttagttaactttacgtagtacgaaacgaaaaagtacgtaaccgggaaaaccccgtagggtacggaccgacgtaagg

SEQ ID NO: 407419 - DNA, 561 bp, Homo sapiens
  misc_feature: GZ8MTXP02GRDB2.9.81.H04.1.454.CMB.2.raw
  modified_base (238)..(238): a, c, t, g, unknown or other
  modified_base (248)..(248): a, c, t, g, unknown or other
  modified_base (265)..(265): a, c, t, g, unknown or other
  modified_base (342)..(342): a, c, t, g, unknown or other
  modified_base (359)..(359): a, c, t, g, unknown or other
  modified_base (439)..(439): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaacccagcagtgacattggncttataactntgtctctggtaccaacngcacccaggcaaagtccccaaatcatgatttatgaggtcaataacgcggccctgtggggtccctgactcgtcttacncctggcctccaagttcnggaccacgccggccctccctgacccgttctcgtgggacctccgaggctagacgatggaggctagtattacttacgtgcanctacatatgacaggacacccaacatagtacgttacggtaaggtacggtaccgacggtaccgaccgtaccgttaacgtcgacgaacccgaacggacccaaccccacctacgtcctacttcccg

SEQ ID NO: 407420 - DNA, 668 bp, Homo sapiens
  misc_feature: GZ8MTXP02I2GZU.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttgggtattttaaaaggtgtccagtgtgaagtgcagctggtggagtcgtgggggagcttggtgcagcctggccaccctccctgacgactctcctgtcgcccgcctctggacttcattgtttgattgtacttatcgccatcgctacgtggggtcccggctaagttccggaggggaagggccgtagggaggtgggtcctaggtaggttactttacgtgggaagtagaccacctaaccacgtacggactagtcggcggtactgtggtgggaggggtcccattaccaccattccaccaagacgaaccgaacgaccaaacgtaacccttaccctattactcctagaactaaaagtggtaaagttgggtacgttaggaaggtacggttaggaaacgggtaccgtaaccggggttcctttaaggttaactttacgtagggttaaccaaagaaaaacggtacgttaaaccgggaaaaaccccggttagggggtacggaaccggactaacgggg

SEQ ID NO: 407421 - DNA, 712 bp, Homo sapiens
  misc_feature: GZ8MTXP02JFM4G.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtcgtgggggagcttggtgcagcctggcacctccctgagactctcctgtcgcccgcctctggatcattgttgatgattatgacctagtgcctacgttcggggtcccgactaaacggtttcccggaagggggtaaccgggtccgtggggtacgggttcggggtcctacggtaaggggtttaactttacggttaggggaacgttacggacctaaaccgttaaccccgagtagggccttaagtcgggacgggtactgtagggtgggacgggggtcctagttccaaccgtattccctaccgaaggacgaaccaaaccgtaccaaaacgtaacccttaccctaattactactacgaactaaagtgtaaagtcggtacgtaggtaggtaggttaggaacgggtaccgtaccggggttaccgtttaggttaacctttacgtacggttacgaaaaccgaaaaggtacgtaaacccgggaaaaccccggtaggggtacggaaccgtagtaaccgg

SEQ ID NO: 407422 - DNA, 520 bp, Homo sapiens
  misc_feature: GZ8MTXP02IULR0.9.81.H04.1.454.CMB.2.raw
  modified_base (285)..(285): a, c, t, g, unknown or other
  modified_base (454)..(454): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtctgggggaggcttggtgcagcctggcacctccctgagactctcctgtgccgctctggattcatgtttgatgattangccatgcactgggtccgcaagttccgagggaacgggcctgggagtgggtctcgaggtacttacgttggatagcactaccacaggctatgcggactcgtgtgaggggccagttcaccatctccagacgaacaacgccaaagacctaccctatatctagacaaatgaatgntgagagtgacggacacggtctgtatacgtgtgacaaaagactacggaacccaggtacgacgctaag

SEQ ID NO: 407423 - DNA, 530 bp, Homo sapiens
  misc_feature: GZ8MTXP02IKBVP.9.81.H04.1.454.CMB.2.raw
  modified_base (239)..(239): a, c, t, g, unknown or other
  modified_base (244)..(244): a, c, t, g, unknown or other
  modified_base (361)..(361): a, c, t, g, unknown or other
  modified_base (443)..(443): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcacccctcctcactcagggcacagggtcctgggcccagtctgccctgactcagccctccctccgcgtccgggtctcctggacagtcggtcaccatctcctgcactggaaccagcagtgacattggtncttanaactatgtctcctggtaccaacagcaccaggcaaacgtccccaaatcatgatttatgaggtacaataagccggccctcgtggggtccctgatcgcttctcctgctcagtctggcacncgcctccctgacccgtctcgtgggcctccgaggctggacgagtgaggctgtattatactgcagctcatatgcgagcacccanatgtcgttacggaagttcggaccacgggtcctaccggtctacggtcaacgtcccgaaacgcccgaaccctactcgtaccaccttccg

SEQ ID NO: 407424 - DNA, 600 bp, Homo sapiens
  misc_feature: GZ8MTXP02HB8Q0.9.81.H04.1.454.CMB.2.raw
  modified_base (374)..(374): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtcgtgggggagcttggtgcagcctggcacctccctgagactctcctgtcgcccgctctggattcattgttgatgattatgccatgcacgtgggtcccgataagttccgaggggaacgggtcctagggagtggggtctcgtaggtacttacgtggagtagcacgtacngaggctagtgccgtactcgtggtcgaggggcccgtagttccaccactcctaccgaagacgaaccaaaccggtaccaaaacgacccttaccctatactactacggactaaagtagtaattcgggtactaggtaagtacggttaggaacggaccgtaccgggtaccttaggtacttacgtagtagaaaccgaaagacgtaccggaaacccgagggtacgacgacgagg

SEQ ID NO: 407425 - DNA, 544 bp, Homo sapiens
  misc_feature: GZ8MTXP02I731R.9.81.H04.1.454.CMB.2.raw
  modified_base (302)..(302): a, c, t, g, unknown or other
  modified_base (360)..(360): a, c, t, g, unknown or other
  modified_base (383)..(383): a, c, t, g, unknown or other
  modified_base (398)..(398): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtatttaaaggtgtccagtgtgaagtgcagctggtggagtctgggggaggcttggtgcagcctggcacctccctgagactctcctgtgcccgcctctggattcatgttgatgattatgccatgcacgtgggtccgnaagttccagggagggcctggagtgggtctcgaggtattacgttggagtagcactaccnaggctagtgcggtactcgtgtgnggggccatcacatcncccagagacaacgcaaacgtaacctcctatatctagaccaaaatgaaatggtactggagtagttggaacggacgacgggtccttggtaactttacgtcgtagaccgaaaagacgtaacgaaaaccccgaggtacggacgacgtaag

SEQ ID NO: 407426 - DNA, 557 bp, Homo sapiens
  misc_feature: GZ8MTXP02I074L.9.81.H04.1.454.CMB.2.raw
  modified_base (238)..(238): a, c, t, g, unknown or other
  modified_base (303)..(303): a, c, t, g, unknown or other
  modified_base (404)..(404): a, c, t, g, unknown or other
  modified_base (434)..(434): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcacccaggacaaacgtccccaaactcaatgatttangaggtacaatacgcgcctcgtcggggtcctgatcgcttctctgctcaagtctggcacgaccggtcctcctcgaccgtctcgtcgggcctcgaggctgacgngtgagctgtattatacgtgcagctacatangacagaccaacccataattcgtacgttacggaacggtcgggacctacgggtacctaccggtaccgtaacggtccaaccgaacccgaaacggaccccaaaccctacgtcgtacctactttcccg

SEQ ID NO: 407427 - DNA, 570 bp, Homo sapiens
  misc_feature: GZ8MTXP02INHDY.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttgggtatttaaaggtgtccagtgtgaagtgcagctggtggagtcgtgggggaggcttggtgcagcctggcacctccctgagactctcctgtcgcccgcctctggattcatgtttgatgattatgccatgcacgtggggtcccggactaaggttccgaaggggaacgggccttgggaggtggggtctcgtaggttacttacgtggatagcaacctaccagaggctagtgcggactcgtggtaggtaggggcccgtaagttcacctatcctaccagacgaacaaacgccaaagaacctaccctatactctagacaaatgaatgtctagagagtgaacggacgacggtcttagtattacgtgtagaacaaaagtacgtaacggaaaacccgtagggtacgacgacgtag

SEQ ID NO: 407428 - DNA, 564 bp, Homo sapiens
  misc_feature: GZ8MTXP02I2BIS.9.81.H04.1.454.CMB.2.raw
  modified_base (243)..(243): a, c, t, g, unknown or other
  modified_base (358)..(358): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtcccgggtctcctggacagtcggtcaccatctcctgcactggaaccagcagtgacattggtgcttanaactatgtctcctggtaccaacagcacccaggcaaagtccccaaatcatgatttatgagtcaataagcggccctcgtggggtccctgatcgcttctcctgctcaagtctggcacnccggcctcccgtgacccgtctctgggctccgagctgacgatgaggctagattatactgcagtctcatatcgcaggccacccgtaacagtgtacgttacggaaacgttcggggaaccctacgggttcaacccgttccgttaaacgggtccaaccggaaccccgaaacgggaccccaaaacccccgtcttacggtcccactttccccg

SEQ ID NO: 407429 - DNA, 596 bp, Homo sapiens
  misc_feature: GZ8MTXP02F1VJ8.9.81.H04.1.454.CMB.2.raw
  modified_base (238)..(238): a, c, t, g, unknown or other
  modified_base (300)..(300): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctctggtaccaacagcaccaggcaaacgtccccaaactcatgtatttangagtcaataagcggccctgtcggggtccctgactcgcttctccgtgctccaagtctggccacgccggcctccgtcgaccgtctcgtcgggactccgaggctagacgagtgacggtctagtattattcgtgacagctcaattgcgacgacggaccaacccaacgtaacgttcgtacgtttacgggaaaacggttcgggaaccctacggttaccgtaaccgttccgttaacggtcccaaacggaaccccgtaaacggacccctaaaacccccgtacgtaccgtacctaccgtttcccg

SEQ ID NO: 407430 - DNA, 612 bp, Homo sapiens
  misc_feature: GZ8MTXP02JT5IZ.9.81.H04.1.454.CMB.2.raw
  modified_base (379)..(379): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtcgtgggggaggcttggtgcagcctggccacctccctgacgactctcctgtcgcccgcctctggattcatgttgatgattatgccatgcacgtcggggtccgacaaggttccgaggggacgggccgtgggtaggtgggtctcgtaggtacttcgtaggagtacgcactacncgaggctagtgcgactcgtggtaggacgggggtccgattccgacctagtccgtacccaaggaacgaaccgaaccgaccaaacgtaccctacctatactactagaacaaagtcgtaaagtcggtacgtagaaggtaggttacggaacggtaccgacgggtcctttaggtacttaccgtagtacgaaacgaaaagtacgtaaccggaaaccccgtagggtacggaccgagtacgg

SEQ ID NO: 407431 - DNA, 728 bp, Homo sapiens
  misc_feature: GZ8MTXP02I1Z2T.9.81.H04.1.454.CMB.2.raw
  modified_base (274)..(274): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttgggtatttaaaggtgtccagtgtgaagtgcagctggtggagtcgtgggggagcttggtgcagcctggccacctccctgacgctctctgtcgccgctctgattcatgttnatgattatgccatgcacgtcggggccgactaacggttccgaaggggagggcctgggaggtggggtctacgtaggttactttacgtagggtagtacgacctaaccgttaacccgacgtagggtaccttaagtcggaccggtactcgttgggtagggaccgggggaccctacgttacccgaaccctacgtttacccgacccgaaagaaccggaaacccgaaaccggaaccctaaaacggtaaaccccttacccccgtaaatttaccgttacctacggtaaacctaaaaacgttacggtaaattcgggggtttactagggtaaaggttaagggttacggaaacgggttaacccggtaaccgggttcccgttttaagggttaactttaccggtaggttacgaaaacgtaaaagtacggtaaccggaaaaccccgtaggggaccggtacgaccgtaagg

SEQ ID NO: 407432 - DNA, 559 bp, Homo sapiens
  misc_feature: GZ8MTXP02JYT15.9.81.H04.1.454.CMB.2.raw
  modified_base (223)..(223): a, c, t, g, unknown or other
  modified_base (238)..(238): a, c, t, g, unknown or other
  modified_base (542)..(542): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtncttataactatgtctcctggtaccaacagcacccaggcaaacgtccccaaactcatgtatttatgaggtcaaataagcggccctcgtcggggtccctgatcgtcttctcctggctccaagtctggcacaccggtccctccctgacccgtctcgtgggcctccgaggctgacgtagtgaggctagtatttacttactgcagctcatatgcacggccaaccgacaacgtgtacttacgggaacgtcgggaccgacggtccaaccggttcctacggtccaacgaacccgaacggacccctaaacccncgtcgtaccaccttccg

SEQ ID NO: 407433 - DNA, 676 bp, Homo sapiens
  misc_feature: GZ8MTXP02JGLG0.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtcgtgggggagcttggtgcagcctggcacctccctgagactctcctgtcgcccgcctctggattcattgttgatgattatgccatgcacgtcggggtccgactaacgttccgaaggggaacgggccgtagggaggtcggggtctacgtaggttacttacgttggagtagcaactaccacgaggtctagtcgcggtactcgtggtcggacgggggccctattccgacctatcctacccgaagaacgacaaaccgaccaaaacgacccttacctaattactacttagaacctaaagtagaaacgttgggtactaggtaaaggtagtttagggaaacggtaccgtaccggggttacccgttttaaaggtaaccttttaaccggttacggttaaggaaaactaaaaacgggtaacggttaaacccggggaaaaacccccggtaggggtaaccgggaacccggagtaaacgggg

SEQ ID NO: 407434 - DNA, 644 bp, Homo sapiens
  misc_feature: GZ8MTXP02HIYIP.9.81.H04.1.454.CMB.2.raw
  modified_base (304)..(304): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgactagttggtgctttaataactatgtctcctggtaccaacagcaccaggacaaacgtccccaaactcatgattangagtcaatagcgcctcgtcgggtccctgactcgcttctccgtgctccaagtctggacacgaccggtcctccgtcgacccgtctcgtcgggcctccgaggctcggacgtagtgaggtctagtattacttactgacagcttacattagcgacgacggacccaaacccctaagtaaacgttcgttaccggttaacggggtaaacggttaccggggaaaccctaacccgggttacccgtaaacccggttaccggttaaaccgggtaccgaaaccggtaacccccgaaaaccggggtacccccaaaaccccctacgttacccggtaccttaacccgtttccccgg

SEQ ID NO: 407435 - DNA, 683 bp, Homo sapiens
  misc_feature: GZ8MTXP02IL8MG.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttgggtatttaaaggtgtcagtgtgaagtgcagctgggtggagtcggtgggggagcttggtgcagcctggcaccctccctgacgctctcctgtcgccgcctctggattcattgttgatgtattatgcctatgctacggttggggtcccgactaaggttccggaaggggaacgggccgtggggacggttgggtctacggtaggttactttacgtggagtagcctaactaccacgtaggaccttaggtcgcccgggtacttcggttagggtcggggacgggggtacccgtaagttaccaacccgtaattcccgtacccgaaggaacggaaaccaaaccgaccaaaacgtaaccccttaccctaatacctacgttacgaacctaaaagtgaaagttggtacgtaggtaagaggttaggaacggtacgtaccgggttactttaggttaactttacgtagttacgaaacgtaaaaacggtacgtaaacccgggaaaacccgtaggggtaccgaacggtcgtaagg

SEQ ID NO: 407436 - DNA, 588 bp, Homo sapiens
  misc_feature: GZ8MTXP02JQZM1.9.81.H04.1.454.CMB.2.raw
  modified_base (223)..(223): a, c, t, g, unknown or other
  modified_base (238)..(238): a, c, t, g, unknown or other
  modified_base (264)..(264): a, c, t, g, unknown or other
  modified_base (296)..(296): a, c, t, g, unknown or other
  modified_base (342)..(342): a, c, t, g, unknown or other
  modified_base (434)..(434): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccngcagtgacattggtnctttataactatgtctcgtgtaccangcaccagcaaacgtccccaaatcatgatttangaggtacaataacgccgtaccctgtcggggtccctgatccgcttcncctggctacagtctggacaccgaccggtcctccgtcgaccgttctcgtcgggcctcgaggctacgacgagtcgacggtctagtattattacngctagtctacatcgtcgcgaccgaccaaccccataactcgtagtaccgggtaagttccgggacctacgggtcctaccggttaccgtaacggtccaaccggaaccccgaaacgggaccccctaaacccgtacgtaccggtacctacctttcccgg

SEQ ID NO: 407437 - DNA, 631 bp, Homo sapiens
  misc_feature: GZ8MTXP02GU25F.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtcgtgggggagcttggtgcagcctggcacctccctgagactctcctgtcgcccgctctggattcatgttgatgattatgccatgcacgtggggtccgacaagttccgaaggggaacgggcctgggaggtggggtctacgtaggtacttacgttggagtagactaacctaccacgagggctagtcgacgggtactcgtggtaggacgggggcctattccgacctatcctacccagacgaacaaaccgaccgaaaagaacccttacccctaattactccttagaacctaaaagtagaaatgggtacttaggaagtagttaggaacggtaccgacgggtaccctttaggttaacttaccgtaggttacgaaacgtaaaaaggtacgtaaccggaaaaccccggtagggtaacgacggactaaacgg

SEQ ID NO: 407438 - DNA, 706 bp, Homo sapiens
  misc_feature: GZ8MTXP02H385T.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttccttttgggtattttaaaaggtgtccagtgtgaagtgccagctggtggagtcgtgggggaggtcttggtgcaggcctgggccacctccctgacgactctcctgtcgccgcctctggattcattgttgatgattatgccatgcacgtcggggccgacaagttccgaggggaacgggcgtgggagtggggtctcgtaggttacttacgttaggagtacgctaacctaccacgacggtactagtcgggaccggtactcggttggtacggggacgggggacccgtacgtttaccgaaccctagttcccgttaccgaaggaacgaaacccgaaaccgacccaaaacgtaacccttacccctaattactaccttaggaacctaaaagttacgaaagtttcggtacgttagggaaggtaaggtttacgggaacgggtaaccgtaccggggtttaccttaagggtttaactttaaccgttaggtacgtaaaacgtaaaaaggcggttaaaacccgggaaaacccggtaggggtaacggacggtaacccgtaggg

SEQ ID NO: 407439 - DNA, 548 bp, Homo sapiens
  misc_feature: GZ8MTXP02FFMK2.9.81.H04.1.454.CMB.2.raw
  modified_base (265)..(265): a, c, t, g, unknown or other
  modified_base (299)..(299): a, c, t, g, unknown or other
  modified_base (339)..(339): a, c, t, g, unknown or other
  modified_base (359)..(359): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctctggtaccaacngcaccaggcaaacgtccccaaactcatgatttangagtcaataagccgcctctggggtccctgactcgctttcncctggctcaagtctggcacnccggcctccctgaccttctctgggctccgaggctgacgatgaggctagatttacttacgtgcagctactatatgcacggccaacccacaagtcgtacgttacggaacggtcgggaccctacggtcccaccgtccgtaacggccacggaaccccgaaaggaccccaaacccgtcgtcgtaccacttcccg

SEQ ID NO: 407440 - DNA, 589 bp, Homo sapiens
  misc_feature: GZ8MTXP02FLIW6.9.81.H04.1.454.CMB.2.raw
  modified_base (238)..(238): a, c, t, g, unknown or other
  modified_base (265)..(265): a, c, t, g, unknown or other
  modified_base (299)..(299): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctctggtaccaacngcaccaggacaaacgtccccaaatcatgtattangagtacaataagcggccctgtcggggtccctgactcgtcttctccgtggcctaccgaagttctacggacaccgaccgggcccttcccgtacgtacccgttctccgtgggccctccgaggtctagacgagtggacggtctagtattattacgtgcagtctacatagtgaccgacggaccaacccataagtcgttcgttacgggaacgtcgggacctacggtcctaccgtaccgtaacggtccaacgaacccgaaacggacccccaaacccgtctaccgtacctacttcccg

SEQ ID NO: 407441 - DNA, 683 bp, Homo sapiens
  misc_feature: GZ8MTXP02I5HYW.9.81.H04.1.454.CMB.2.raw
  modified_base (281)..(281): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtatttaaaggtgtccagtgtgaagtgcagctggtggagtcgtgggggagcttggtgcagcctggcacctccctgagactctcctgtcgccgctctggatcatgttgatgattancacatcgctacggtcgggtccgactaacggtaccggaaggggaacgggcgtaggtaggtggtctacgtaggttaacttacgttaggtaagtacgactaaccgtaaccagtaggtactaagtcgacgtactcgtggtacggacggggtaccgtacgtaccaacctaacgtaccgtaacccgaaaggaaacgaaaccgaaaaccgaacccgtaaaaacgtaaaccccttaaccctaaaattaacttacctaacgaaactaaaacgtaaagtaaagtacggtacgtaggtaagtagtaggtaacggtaacgtaccggttacgttacgttaacgttaacgttacgtaacgaaacgtaaaacgtaaacgtaaacggaaaaccggtaacggtaacggaacgacgtacg

SEQ ID NO: 407442 - DNA, 534 bp, Homo sapiens
  misc_feature: GZ8MTXP02GFROF.9.81.H04.1.454.CMB.2.raw
  modified_base (238)..(238): a, c, t, g, unknown or other
  modified_base (298)..(298): a, c, t, g, unknown or other
  modified_base (370)..(370): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttaataactatgtctctggtaccaacagcaccaggcaaacgtccccaaatcatgattangagtcaataagcgccctgtcggggtccctgatcgcttctctgctcagtctggcacgacggcctcctgacctntcgtgggctcgaggctgacgatggagctagattactactgcagtctacatatgacacgacacctacaatcgtcgttacggagtcgggacctacggtccaccgttccgtacggtaccacgaacccgaaacggaccccaaccccgtacgtacgtactaccttcccg

SEQ ID NO: 407443 - DNA, 608 bp, Homo sapiens
  misc_feature: GZ8MTXP02JXH82.9.81.H04.1.454.CMB.2.raw
  modified_base (352)..(352): a, c, t, g, unknown or other
  modified_base (403)..(403): a, c, t, g, unknown or other
  modified_base (412)..(412): a, c, t, g, unknown or other
  modified_base (421)..(421): a, c, t, g, unknown or other
  modified_base (439)..(439): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttggtattttaaaggtgtccagtgtgaagtgcagctggtggagtcgtgggggagcttggtgcagccgtggccaccctccctgacgactctcctgtcgcccgcctcgtggtattcattgttgattgattatcgccatcgcctacgtcggggccgacgtaacggttccggaaggggaacgggtttttccgngggtaggtcggggtctacgtaggttacttacgtggaagtacgcaacctacngagtctagngcgactcgnggaggcgggcatcacctntcacgagacgaaccacgaccaaacgacctacctatactcgtagaactaaagtgtaagtcggtataggagtaggtagacggaccgacggtttcctagttacgttacgtacggtaagaactaaaaggtaccgtaaccgggaaacccggtagggtacggaacggctaacggg

SEQ ID NO: 407444 - DNA, 610 bp, Homo sapiens
  misc_feature: GZ8MTXP02HSP8Q.9.81.H04.1.454.CMB.2.raw
  modified_base (241)..(241): a, c, t, g, unknown or other
  modified_base (252)..(252): a, c, t, g, unknown or other
  modified_base (269)..(269): a, c, t, g, unknown or other
  modified_base (477)..(477): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacgagggtcctgggcccagtctgccctgactcagcctccctccgcgtccgggtctccgtggacagtcggtcaccatctcctgcactggaaccagcagtgacattgggtncttaataactntgtctcctggtaccaangcaccagcaaacgtccccaaatcatgatttatgagtacaatacgccggccctgtcgggtccctagctcgtcttctccgtggcctacgacgtctcgggactaccgccggtccctccgttcgaacccgtctcgtcgggcctccgaggtctaggaccgtagtggacggtcttaggtaacttaacgttccgtgtcgtacgtcttatacgtanacgacgacgaccaacctactacgttacgtacggttacggtaacggtacgggtaccgtaccggtaccgtaccgtaccgtacgtaccgaccgaaccgaaccgacccgtacccgtaccgtaccgtacctacctccg

SEQ ID NO: 407445 - DNA, 720 bp, Homo sapiens
  misc_feature: GZ8MTXP02GK09N.9.81.H04.1.454.CMB.2.raw
  modified_base (284)..(284): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttccgttttgggtaattttaaaaggtgtccagtgtgaagtgcagcgtggtggagtcggtgggggagtcgttggtgcagcctggcctaccctccctgacgtacctctcctgtcgcccgtcctcgtgnttcattgttgatgtattagtcgacctatcgcgtacggtcggggtcccgtacgtaacggttccggaaggggacgggtccgtggggaggttgggtaccacgttaggttactttacggtaggtaagtcgactaaccgtaccacggtacgtacttaggtcggacggtacttcgggtcggggtacggggacgggggtacccctagtttacccgaacccgtcgtacccgtaccgaagaacccggaaaccaaacccgaaccgtaaaaccgtaacccttaccgttaattactacgtagtaaactaaagtgtaagtcggttagaggaggttaggtacggaaacggtacgttcccgggtaacgttttagtaacctttaggtaacgtaacggaaaacaaaacggttacgaaacccggtaaccggtaaagggcgtaaaccggcgtagg

SEQ ID NO: 407446 - DNA, 615 bp, Homo sapiens
  misc_feature: GZ8MTXP02HXF5J.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaggtgtccagtgtgaagtgcagctggtggagtcgtgggggagcgttggtgcagcctggcacctccctgacgactctcctgtcgcccgctctggattcattgttgatgtattatgcctatcgctacggtcggggtcccggacgtaacggttccggaaggggaacgggcctaggggaggtcggggtctcgtaaggttacctttacgttgggagtacgactaacctaccacgagggtctagtcggacgtctcgtggcggacggggcctattccacctactctacccgaagacgaacaccgaccaaacgtacctaccctatactcagaccaaatcgaatggtctagagtaggttacgacggacgtacggtacctttagtacgttacgtgtaacaaacgtaaaagcgttaaaccggaacccgagggtaccggaacgacgtacgg

SEQ ID NO: 407447 - DNA, 619 bp, Homo sapiens
  misc_feature: GZ8MTXP02GKCDX.9.81.H04.1.454.CMB.2.raw
  modified_base (226)..(226): a, c, t, g, unknown or other
  modified_base (384)..(384): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtcgtgggggaggcttgggngcagcctggccacctccctgagctctcctgtgcccgcctctggattcattgtttgatgattatcgccatgcacgtcggggtccgcgaagttccggaggggaacgggtcctggggtaggtcgggtctcgtaggttacttcgtggagtacgacacctacngaggctagcgcgactcgtggtgacggggcctagttcacctagtcctacgaacgaacgaaccaacgaccaaacgaaccctcctaatactactagaacaaagtagaaagttcggttacaggtaggtagttacggacggtacgacggtactttacgtaatttacgtaggttacgaaacgtaaaaacggaacgttaaaccgggaaaaccccggtagggtacggaacccggtactaacgg

SEQ ID NO: 407448 - DNA, 591 bp, Homo sapiens
  misc_feature: GZ8MTXP02FPXD8.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtattttaaaaggtgtccagtgtgaagtgcagctggtggagtcgtgggggaggcttggtgcagcctggcacctccctgagactctcctgtgcccgcctctggattcattgttgatgattatgccatgcacgtgggtccgcaagttccgaaggggagggcctgggagtgggtctcgaggtacttacgtggagtagcaactaccacgaggctaagtcgacggtactcgtggtgggacggggccgtattccgacctacgtcctacccgaagacgaaccaaaccgaccaaacgaaacccttaccctaatactcctagaactaaatgaaatggtactagaagtagttaggaacggacgacggtaccttaggtactttacgtagtcgaaacaaaagacgtaacggaaaacccaggtacggacgacgtaag

SEQ ID NO: 407449 - DNA, 696 bp, Homo sapiens
  misc_feature: GZ8MTXP02JU280.9.81.H04.1.454.CMB.2.raw
  modified_base (401)..(401): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttccttttgggtattttaaaaggtgtccagtgtgaagtgcagctggtggagtcgtgggggagcttggtgcagccgtggccaccctccctgacgacctctccgtgtcgcccgtcctctggacttcattggttgatgtacttatcgcctagtcgctacggtggggtccgacaacggttccggaaggggacgggtccgtagggaggtgggtctacgtaggttacttacgtggacgtagcactaccngacggctagtcggcgtactcgtggtacgggacgggggtccctagttccaacctacgttacccgacccgaaggaaccgtaaccaaacccggaccaaaacgtacccttaaccctaattactcctaagaacctaaaagtacgaagttggtacgtaggtaaggtagttagggaacggaaccggtaccgggttacctttagggttaaacctttacggtagttaacggaaaacgtaaaaacggtaacggttaaacccgggaaaaccccggttaggggtaccggaaacccggtacgtaacgg

SEQ ID NO: 407450 - DNA, 684 bp, Homo sapiens
  misc_feature: GZ8MTXP02JOOIK.9.81.H04.1.454.CMB.2.raw
  modified_base (280)..(280): a, c, t, g, unknown or other
  modified_base (290)..(290): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttccttttgggtaattttaaaaggtgtccagtgtgaagtgcagctggtggagtcgtgggggagcttggtgcagctggcacctccctgacgctctcctgtcgccgcctcgtggattcattgttnatgtattatnaccatgctacggtcggggtccgactaaggttccggaaggggtaacggtccgtaggggaggttgggtcctacggtaaggttaccgtttacgttggggaacgtacggcctaacgttaacccagagggtactagtcggcgtacgtcgtgggtacggacgggggtcctacttcgaccctgtaccctacgaaggaccgaacaaccgacctaaaaccgtacctacccttaatacgtactaggaacctaaagtaggaaagtttcggtacgtaagggagtaaggttaggaaaccggtacgaaccgggtttctaaggttaccgtttagtacggtacgaaaacgtaaaacggtacgttaaacccggggaaaacccgttacggggacggaacgacgtaaccgggg

SEQ ID NO: 407451 - DNA, 711 bp, Homo sapiens
  misc_feature: GZ8MTXP02G7EIP.9.81.H04.1.454.CMB.2.raw
tcagtgatacgtctcacgaccggtgctcgatttagtagtgtagattcgcggggagctctgggagaggagtcccagccctgagattcccaggtgtttccattcagtgatcagcactgaacacagaggactcaccatggagttgggactgacctggtattttccttttgggtattttaaaaggtgtccagtgtgaagtgcagctggtggagtcgtgggggaggcttggtgcagcctggccaccctccctgacgactctcctgtcgccgcctcgtggtattcattgttgatgtattatcgccatcggactacggtcggggtcccgacgtaacggttccggaagggggtaacggggtccgtaggggtacggttcggggtctacggttagggttacgtttaacggttagggaagtacgaccgtaaacctaccacggacggtctacgtcggccggtactcgtgggttacggggacgggggtcccgtacttcccgaaccgtacttacccgaccgaaagaccgaaacgaaacccggacctaaaacgtaacccttacctaatacttacgagaaactaaagtgaaacgttggtactaggaaggtagttacgggacgtaccgacggttcctttagttaaccttacgtaggtaacgtaaaacgtaaaacggacgttaaacccggaaaaccccggtaagggtaccggaaccgtacgtaaccggg

SEQ ID NO: 407452 - DNA, 754 bp, Homo sapiens
  misc_feature: GZ8MTXP02IFW8R.9.81.H04.1.454.CMB.2.raw
  modified_base (224)..(224): a, c, t, g, unknown or other
tcagtgatacgtctcacgaccggtgctcgatttagtagtgtagattcgcggggagctctgggagaggagcccccagccctgagattcccaggtgtttccattcagtgatcagcactgaacacagaggactcaccatggagttgggactgacctggtattttcctttgggtatttaaaggtgtccagtgtgaagtgcagctggtggagtcgtgggggagcttggngcagcctggccacctcccgtgacgactctcctgtcgccgctctgattcattgttgatgtacttatcgcctagtcgcctacggtcggggtcccggactaacggtttcccggaagggggaaacggggtcccgttaggggaaggttcgggggtccttacggtaagggtttacctttaaccggttaggggtaacgttaacggactaaacccgttaacccgaacgggtacgggttaccttaaaggtcgggtcccggggtaactttccggtgggtacgggggtacgggggaccccttaagtttcccaaacccgtacttacccgtacccgaaaggaaccgaacccgaaaccgtacccaaaacgtaaacccttaccccttaaattactacctaggtaacctaaaagttacgtaagttacgggttattaggaaggttacgttaggaacggtacgtaccggtcctttagtaaccgttacgagttcgaaacgaaaaggtacgtaaccggaaaacccgtaggggtacgaacgacgttaacgg

SEQ ID NO: 407453 - DNA, 643 bp, Homo sapiens
  misc_feature: GZ8MTXP02JBLTR.9.81.H04.1.454.CMB.2.raw
  modified_base (430)..(430): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtacttttccttttgggttaattttaaaggtgtccagtgtgaagtgcagcgtggtggagtcggtgggggagtcttgggtgcgagccgtggcccaccctccctaggacgtaccttcctcccgtggtccgcccgtccttcgtggtattcattgtttgatgtattatcgaccagtcgctacggtcggggtaccgactaacggttccggaaggggtacgggccgtaggggacggtcggggtctacggtaggttactttacggtggagtagccacctaaccncgagctagtcgcggtactcggtggtcgggacggggtccctattccgacctacgtcctaccgagacgaaccaaccgaccaacgaaccctcctaatatctagactaaacgtgtaagtcgtagtagagtagtaggacggacgtacggtcttaggttattacgtagtacgaaacgtaaagtacgtaaccgggaaacccgagggtcgaaccggcgtag

SEQ ID NO: 407454 - DNA, 558 bp, Homo sapiens
  misc_feature: GZ8MTXP02FH8BF.9.81.H04.1.454.CMB.2.raw
  modified_base (284)..(284): a, c, t, g, unknown or other
  modified_base (303)..(303): a, c, t, g, unknown or other
  modified_base (366)..(366): a, c, t, g, unknown or other
  modified_base (408)..(408): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaatgcagctggtgagtcgtgggggaggcttggtgcagcctggcacctccctgagactctcctgtgcccgcctctggattcatgttgatgattangccatgcacgtgggtccgnaagttccgagggacggcctgggagtggggctcgaggtactttacgtggagttagccactaccnagggcctagtgcgtactcgtgtgaggggccgattcaccatcnccagacgacaaccgaccaaacgaacctaccctatactctacgacaaagtagaaatggtctaggagtagttaggacggaccgacggtccttagtacttactgtacgaacgaaaagactaacggaaaacccccgaggtacggaaccgcacgg

SEQ ID NO: 407455 - DNA, 616 bp, Homo sapiens
  misc_feature: GZ8MTXP02H6GK5.9.81.H04.1.454.CMB.2.raw
  modified_base (224)..(224): a, c, t, g, unknown or other
  modified_base (242)..(242): a, c, t, g, unknown or other
  modified_base (385)..(385): a, c, t, g, unknown or other
  modified_base (411)..(411): a, c, t, g, unknown or other
  modified_base (424)..(424): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttgggtatttaaaggtgtccagtgtgaagtgcagctgggtggagtcgtgggggagcttggngcagcctggcacctcccngacgactctcctgtcgcccgcctctggattcattgtttgatgtattatgccatcgctacgtcggggtcccggactaaggttcccgaaggggaacgggccgtgggagtgggtctcggaggttacttacgtggagtcgcactacncgaggctagtcgcggtactgtgtggngggccgtatcacntcgtccagacacacgccaaacgtaacctcctaatacgtctacgaacaaaagttgaagttcggttagaggtaggtaggttaggaacggtacgtaccggttaccgtttaggtaactttacgtaggttaacgaaaccgtaaaaaggtacgtaaaacgggtaaacccccgtagggtacgggaccgacggtaacggg

SEQ ID NO: 407456 - DNA, 689 bp, Homo sapiens
  misc_feature: GZ8MTXP02HD0NL.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttgggtattttaaaaggtgtccagtgtgaagtgcagctggtggagtcgtgggggaggcttgggtgcagcctggccaccctccctgagacctctcctgtcgcccgtcctcgtggtattcattgttgatagtattatcgcctagtcgcgacggttcggggtcccggacgtaacggtttccccggaaagggggtaaccggggtccggttaggggtacgggttcggggttccgtacggtaacgggtttacgtttaccggttaggggtaacgtacgacctaaccgtaaccacgtacgggtctaacgtcgaccggtacttcggtggagggtacggggaccgtatccgaacactccgtaccaggacaaccgaaccgaccaaagtccctactatactcgtagaactaaagtatagtgtacgtaggagtaggttaggaacggtaccgtacggtaccttaaggttacttacgtacgtaacgtaaacgaaaagtaaccggtaaccggaaacccggtagggtacgaccgtacgacggg

SEQ ID NO: 407457 - DNA, 609 bp, Homo sapiens
  misc_feature: GZ8MTXP02I8ZWK.9.81.H04.1.454.CMB.2.raw
  modified_base (238)..(238): a, c, t, g, unknown or other
  modified_base (249)..(249): a, c, t, g, unknown or other
  modified_base (263)..(263): a, c, t, g, unknown or other
  modified_base (298)..(298): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtnctttataactntgtctctgtaccanagcaccaggacaaacgccccaaatcatgtatttangagtacaatagcgtcctcgtcgggtccctgactcgcttctccgtcgcctacaagtctacggaccaccgaccgtcccctacccgtcgtacccgttctccggtcgggtcctccgaggtcctagacgagtgacggcttagtattacttacgtgacagtcctacattatagccgaacggacccaacctactaaacgttcgttacgttaacggggtaaacggttacgggaacccgtaccggtaccgtacccgttaccgtacggaccgaccgtaacccgaacgtaaccccaacccgtacgtccgtacacctttcccg

SEQ ID NO: 407458 - DNA, 740 bp, Homo sapiens
  misc_feature: GZ8MTXP02G1ULA.9.81.H04.1.454.CMB.2.raw
  modified_base (283)..(283): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagagactcaccatggagttggactgacctggtattttctttggtatttaaaggtgtccagtgtgaagtgcagctggtggagtcgtgggggagtcttggtgcagcctggccaccgttcccgtgacgacctcgtcctgtcgcccgcttcgtggattcattgttnatgtattatcgccagtcgccgtacgtcggggtcccgacgtaaacggttcccggaaggggtaaccgggtccgtagggtacggttcggggtacctaggtaaggttacctttacggttaggaacgttacgacctaaccgttaaccgacgtacgtacgttaagtcgggtacccggtaacttccggtagggtacggggaccgggggtacccttaacgttcccaaccgtacgttaccctaccgaagaaccgaaaccgaaaccgttaccgaaaaccgttaacccttacccctaattaccttccgtaaacgtaaacgtaaagtagtaacgttcggtacgttaggtaaggttacgtacggaacggtaccggtaccgtttaccgtttagttaacgttacgtacgtaacgaaaacgtaaaacggtaccgtaaacccggaaccggtagggtaccgaacgtacgtaacgg

SEQ ID NO: 407459 - DNA, 518 bp, Homo sapiens
  misc_feature: GZ8MTXP02H1FUG.9.81.H04.1.454.CMB.2.raw
  modified_base (238)..(238): a, c, t, g, unknown or other
  modified_base (243)..(243): a, c, t, g, unknown or other
  modified_base (300)..(300): a, c, t, g, unknown or other
  modified_base (372)..(372): a, c, t, g, unknown or other
  modified_base (439)..(439): a, c, t, g, unknown or other
  modified_base (506)..(506): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttanaactatgtctcctggtaccaacagcacccaggcaaagtccccaaactcatgatttangaggtcaataagcggccctctggggtccctgatcgcttctctggccttccaagtctggcacacggcctcccngacccgtctctgggctccaggctgacgatgaggctgattatactgcagctcatatgcaggcacccanaatgtcttaggagtgggaccaacggtcaaccgtcctaggtcaacgcccaaggacccaaacccccgtntcgtaccactcg

SEQ ID NO: 407460 - DNA, 619 bp, Homo sapiens
  misc_feature: GZ8MTXP02G37CA.9.81.H04.1.454.CMB.2.raw
  modified_base (557)..(557): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctggtggagtcgtgggggagcttggtgcagcctggcacctccctgagactctcctgtcgccgctctggattcattgttgatgtattatgccatcgctacgtggggtcccgactaagttccgaggggaacgggcctgggagtggtcagtaggtacttacgtggagtacgactacctaaccacgaggacttagcgccggtactcgtagggtggacgggggcctacttccgaacctacgtcctaccgaagaacgaacccgaaaccgacccaaagtaacccttacctaactatacctagaacaaagtacgaattggtacgtagagtagttcggaacggacgtacggtccttagtacggtttacncgttagaaacgaaaagttcgaaaccgggtaaaaccccgtagggacggaaccgtacgtaacgg

SEQ ID NO: 407461 - DNA, 541 bp, Homo sapiens
  misc_feature: GZ8MTXP02IL6FC.9.81.H04.1.454.CMB.2.raw
  modified_base (237)..(237): a, c, t, g, unknown or other
  modified_base (424)..(424): a, c, t, g, unknown or other
tcagtgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtncttataactatgtctcctggtaccaacagcaccaggccaaagtccccaaactcatgatttatgaggtcaataagcggccctcgtggggtccctgatcgcttctcctgctccaagtctggcacaccggcctccctgaccgtctctgggcctccgaggctgacgatgaggctgattatactgcagcctnatatagcgagaccaccgacaatcgtcgttacggaacggtcgggaccctacggtaccaccgttccgtacggtccacgcccgaaacggaccccaaccctacgtacgtacctacttcccg

SEQ ID NO: 407462 - DNA, 538 bp, Homo sapiens
  misc_feature: GZ8MTXP02H32WP.9.81.H04.1.454.CMB.2.raw
  modified_base (221)..(221): a, c, t, g, unknown or other
  modified_base (236)..(236): a, c, t, g, unknown or other
  modified_base (242)..(242): a, c, t, g, unknown or other
  modified_base (298)..(298): a, c, t, g, unknown or other
  modified_base (328)..(328): a, c, t, g, unknown or other
  modified_base (339)..(339): a, c, t, g, unknown or other
  modified_base (406)..(406): a, c, t, g, unknown or other
  modified_base (425)..(425): a, c, t, g, unknown or other
  modified_base (430)..(430): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcggtcaccatctcctgcatggaaccngcagtgacattggtnctttanaactatgtctcctggtaccaacagcacccaggcaaagtccccaaatcatgatttangaggtcaaatacgcggcctgtggggtcccngatcgcttacncgtgctcaagtctggacacgcgcctcccgtgaccgtctctcgggctccgaggctagacgatgaggcngattatactgacagcttanatagngcgacgaccaccactagtcgtcgttacggaaggtacggacctacggtacctaccgtaccgtacgtacacgaacccgaacggaccccaacccgtagtaccgtactactc

SEQ ID NO: 407463 - DNA, 837 bp, Homo sapiens
  misc_feature: GZ8MTXP02FQ5CS.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtatttaaaggtgtcagtgtgaagtgcagctggtggagtcgtgggggagcttggtgcagcctggccaccctccctgacgactctcctgtcgcccgcctcgtgattcattgtttgatgtattatcgacctatcgcgtacggttcggggtccccggacgtaaacggtttcccggaagggggtaacgggtcccgtaggggtacggttcggggtacctacggtaaggtttaactttacggttaggggaacgttacggaccgtaaccttaacccgacggtaacgggtccttaaaggtccgggtaccgggtaaccttcgggttaggggtacgggggaaccgggggtacccgttaacttacccgtaacccgtactttaccccgtacccggaaagtaaacccgaaaccgaaaacccggaacccaaaaaccggttaaaccccttacccccgttaaattaccgttaccttaaggaaacctaaaagttacggtaaaggtttccggttaacggttagggaaacgggttaggttaaggggaaccggggtaacccgttaaccggggttacccttttaaggttaacgttttaaccgtacgggttaacgaaaaccgtaaaaagggtaaccggttaaacccgggtaaaaaccccggggtaggggtaaccggaaccggtacggtaacgg

SEQ ID NO: 407464 - DNA, 627 bp, Homo sapiens
  misc_feature: GZ8MTXP02F8FUR.9.81.H04.1.454.CMB.2.raw
  modified_base (397)..(397): a, c, t, g, unknown or other
  modified_base (420)..(420): a, c, t, g, unknown or other
  modified_base (437)..(437): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgactggtatttctttggtattttaaaggtgtcagtgtgaagtgcagctggtggagtcgtgggggagtcttggtgcagccgtggccacctccctgacgtacctcctcctgtcgccctcctctggattcattggttgatgtattatcgaccatcgctacggttcggggtccgactaacggttccggaaggggtacgggcgtggggtaggtcggtctacggtaggttacttacgtggagtacgctaacctacncgtagctagtcgcgtactgtggnggacgggcctatcgacncgtcaccgagacgacaacgacaaacgtacctacctatactctagaaactaaagtcgtaagttggtagtaggtaagtggttaacggaacggtaccgtacggttccgttttaaacgtaattaccgtaaggtacgtaaaacgaaaacggtcgtaaaaccgggaaaacccgtagggtacggaccgtacgtaagg

SEQ ID NO: 407465 - DNA, 821 bp, Homo sapiens
  misc_feature: GZ8MTXP02I6VWN.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagctggtggagtcgtgggggagcttggtgcagcctggcacctccctgagctctcctgtcgcccgcctctggattcattgttgatgattatgacccatgcctacgtcggggtcccggacaaacggttccgaagggggaacgggtccctaggggaggttcggggtcctacggtagggttaactttacggttggggtaagttacggcctaaccgttaacccacggtacgggaccttaaggtccggaccgggtaactttcggtagggttacggggacggggggtacccgtagtttacccaacccgtaactttcccgtaccccgaaagggaaccgaaaccgaaaacccggaccctaaaaccggtaaaccccctttacccccttaaagtttaaccttacctacggtaaaccctaaaaagttacggtaaaacggtttgggttaccgttagggtaaacggttaacggggtttagggaaaacgggggtacccgtaaacccgggggttcccgttttaaggtttaaacgttttaccggtaacggtttaggtaaaaccgaaaaaagggttaccggttaaaacccggggaaaaaccccccggtagggggttaaccgggaaccggaccgttaaacggggg

SEQ ID NO: 407466 - DNA, 753 bp, Homo sapiens
  misc_feature: GZ8MTXP02JFDWQ.9.81.H04.1.454.CMB.2.raw
  modified_base (292)..(292): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtcgtgggggagcttggtgcagcctggccacctcctgacgactctcctgtcgcccgtcctctggtattcagttgttgattgattancgcctagtcgcctacggttcggggtaccgacgtaaacggtttccggaagggggaaacgggtccgtaggggtaggttcggggtcctacggtaaggtttactttacggtggggtaatacgactaaccttaacccgagacgggtcttaacggtggacccgggtacttcggtgggttacggggcgggggtaccctacgttacccgaccctacgttacccaccgaaggtaacgaaaccgaaacccgaaccaaaacgtaacccttaccctaattactactacgaactaaacgtagtaagttacgggtcgtaggtacgttaaggttacggaaacggttacccggtaaaccggttcccgtttaaggttaacctttacggttaacggttaacgtaaaaccggaaaaaggtaaccggttaaaacccgggtaaaacccccggaggggttaaccggacccggtacgtaacggg

SEQ ID NO: 407467 - DNA, 627 bp, Homo sapiens
  misc_feature: GZ8MTXP02FPOLT.9.81.H04.1.454.CMB.2.raw
  modified_base (239)..(239): a, c, t, g, unknown or other
  modified_base (301)..(301): a, c, t, g, unknown or other
  modified_base (345)..(345): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgactattggtncttataactatgtctctgtaccaacagcaccaggacaaacgtaccccaaatcatgtatttangagtacaataagccggccctcgtcggggtccctgactcgcttcncctggctacagtctgcacgcgcctcctgacctctcgtcgggtcctcgaggctagacgagtgacgtctagtatttactcgtagcagctacaattagtagccgacggccaaacccgaactaagttacggttaccgttacgggtaaacggttaccggggaaacccgtaccgggttacccgaacccggtttaccgttaaccggtacccgaaccggaaccccggaaaacccgggttaacccccaaaacccccgtaccggtttacgtaccccgtaaccgtttcccccg

SEQ ID NO: 407468 - DNA, 669 bp, Homo sapiens
  misc_feature: GZ8MTXP02H389X.9.81.H04.1.454.CMB.2.raw
  modified_base (282)..(282): a, c, t, g, unknown or other
tcagtgatacgtctcacgaccggtgctcgatttagtagtgtagattcgcggggagctctgggagaggagcccccagccctgagattcccaggtgtttccattcagtgatcagcactgaacacagaggactcaccatggagttgggactgacctggtattttccttttagggtattttaaaggtgtccagtgtgaagtgcagctggtggagtcgtgggggagtcgttggtgcagcctggccacctcctgagactctcctgtcgccgctctggattcattgttnatgtattatcgccatcgcgtacgtcggggtcccgactaaggttccggaaggggaacgggtccgtagggaggttgggtcctacgtaggtttaccttacgttgggtaagtacgacctaacttaacccgagtacgggacttaagcgtaccgggtacctcggtcgggtacggggacggggacccgtacttacccgaccctaacgttcccgtaccgaacggaaccgaaacccgaccgaacccaaaacgtaacccttccctaaatttactacgtacgaactaaaagtacgaagtggtactaggagtagttagacggacgtacggttcttagtacttacgtacgtagaaccgaaaaggtcgtaaaccggaacccgaggtacggaccgacgtagg

SEQ ID NO: 407469 - DNA, 683 bp, Homo sapiens
  misc_feature: GZ8MTXP02GRWLP.9.81.H04.1.454.CMB.2.raw
  modified_base (293)..(293): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttggtattttaaaggtgtccagtgtgaagtgcagcgtggtggagtcgtgggggaggtcgttggtgcagcctggccacctcctgacgcctctccgtgtcgcccgctcgtgtattcattgttgatgtattangacctatcgctacggtcgggtaccggacgtaacggttccgaaggggaacgggtccgtaggggtcggttcggggtcctaggtaaggttactttacggttggaagttacgacctaaccgtaaccgacgtagggctaagtcggaccggtacttcgtgggtcgggacgggtcccgtattaccgacctacgttaccaccgaagaacaaccgaaaccgaccgaaaacgtaccctaccctaattactctaacgaactaaattgtaaacggttggtagtcgaaggtagttacgaacgggtacctaacggttcctttaagtacgtttacgtaggtacgaaaacgaaaacggttacgtaaacccgggaaaaccccgagggtacggaacccgtagtacggg

SEQ ID NO: 407470 - DNA, 541 bp, Homo sapiens
  misc_feature: GZ8MTXP02FXBW0.9.81.H04.1.454.CMB.2.raw
  modified_base (358)..(358): a, c, t, g, unknown or other
  modified_base (375)..(375): a, c, t, g, unknown or other
  modified_base (401)..(401): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtctgggggagcttggtgcagcctggcacctccctgagctctcctgtgccgcctctggattcatgtttgatgattatgccatgcactggggtccgcaagttccaggggaaggcctgggagtggtctcaggtattacgttgagtagcactacncagctatgcggactcgngtgacggggtccgagttccaccatcncccagacgaccaaacgccaaagaacctccctaatatctagacaaatagaatggtctagagagttgaaggtacacgggtccttagtacttactggtagaacaaaagagtaacggaaaaccccgaggtacggaccgacaacg

SEQ ID NO: 407471 - DNA, 583 bp, Homo sapiens
  misc_feature: GZ8MTXP02FP9T4.9.81.H04.1.454.CMB.2.raw
  modified_base (370)..(370): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggaatcaccatggagttgggactgacctggattttcctttgggtattttaaaaggtgtccagtgtgaagtgcagctggtggagtcgtgggggagcttggtgcagcctggcacctccctgagactctcctgtcgcccgcctctggattcatgttgatgattatgccatcgcacgtgggtccgctaagtccgaggggacggccgtgggagtgggtctcgaggtacttacgtggagtacgcaactaccngaggctagtcgcgtactcgtgtggcggggcctattccgacctgtcctaccgagaacgacaaaccggccaaaagtaccctaccctaatactctacgacaaaagttgaaattgggtctaggagtaggttacgaacgggtctaacgggtccttaggtacttacgtagtagaaccaaaagtacgtaaccggaaaacccgtggtacggacgcgtaagg

SEQ ID NO: 407472 - DNA, 659 bp, Homo sapiens
  misc_feature: GZ8MTXP02JIPHE.9.81.H04.1.454.CMB.2.raw
  modified_base (273)..(273): a, c, t, g, unknown or other
  modified_base (558)..(558): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaaggtgtccagtgtgaagtgcagctggtggagtcgtgggggaggcttggtgcagcctggccaccctcctgacgacctctcctgtcgcccgctctggtntctattgttgattgtaattagtcgcctagtcgacgtaccgtcggggtcccggacgtaacggttacccggaaggggaacgggtccgtgggtacggttggggtactacggtaaggtttacgtttacgtagggaacgtacggaccctaaccttaacccgcgaacggtaccttagtccggaccggtacttcggttcgggtaagggggaccggggtaccctagttccaaccgttactcctaccgaagacgacaaacccgacaaacgtcctaccgtatacgctagaactanagtatcggtgagtagtagtgacgtacgtacggttctagtacttacgtcgtagaaaacgtaaacgtacgaaccgggtaaaccggtggacggactacgtacgg

SEQ ID NO: 407473 - DNA, 561 bp, Homo sapiens
  misc_feature: GZ8MTXP02JCERZ.9.81.H04.1.454.CMB.2.raw
  modified_base (193)..(193): a, c, t, g, unknown or other
  modified_base (239)..(239): a, c, t, g, unknown or other
  modified_base (249)..(249): a, c, t, g, unknown or other
  modified_base (266)..(266): a, c, t, g, unknown or other
  modified_base (302)..(302): a, c, t, g, unknown or other
  modified_base (342)..(342): a, c, t, g, unknown or other
  modified_base (374)..(374): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacngtcggtcaccatctcctgcactggaaccagcagtgactagttggtncttataactntcgtctcctggtaccangcaccaggacaaacgtccccaaactcatgtatttangaggtcaataagcgccctgtggggtccctgactcgcttcnccgtgctccagtctcgcacgtaccgcctccgngaccgtctcgtcggcctcaggctagcgtagtgacggtctagtattactactgcagtcctagacttagtcgaccgacggtaccacccgaactatcgtcgtaacggacggtcggacctacggtcctaccgtcgtacggcgaccgaacccgaaccggtacccaaacccctcgtacgtacctactttcccg

SEQ ID NO: 407474 - DNA, 715 bp, Homo sapiens
  misc_feature: GZ8MTXP02FWHP2.9.81.H04.1.454.CMB.2.raw
  modified_base (247)..(247): a, c, t, g, unknown or other
  modified_base (265)..(265): a, c, t, g, unknown or other
  modified_base (692)..(692): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgaagtgcagcgtggtggagtcgtgggggagcgttggtgcagcctggccacctccctganctctcctgtcgccgcctntgattcattgttgatgtattagtgaccatcgcgacggtcggggccgacgtaacggttccggaagggggtaacgggtccgtagggtaggttcggggtctacggtaggttacctttacggtagggaagttacggaccctaaccgttaaacccgacgacgggtacgttaacgtcggggacccggtaacttccgtgggtcggggacggggtacccgtacttaccgaaccctacgttacccgtacccaacggaacgaacccgaaaccgaacccaaaacggtaaccccttaaccctaacgttactcccgttaagaactaaaacgttgtaagtcggttacgtagaaggtaggtaggaacggtacgtacggttccgtttagttagttaccgtagttaagaaacgtaaaacgtacggtaaaccgaaaaccccgggnggtaacggacggtacgtaacggg

SEQ ID NO: 407475 - DNA, 801 bp, Homo sapiens
  misc_feature: GZ8MTXP02I3JNC.9.81.H04.1.454.CMB.2.raw
  modified_base (181)..(181): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttgggtattttaaaggtntccagtgtgaagtgcagctgggtggagtcggtgggggagtcttggtgcagcctggccaccctccctgacgtacctctcctgtcgcccgctctggattcattgttgatgtatagtcgccagtcgctacggtcggggtcccgacgtaacggttcccggaagggggtaaccgggtcccgtaggggtacggttcggggttacctaggttaacggtttaacgttttaccggtgggtaacgtaacgtacctaacccttaacccccgaggtacggtccgttaaagtccgggacccggggttaccttaccgggtgggttacggggaccgggggtaccctaacgttaccgaacccctacttacccgtacccggtaacgaaaccggaaacccgaaacccggaacccaaaaccggttaaccccctttaaacccctaaacgtttacttaccccgtaaggtaacccctaaaaggttaccggtaaaggtttacgggtaacgtttagggaacggtaaaggtttacggaaacgggtaccgtaaccggttaccgtttagttaacgtttacgtagttaccgaaagtaaacggtaccggtaaccggtaaaacccgtggggtaccgaccgtagtaacggg

SEQ ID NO: 407476 - DNA, 545 bp, Homo sapiens
  misc_feature: GZ8MTXP02JMK65.9.81.H04.1.454.CMB.2.raw
  modified_base (238)..(238): a, c, t, g, unknown or other
  modified_base (263)..(263): a, c, t, g, unknown or other
  modified_base (291)..(291): a, c, t, g, unknown or other
  modified_base (295)..(295): a, c, t, g, unknown or other
  modified_base (332)..(332): a, c, t, g, unknown or other
  modified_base (377)..(377): a, c, t, g, unknown or other
  modified_base (421)..(421): a, c, t, g, unknown or other
  modified_base (426)..(426): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgactattggncttataactatgtctctgtacaacngcaccaggacaaagtccccaaatcagtnattnagagacaatagcgcctctgggtccctgatcgtcttcnctcgctaccgaagtctcggacacgccggcctcccgtacgccttcncgtcgggacctccaggtccagaccagtgaggcctagtatttacncgtanctagctacatagagacgacgaccaccacagtacgtacgtacggtacggtacggtaccgtacgtacgtaccgtaccgtacgacgacgaaccgaaccgacccacccactactactactacg

SEQ ID NO: 407477 - DNA, 697 bp, Homo sapiens
  misc_feature: GZ8MTXP02GHNAT.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggattttcctttgggtattttaaaggtgtccagtgtgagtgcagctggtggagtcgtgggggagcgttggtgcagccgtggccacctccctgacgctctcctgtcgcccgtctctggtacttcattggttgagtgtaattatcgcctatcgcgtacggtcggggtccgtacgtaacggttcccggaaggggaacgggtccggtagggtacgggttggggtacctaggtaggttaacgtttacgttacggagtacgtaccaaccttaaccgacgacgtctacggtcgcggtacctgtgggtacgggacgggggtccctaagttcccgaactctaccgtacccgagaacgaaccaaaccggtaaccaaaagtaaaccccttaccctaattactcgtaagtaaaccaaaagtagtaacgtgtactaggtaagtacggttaggaacggtaccgtacggttccgtttaaggtacttacgtacggtaacaaaaggtaaaaacggcgttaaaccggggaaacccgtaagggttcggaacccgaacgttacgg

SEQ ID NO: 407478 - DNA, 758 bp, Homo sapiens
  misc_feature: GZ8MTXP02JSZ92.9.81.H04.1.454.CMB.2.raw
  modified_base (223)..(223): a, c, t, g, unknown or other
  modified_base (240)..(240): a, c, t, g, unknown or other
  modified_base (383)..(383): a, c, t, g, unknown or other
tcagtgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctctgcactggaaccngcagtgactagttggtntcttaataactatcgtctccgtggtaaccaacacgccaacccaggtaccaaaacgtcccccaaatctaatgtaactttagtgaacggttacaaaagtaggcccggaccctttcggtcggggtcccctagacttcgtcctttcncccgtcgggaccttaccgaagttccgtcgggaaccaaccggtcccgggtcccccttcccgtagtaccccggtttcgtcccggttacgggggtacccttacccgggaagggtccgttacggaaccgggaacgttgggtaaacggggtcctttaagggtaacttttaacgtttaaccgtcggtacaacggttcccttaactaagttacgtcgacccgaacggtacccctaaaccaaccgtaagttccggttacgttacgggaaacggttccgggacctaccggggtacctaacccggtccgttaacgggtacccaacgggtaaccccgtaaaacggcccccctaaaaccgtcggttcctacccgttactttccccgg

SEQ ID NO: 407479 - DNA, 689 bp, Homo sapiens
  misc_feature: GZ8MTXP02IE653.9.81.H04.1.454.CMB.2.raw
  modified_base (405)..(405): a, c, t, g, unknown or other
tcagtgatacgtctcacgaccggtgctcgatttagtagtgtagattcgcggggagctctgggagaggagcccccagccctgagattcccaggtgtttccattcagtgatcagcactgaacacagaggactcaccatggagttgggactgacctggtattttccttttagggtattttaaaaggtgtccagtgtgaagtgcagctggtggagtcgtgggggaggcttggtgcagcctggccacctccctgacgacttctcctgtcgcccgctcgtggattcgattgttgatgtaattatgaccattcgcctacgtggggtcccggactaaggttaccgaggggaaggccgtggagtcgggtctacgtaggttacctttacgtgggacgtagacctaacgtaacccngacggtacttagtcggaccggtaccttggttcggaggggtacggggcccgttaaacgttccaaacctacgttccacccggaagaacgaaccaaacgtaccaaacgtacctacccgtataactctcgaactaaagtagtaaacgttgtacgtagaacgggtagtttacgggaacgtaccgtacgggtcccttttaaaggtagtttacccgtagggtaactaaaacggtaaaaacgtacgttaaccgggaaaacccccggaggttccggaaacgaccggttaacgg

SEQ ID NO: 407480 - DNA, 637 bp, Homo sapiens
  misc_feature: GZ8MTXP02JRYYH.9.81.H04.1.454.CMB.2.raw
  modified_base (183)..(183): a, c, t, g, unknown or other
  modified_base (217)..(217): a, c, t, g, unknown or other
  modified_base (225)..(225): a, c, t, g, unknown or other
  modified_base (255)..(255): a, c, t, g, unknown or other
  modified_base (263)..(263): a, c, t, g, unknown or other
  modified_base (270)..(270): a, c, t, g, unknown or other
  modified_base (285)..(285): a, c, t, g, unknown or other
  modified_base (372)..(372): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggattgggactgacctggatttttacctttgggtaattttaaaaggtntccagtgtgaagtgcagctggtggatctgggggngcttggtncagcctggcacctccctgagactctcctgngccgcctntggattnatgttgatgattgtncatgcacgtggcccggacaaggtttcccgaaggggtaacgggtccttggggagttggggtcctacgtagggtaacttttccgttggngtagcacctacccgactaagggctacgttgaccgcttcgtagttggagggggtcccaatttcacctaatcctaccgaagaaacggcaaaaccggaccaaaagaacccttaccccaatactctacggaccaaaatagaaattcgggttctagaaggtattagggaacgacacggtaccctttaggttaactttaacgtacgttgaaaccgtaaaaagacgttaaacggaaaccccccgagggtttacggaaacccggtctaaacgg

SEQ ID NO: 407481 - DNA, 657 bp, Homo sapiens
  misc_feature: GZ8MTXP02GLXCJ.9.81.H04.1.454.CMB.2.raw
  modified_base (242)..(242): a, c, t, g, unknown or other
  modified_base (255)..(255): a, c, t, g, unknown or other
  modified_base (275)..(275): a, c, t, g, unknown or other
  modified_base (317)..(317): a, c, t, g, unknown or other
tcagtgatacgtctcacgaccggtgctcgatttagtagtgtagattcgcgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatcctctgcacgtggaaccagcagtgactagttgggtntcttaataaactntcgtctccgtggtaaccaanacgccaaccgaggacaaaccgtaccccaaatcatcgtattangtagtacaaagtacggcgtccctaggtcggggtccctgtacgtcgtctttctccgtcggtcctacgaaagttccgacggaccaccggaccggtccccttacccgtacggtacccgttctccgggtacgggtccttacccggaggctaggaccgtaagtacggaacggtctagttaatttacgtactagacgtacgtctactagtactcgacgacgtaccaacccgtaataacgttcgttacggttacggaacggttccgggaaacctcggttaccctaccgttccgtaacgtccgaaccgaacccgaacggaacccctacccgattacgcctacttcccg

SEQ ID NO: 407482 - DNA, 720 bp, Homo sapiens
  misc_feature: GZ8MTXP02GXJ1W.9.81.H04.1.454.CMB.2.raw
  modified_base (300)..(300): a, c, t, g, unknown or other
  modified_base (702)..(702): a, c, t, g, unknown or other
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttcctttgggtattttaaaaggtgtccagtgtgaagtgcagctggtggagtcgtgggggagtcgttggtgcagcctggcaccctccctgagtactctcctggtcgcccgtcctcgtgtacttctattgtttgatgtaattancgaccatcggacctacggtcggggtccgataacggttccggaaggggaacgggtccgtagggtacggtcggggttaccacggttaggttaactttcggtagggtagtaacggcctaaaccgtaacccagggtaacgggtactacggtccgggtaaccggtacttcggtgggtaggggaccgggggtaccctagttacccgaccgacgttccctaccgacgaacggaacccgaaaccgaacccaaaacgggtaccccttaccgttaactacgtaccgtaggtaaccctaaagttagtaaacgtccggttactcggaaaggttccggttagggaacggtacgtaccggtcctttaaggttacttacgtaagtacttaaacgaaagacgtaaccggaaaacccgngggtaacgacgacgtacg

SEQ ID NO: 407483 - DNA, 839 bp, Homo sapiens
  misc_feature: GZ8MTXP02F9CGY.9.81.H04.1.454.CMB.2.raw
tcagtgatacgtctcacgaccggtgctcgatttagtagtgtagattcgcggggagctctgggagaggagccccagccctgagattcccaggtgtttccattcagtgatcagcactgaacacagaggactcaccatggagttgggactgacctggtattttccttttgggtattttaaaaggtgtccagtgtgaagtgcagcgtggtggagtcggtgggggaggtcgtttgggtgcgagccgtggccaccctccctgacgacctctcctgtcgcccgtcctcgtggtacttctagttgttgatgtattatgccagtcgcgtacgtcggggtaccggacgtaacggttaccggaaggggaacgggtccggtaggggtacggttcgggttcgtacggtaaggtttacgtttacgttagggtaacgtacgtacctaacccgttaaccgacggtaacggtaccgttaacggttaccgggtaccgggttaccgtttcgggttacgggggtacggggggtaaacgggggttacccccttacgtttaaccccgaaccctaaccggtttaccccgacccgggtaaaacgacccggaaaaccgaaaacccgttaccccgaaaaaccggttaaacccccttacccgttaaaattaccggtaccttaacgggaaaaccttaaaagtggttaaaccgttgggtaaaccgttagaagggttaacggttagggaaacggttaccccggtacggtttaccgttttaggtaactttaccgttaggaaccgtaaaacgtaaaaacggtccgttaaacccggggaaaacccgtggggtacggacccgtaggttaacgg

SEQ ID NO: 407484 - DNA, 425 bp, Homo sapiens
  misc_feature: GZ8MTXP01EF54J.13.77.G11.1.454.CMB.2.raw
  modified_base (421)..(425): a, c, t, g, unknown or other
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactacgtggggccaggggaaccctggtcaccgtctcctcaccctccaccaagggcccatcggtcttccccctggcaccctcctccaagagcacctctgggggcacagcggccctgggctgcccctggtcaaggctacttcctagtcgtgactgagcgggctggcagcgcatagnnnnn

SEQ ID NO: 407485 - DNA, 421 bp, Homo sapiens
  misc_feature: GZ8MTXP01C6K0H.13.77.G11.1.454.CMB.2.raw
  modified_base (289)..(289): a, c, t, g, unknown or other
  modified_base (412)..(412): a, c, t, g, unknown or other
  modified_base (418)..(421): a, c, t, g, unknown or other
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggcctatattactgtgcgagagtcggaggttacggtgactatcagctagttgactacgtggggccaggggaccctggtcaccgtctcctcacccncaccaagggcccatcggtctcccctgcaccctcctcaagagcacctctgggggcacagcgcctgggctgcccctggtcaaggactacgttccctagtccgtgactgagcgggctggcaaggcncatagnnnn

SEQ ID NO: 407486 - DNA, 436 bp, Homo sapiens
  misc_feature: GZ8MTXP01EDC7H.13.77.G11.1.454.CMB.2.raw
  modified_base (291)..(291): a, c, t, g, unknown or other
  modified_base (427)..(436): a, c, t, g, unknown or other
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactacgtgggggccaggggaccctggtcaccgtctcctcacccnccaccaagggcccatcggtccttccccctggccacccctcctccaagacgcacctcgtgggggcacagcggccctgggctgcccctggtcaaggctactcctagtcgtgactgagcgggctgggcaggcgcatagnnnnnnnnnn

SEQ ID NO: 407487 - DNA, 435 bp, Homo sapiens
  misc_feature: GZ8MTXP01A6OKF.13.77.G11.1.454.CMB.2.raw
  modified_base (292)..(292): a, c, t, g, unknown or other
  modified_base (428)..(428): a, c, t, g, unknown or other
  modified_base (431)..(435): a, c, t, g, unknown or other
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagctagtttgactacgtgggggccagggaaccctggtcaccgtctcctcacccnccaccaggcccatcgtcctccccctgccacccctcctccaagacgcacctcgtgggggcacgacgcggcccgtggctcgccctggtcaacggactactacctagtcgtgactgacgcgggcgtggacaagcgacanagnnnnn

SEQ ID NO: 407488 - DNA, 430 bp, Homo sapiens
  misc_feature: GZ8MTXP02IQOY7.13.77.G11.1.454.CMB.2.raw
  modified_base (424)..(430): a, c, t, g, unknown or other
tcagtcacgtactacacgaccggtgctcgatttagctagtcactcaagggaaagggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactgggccaggggaaccctggtcaccgtctcctcaccctccaccaagggcccatcggtcttccccctggcaccctcctccaagagcacctctgggggcacagcggccctgggctgcccctggtcaaggactacttcctagtcgtgactgagcggggctgggcaaggcgcatagnnnnnnn

SEQ ID NO: 407489 - DNA, 421 bp, Homo sapiens
  misc_feature: GZ8MTXP02HPYKZ.13.77.G11.1.454.CMB.2.raw
  modified_base (418)..(421): a, c, t, g, unknown or other
tcagtcacgtactacacgaccggtgctcgattagctagtcactcaaggaaggcctggagtggattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactggggccaggggaaccctggtcaccgtctcctcaccctccaccaagggcccatcggtctcccctggcaccctcctccaagagcacctctggggcacagcggccctgggctgcccctggtcaaggctacttcctagtacgtgactgagcgggctgggcaaaggcgcatagnnnn

SEQ ID NO: 407490 - DNA, 448 bp, Homo sapiens
  misc_feature: GZ8MTXP02FVBW9.13.77.G11.1.454.CMB.2.raw
  modified_base (357)..(357): a, c, t, g, unknown or other
  modified_base (439)..(448): a, c, t, g, unknown or other
tcagtcacgtactacacgaccggtgctcgatttagctagtcactcaagggaaaggggctggagtggattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggccccgggaaccctggtcaccgtctcctcagcctccaccaaggcccatcggtctccccctggccaccctcctcagagcccacctcnggggcacagcggccctgggctgcctggtcaagggctacttccctagtacgtgactgacgcggggctggcaaggcgacatagnnnnnnnnnn

SEQ ID NO: 407491 - DNA, 511 bp, Homo sapiens
  misc_feature: GZ8MTXP01DLEI2.45.35.D02.1.454.CMB.2.raw
  modified_base (200)..(200): a, c, t, g, unknown or other
  modified_base (349)..(349): a, c, t, g, unknown or other
  modified_base (422)..(422): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccatggcatcccagccaggttcagtggcggtggttgcncagacttcactctcacaatcagcagcctccaaaccctagaagtatttgctagtctaatttacctggttacaanagcgtacagattggccgctcactttcggcggtaagggaccaagggtggagatcgaaaacgacttgaaggctggcaccattccttgttcc

SEQ ID NO: 407492 - DNA, 694 bp, Homo sapiens
  misc_feature: GZ8MTXP01BT82C.45.35.D02.1.454.CMB.2.raw
  modified_base (201)..(201): a, c, t, g, unknown or other
  modified_base (284)..(284): a, c, t, g, unknown or other
  modified_base (297)..(297): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtatagaacatacttggcctggtatcaatacaagcctggccagggtcccccgntccctcactctangtatcgtcctcgacgcgacgggaccctagtcggactactcccgagccgtacggttcagggtcgggtcggggttgggttacggactaacgagtaccttacacttcctacaactaactcgacgtccacgtccctaaccgtaaccgtagtaacgttatttcgacttacgttacttaattaccgtacggtaacaaacgtacggtaccgttaaacgacggttaacgtttccgggacccttaccgttaccgtttaccgggtttaccgggggaccggggaaacggggtaacccggttaaagggggttacggggaaacgtaaaccgttaaaccgaaaaaaccgggttccgttggggtaacggtccgttaacggtaacccgacttacgtttccttaacggtttccc

SEQ ID NO: 407493 - DNA, 507 bp, Homo sapiens
  misc_feature: GZ8MTXP01D5GB5.45.35.D02.1.454.CMB.2.raw
  modified_base (201)..(201): a, c, t, g, unknown or other
  modified_base (351)..(351): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggcccatggcatcccagccaggttcagtggcggtggttgcncgagacttcactctcacaatcagcagcctaccaacctagaagtattttgctagtctattactggttacaacagacgtacagagttggccgtctctactttcggcggaagggaccgaaggtggagatacaaacgacttgtggctgcacatcttgttc

SEQ ID NO: 407494 - DNA, 507 bp, Homo sapiens
  misc_feature: GZ8MTXP01CGZ8B.45.35.D02.1.454.CMB.2.raw
  modified_base (199)..(199): a, c, t, g, unknown or other
  modified_base (283)..(283): a, c, t, g, unknown or other
  modified_base (351)..(351): a, c, t, g, unknown or other
  modified_base (368)..(368): a, c, t, g, unknown or other
  modified_base (438)..(438): a, c, t, g, unknown or other
  modified_base (489)..(489): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttccagcagggccactggcatcccagccaggttcagtggcggtgggtttgcncgagacttcactctcanatcagcagcctccaacctagaagtatttgctagtactattactggtacaacagacgtacagtattggccnctctacgttcggcggtaagggacgaggtggagagtcaaacgacttaggtgntcgcaccatcgttgttcc

SEQ ID NO: 407495 - DNA, 506 bp, Homo sapiens
  misc_feature: GZ8MTXP01DNWXB.45.35.D02.1.454.CMB.2.raw
  modified_base (201)..(201): a, c, t, g, unknown or other
  modified_base (285)..(285): a, c, t, g, unknown or other
  modified_base (350)..(350): a, c, t, g, unknown or other
  modified_base (359)..(359): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttccagcaggccatggcatcccagccaggttcagtggcggtgggttgcncgagacttnactctcacaatcagcagcctccaacctgaagtatttgcagtctattactggtacaacagacgtacagtattcggccgctctacgtttcgggcggaagggaccgaagggtcgagagtacaaacgacttgtggatgcacatcgttgttc

SEQ ID NO: 407496 - DNA, 520 bp, Homo sapiens
  misc_feature: GZ8MTXP01B9PNG.45.35.D02.1.454.CMB.2.raw
  modified_base (345)..(346): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacaagcctggccagggtccccgctcctcatcatgatgcttccagcaggccatggcatcccagccagttcagtggcgtggttgcnngacttcactctcacaatcagcacgcctaccaacctagaacgtatttgctagtctattactggtactaacagcgtacagagttggacccgtctccggtactttcgggcggtaacgggaccgagggtacggagtacgtacgaaacgacttggtggactcgcaccactcgttgttcc

SEQ ID NO: 407497 - DNA, 517 bp, Homo sapiens
  misc_feature: GZ8MTXP01BOMS2.45.35.D02.1.454.CMB.2.raw
  modified_base (212)..(212): a, c, t, g, unknown or other
  modified_base (284)..(284): a, c, t, g, unknown or other
  modified_base (350)..(350): a, c, t, g, unknown or other
  modified_base (352)..(352): a, c, t, g, unknown or other
  modified_base (364)..(364): a, c, t, g, unknown or other
  modified_base (372)..(373): a, c, t, g, unknown or other
  modified_base (375)..(375): a, c, t, g, unknown or other
  modified_base (377)..(377): a, c, t, g, unknown or other
  modified_base (390)..(390): a, c, t, g, unknown or other
  modified_base (392)..(392): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctntcatgcagggccagtcagagtattagaacatacttggcctggtatcaatacaagcctggccagggtccccgntcctcatctatgatgcttccagcaggccactggcatcccagccaggttcagtggcggtggttggcncngacttcactctnacaatcannancncactagaatattntnatactattactagtacaacagacgtacagtagtcggtccgtctctacgttcggtcgggaacgggaacggaagggtaggaggaagtaacaaacgaacgttagtggtcgtcgcacactcgttcgttc

SEQ ID NO: 407498 - DNA, 649 bp, Homo sapiens
  misc_feature: GZ8MTXP01C2SL7.45.35.D02.1.454.CMB.2.raw
  modified_base (200)..(200): a, c, t, g, unknown or other
  modified_base (284)..(284): a, c, t, g, unknown or other
  modified_base (337)..(337): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcactctatgatcgccttcgagcgacgggccctagtcggactactcccgngccgtacggttcaggtcgggtcgggttgggtttcggcaacgacgtaccttcactctacaactaatcagcacgtccctacctaaaccgtagaagttatttcgactacgttacctttaattaccttgggttaaccaaacgtaacggtaccttaaacgaagttacgtttccgggcccttcttacccgtaacggttttccggggacggggtaacgggaaacccgttaagggggttcggaaagtaacgtaaccgaaaaaccggttaacttgggtaacggcgttaacggacccaacccgtttacttccgttcgtttcc

SEQ ID NO: 407499 - DNA, 537 bp, Homo sapiens
  misc_feature: GZ8MTXP01D0G5U.45.35.D02.1.454.CMB.2.raw
  modified_base (202)..(202): a, c, t, g, unknown or other
  modified_base (286)..(286): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggganacagccaccctctcatgcagggccagtcagagtattagaacatacttggcctggtatcaatacaagcctggccagggtccccgntcctcatctatgatgcttccagcaggccatggcatccagccaggtcagtggcggtggttgctcgagacttcactctcacaatcagcacgcctaccaacctagaacgtatttgctagtctattactggtacaacagcgtacagtagttcggaccgctctacgtttcgggcgggtaacggaaccgagggtaggacgtaacgtaacgaaacgttacgttaggtcggtactcggccaccttactcgttcgtttcc

SEQ ID NO: 407500 - DNA, 557 bp, Homo sapiens
  misc_feature: GZ8MTXP01B811T.45.35.D02.1.454.CMB.2.raw
  modified_base (203)..(203): a, c, t, g, unknown or other
  modified_base (216)..(216): a, c, t, g, unknown or other
  modified_base (355)..(355): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggganacagcccaccctntcatgcagggccagtcagagtattagaacatacttggcctggtatcaatacaagcctggccacgggtccccgctcctcatctatgatgcttccagcaggccactggcatcccagccaggttcagtggcggtgggttgcncagtacttcactctacacaatcagcacgcctaccaacctagaagtatttgcagtactattactgtacaaacagcgtaacagtacgttcgccgtctcctaacgtttccgggcgggtaaacggggacccgaaaggggtcggaaggaaacttaacgaaaaccgggacttagggtcggacctggaccaccttatccttggtttccc

SEQ ID NO: 407501 - DNA, 519 bp, Homo sapiens
  misc_feature: GZ8MTXP01C20WX.45.35.D02.1.454.CMB.2.raw
  modified_base (201)..(201): a, c, t, g, unknown or other
  modified_base (285)..(285): a, c, t, g, unknown or other
  modified_base (350)..(350): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttccagcagggccatggcatcccagccaggttcagtggcggtggttgcncagacttcactctcacaatcagcacgcctccaaacctgaacgtatttgcagtctattactggtacaacagacgtacagattggaccgctctacgttcgggcggaacgggaccgaaagggtcggagtaacgtacgaaaacgacttggtggactgccaccatccttgttcc

SEQ ID NO: 407502 - DNA, 511 bp, Homo sapiens
  misc_feature: GZ8MTXP01E3INQ.45.35.D02.1.454.CMB.2.raw
  modified_base (350)..(350): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacaagcctggccagggtccccgctcctcatctatgatgcttccagcaggcccatggcatcccagccaggttcagtggcggtggttgcnagacttcactctcacaatcagcagcctaccaacctagaagtatttgctagtctattactggtacaacagacgtacagacttggaccgctcgtacgtttcgggcggaagggaaccaagggtggagatacgaaacgacgttgtaaggctgcacatcgttgtcc

SEQ ID NO: 407503 - DNA, 630 bp, Homo sapiens
  misc_feature: GZ8MTXP01D77ND.45.35.D02.1.454.CMB.2.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagcctattctgtctctctctccgaggggagacacgccaccctctcatgcgagggccagtcagagtatagaacatactggcctggtatacaatacaacgcctggcccgacgggtccccgctcctcatctatgactgccttcagcgagggcccacgtggcactcccgagccgtaggttcaggtcggtcggttggttgttcgcgagtactacctctactacacaactactacgacacaccgtaccctaaccgtaacgtagtaacgtttgtcaacgtacttaacttacttaacggtacgtaaacgtaaacgacggttactaacgtaacgttacggttcccgggccttacggttaccgttaccgggtccgggaacggggtaaacggaacggtaaggggttagaaacgtaacgttaaacgaaacgttgttcgggctaacgtcgaacttactgttaacgttccg

SEQ ID NO: 407504 - DNA, 503 bp, Homo sapiens
  misc_feature: GZ8MTXP01DXIKO.45.35.D02.1.454.CMB.2.raw
  modified_base (349)..(349): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacagcctggccacgggtccccgctcctcatctatgatgcttcagcaggccactggcatcccagccaggttcagtggcggtggttagcncagacttcactctcacaatcagcacgcctccaacctagaacgtatttgctagtcttattactggtacaacagcgtacagattcggcgctcactttcggcggaaggacgagggtggagtagtcaaacgacttagtggctcgcgaccatcttgttc

SEQ ID NO: 407505 - DNA, 563 bp, Homo sapiens
  misc_feature: GZ8MTXP01CM9G6.45.35.D02.1.454.CMB.2.raw
  modified_base (198)..(198): a, c, t, g, unknown or other
  modified_base (357)..(357): a, c, t, g, unknown or other
tcagacgcgatcgacacgaccggtgctcgatttagcacacgatagttgggtttgggggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtccccgctccctcatctatgatgcttccagcagggccactggcatcccagccaggttcccaggtggcggtgggtttggacacngcttcactctcacaatcagcacgcctaccaacctgaagtactttgctagtcttattactgtacaactagcgtacagtagttcggccgtctcgtacgtttcgggcgggacgggaaccgaagggttggaaggttacgtaacgaaacggttaacgttgggttcggtaaccgtacgccgtacccgtattaccgttcggttcctttaaccg

SEQ ID NO: 407506 - DNA, 547 bp, Homo sapiens
  misc_feature: GZ8MTXP01DL6KR.45.35.D02.1.454.CMB.2.raw
  modified_base (202)..(202): a, c, t, g, unknown or other
  modified_base (358)..(358): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtatagaacatacttggcctggtatcaatacaagcctggccgacgggtccccggctcctcatctatgatgcttcagcaggccatggcactcccagcctaggttcaggtggcggttggggttcgcncgagtactcactctacacatcagcacgcctaccaacctagtaacgtatttcgactaagttcttaacttactgggtactaacgtagtacgtaactagtacgttcggaccgtcttcgtacgttcgggcgggtaacgggtaccgaagggtggagtatacgaaacgcgttagtggctcgcacttatcttgtcc

SEQ ID NO: 407507 - DNA, 523 bp, Homo sapiens
  misc_feature: GZ8MTXP01BJLVZ.45.35.D02.1.454.CMB.2.raw
  modified_base (201)..(201): a, c, t, g, unknown or other
  modified_base (213)..(213): a, c, t, g, unknown or other
  modified_base (356)..(356): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagaacatacttggcctggtatcaatacaagcctggccagggtccccgctcctcatctatgatgcttccagcagggcccacgtggcactcccagccaggttcaggtggcggtgggttgcncagcttcactctacacatcagcacgcctaccaactacgaagtatttgctagtctattactggtacaacgagacgtacagtagtcggccgtctcgtacgttcggcggaacgggacgagggtgagtatacgaaacgttcgttaggtggctcggcacgactcttcgttcc

SEQ ID NO: 407508 - DNA, 548 bp, Homo sapiens
  misc_feature: GZ8MTXP01EKRAA.45.35.D02.1.454.CMB.2.raw
  modified_base (201)..(201): a, c, t, g, unknown or other
  modified_base (213)..(213): a, c, t, g, unknown or other
  modified_base (282)..(282): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtatagaacatactggctggtatcaatacaagcctggccagggtccccgntcctcatctatgatgcttccagcaggccatggcatcccagccaggttcagtggcggtggttgcaacagtacttcactctacactaatcagcacgcctaccaaaccctagaaagtattttacgactagtcttaattacctggttacaaacgtagacgtaacagtagttggccgtctctacgtttcgggcgggaacgggaaccgaaagggtaggaaggaactaacgaaaacgttaacgttggtgggactcgccacactcgttcgttcc

SEQ ID NO: 407509 - DNA, 572 bp, Homo sapiens
  misc_feature: GZ8MTXP01BZ12K.45.35.D02.1.454.CMB.2.raw
  modified_base (201)..(201): a, c, t, g, unknown or other
  modified_base (213)..(213): a, c, t, g, unknown or other
  modified_base (251)..(251): a, c, t, g, unknown or other
  modified_base (283)..(283): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagatatagacatcgtgctgtancaatacaagcctggccacgggtccccgctccncatctatgatgccttccagccgacggggcccagtcggcactcccgagccctaggttccaggtcgggcggggtttggggtttcggacaacgaggtaccttcactcctacaactaactcagcacgtccctaccaacctagaagttatttcgctagtcttattacctggttacaaacgagtacgtaacagtacgttcggcccgtcttccgtacgtttccggggcgggtaacgggaccgttagggtaggagtactacgaaacgacgttggtgcgtcgcaccagtcttcgttcc

SEQ ID NO: 407510 - DNA, 565 bp, Homo sapiens
  misc_feature: GZ8MTXP01EE4I1.45.35.D02.1.454.CMB.2.raw
  modified_base (287)..(287): a, c, t, g, unknown or other
  modified_base (298)..(298): a, c, t, g, unknown or other
  modified_base (352)..(352): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacagccaccctctcatgcagggccagtcagagtatagaacatacgtggctggtatcaatacaagcctggccgacgggtcccccgntcctcatctangatgctcagcaggccacgtggcactccagccaggttcaggtggcggtggttgcnagtacttcactctacactatcagcacgcctaccaactagaacttatttgactagtacttacttacttacggtacaacgtagtacgtaactagtacgttcggcctcgttcgtacggtttcgggacgggtaacgggaacgaaggggtcggaaagtacgtaacgaaacggttacgttgggtcggacgtcggtaccacttacgttcgttcgtttccc

SEQ ID NO: 407511 - DNA, 515 bp, Homo sapiens
  misc_feature: GZ8MTXP01EMJKP.45.35.D02.1.454.CMB.2.raw
  modified_base (353)..(353): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacaagcctggccagggtccccggctcctcatctatgatgcttcagcagggcccatggcatcccagccaggttcagtggcggtgggtttgcncagactcactctcacaatcagcacgcctccaaccctagaacgtattttcgctagtactattactggtcaacagcgtacagattggccgtctctacgtttcggcggtaagggaccgagggtggagatacaaacgacttagtggctcgcgaccatcgttgttcc

SEQ ID NO: 407512 - DNA, 532 bp, Homo sapiens
  misc_feature: GZ8MTXP01A3R0X.45.35.D02.1.454.CMB.2.raw
  modified_base (200)..(200): a, c, t, g, unknown or other
  modified_base (212)..(212): a, c, t, g, unknown or other
  modified_base (284)..(284): a, c, t, g, unknown or other
  modified_base (288)..(288): a, c, t, g, unknown or other
  modified_base (349)..(349): a, c, t, g, unknown or other
  modified_base (432)..(432): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggganacagccaccctntcatgcagggccagtcagagtatagaacatacttggcctggtatcaatacaagcctggccagggtcccccgntccnatctatgatgcttccagcagggccatggcatcccagccaggttcagtggcggtggtttgcncagacttcactctacacaaatcagctagcctaccaacctgaagtattttgctaagtctaattactggtacaactagcgtaacngagttcggccgtctcgtacgtttcggcggaacgggaccaaagggtggaagacgtacgaaacgaacgttggtgggcttcggccacccgattccttgttccc

SEQ ID NO: 407513 - DNA, 594 bp, Homo sapiens
  misc_feature: GZ8MTXP01AIW7Y.45.35.D02.1.454.CMB.2.raw
  modified_base (201)..(201): a, c, t, g, unknown or other
  modified_base (285)..(285): a, c, t, g, unknown or other
  modified_base (290)..(290): a, c, t, g, unknown or other
  modified_base (354)..(354): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctnatctatgatgcttcagcagggccacgtggcatcccagccaggttcaggtggcggtgggttcgcncgagtacttcactctcacatcagcacgcctaccaacctagaacgtatttcgactagttcttacttactcggtacaacgtagaccgttaacagtacgttcggcccgtccttacgtaccgtttcgggccggggtaacgggaacccgttaaggggtacggacgtaaacgttaacgaaaaccggttaacgttcgggtaacggtacgttcggaccctaccgttacttaacccgttggtttaaccc

SEQ ID NO: 407514 - DNA, 629 bp, Homo sapiens
  misc_feature: GZ8MTXP01EB301.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagagtatagaacatactgctggtatcaatacaagcctggccgacgggtccccgctcctcatctatgatgctcagcgaggcccagtgcactcccagccaggttccaggtcgggtcgggttggggtttacgctaacgacgtacttcaaccttctacaactaactcacgcacgtccctaccaaaccgtagaacgttatttcgacctagttaccttaagttactacgggtaactaaacgtacggtacctaagtacgtaacgttccgggaaccttccgtaccgttaaccggtttccggggacgggaacggggtaaaccgttaaggggtacggaaagtaacgttaacgaaaaccgttacgttaggtaacgggccttggaccctaaccgttacttcgttcgttcc

SEQ ID NO: 407515 - DNA, 525 bp, Homo sapiens
  misc_feature: GZ8MTXP01BLL6O.45.35.D02.1.454.CMB.2.raw
  modified_base (199)..(199): a, c, t, g, unknown or other
  modified_base (241)..(241): a, c, t, g, unknown or other
  modified_base (283)..(283): a, c, t, g, unknown or other
  modified_base (351)..(351): a, c, t, g, unknown or other
  modified_base (424)..(424): a, c, t, g, unknown or other
  modified_base (449)..(449): a, c, t, g, unknown or other
  modified_base (501)..(501): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacntactggcctggtatcaatacaagcctggccagggtccccggntccgtcatctatgatgcttccagcaggccatggcatcccagccaggttcaggtggcggtgggtttgcncgagacttcactctacacaatcagcagcctaccaacctagaagttatttgactagtctaattactggtacaanacgtcgtaccagtacttggcccgtntccgtacgtttcggcgggaagggaccagggtggagacgtaacaaacgcttgnggctcggcaccatcttcgttaacc

SEQ ID NO: 407516 - DNA, 518 bp, Homo sapiens
  misc_feature: GZ8MTXP01D8STC.45.35.D02.1.454.CMB.2.raw
  modified_base (201)..(201): a, c, t, g, unknown or other
  modified_base (213)..(213): a, c, t, g, unknown or other
  modified_base (286)..(286): a, c, t, g, unknown or other
  modified_base (354)..(354): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcaagagtattagaacatacttggcctggtatcaatacaagcctggccagggtccccgntcctcatctatgatgcttccagcagggcccatggcatcccagccaggttcagtggcggtgggttgctnagtacttcactctcacaatcagcagcctaccaacctacgaagtattttagctagtactattactggtacaaacgtagacgtacagattcggccgtctctacgttcggcgggaaggaccgaagggtgagagtacgaaacgcgttagtggctgcacactcttgttc

SEQ ID NO: 407517 - DNA, 558 bp, Homo sapiens
  misc_feature: GZ8MTXP01DXY12.45.35.D02.1.454.CMB.2.raw
  modified_base (200)..(200): a, c, t, g, unknown or other
  modified_base (212)..(212): a, c, t, g, unknown or other
  modified_base (287)..(287): a, c, t, g, unknown or other
  modified_base (318)..(318): a, c, t, g, unknown or other
  modified_base (346)..(346): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccgagggganacagccaccctntcatgcgagggccagtcagagtatagaacatacttggctggtatcaaatacaagcctggcccgacgggtccccgntcctcatcatgatgctcagcaggccatgcanccagccagtcagtggcggtggttgcaanagtacttcactctacaactatcagacacgccctaccaactacgaagttatttcgctactacttaacttacgtcgttaacaaacgtacgacgttaaccagtaagttccggacccgtccttaccgtacggtttccgggcgggaacgggaccgaaggggtagagtaataacgaaaacgttcgttggtggctcgacacccttatccgttgttaacc

SEQ ID NO: 407518 - DNA, 566 bp, Homo sapiens
  misc_feature: GZ8MTXP01CEGOA.45.35.D02.1.454.CMB.2.raw
  modified_base (201)..(201): a, c, t, g, unknown or other
  modified_base (285)..(285): a, c, t, g, unknown or other
  modified_base (350)..(350): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttccagcaggccactggcatcccagccaggttcagtggcggtggttgcngagtacttcactctacacatcagcacgcctaccgaactagaagtatttgactagtctattactggtactaacgacgtacgtacagtacgttcgaccgtcttcgtacgtttcgggcgggtaacgggaaccgaagggttacggaagtaacgtacgaaaacggttacgttacgggtaagggtccttaacggcccgtaaccttacttccgttcgtttccc

SEQ ID NO: 407519 - DNA, 565 bp, Homo sapiens
  misc_feature: GZ8MTXP01BT1ED.45.35.D02.1.454.CMB.2.raw
  modified_base (198)..(198): a, c, t, g, unknown or other
  modified_base (261)..(261): a, c, t, g, unknown or other
  modified_base (277)..(277): a, c, t, g, unknown or other
  modified_base (350)..(350): a, c, t, g, unknown or other
  modified_base (412)..(412): a, c, t, g, unknown or other
tcagacgcgatcgacacgaccggtgctcgatttagcacacgatagttgggtttgggggaactgctcagttaggacccagagggaaccatggaagccccagctcagcttctcttcctcctgctactctggctccagagacctccggagaaattgtcttgacacagtctccagccattctgtctctctctccgagggganacagccacctctcatgcaggccagtcagagtatagaacatacttgctggtatcaatacagccnggccacgggtccccgntcctcatctatgatgcttcagcacgggccagtggcatcccagccaggttccaggtggcggtgggttcgacacngtactcactcacacaatcagcacgcctacaactgaacgtatttgcatctatactgtacgaanacggcttaacgagtcgttcgggcctacttccgtaccgtttacgggacccggggaagggaacccggtaaaaggggttccggaagttacgtaaccgaaaacgttaaccgttcgttagggaacttcggaacacgtacttcgttgttaacctttccg

SEQ ID NO: 407520 - DNA, 590 bp, Homo sapiens
  misc_feature: GZ8MTXP01EDSC0.45.35.D02.1.454.CMB.2.raw
  modified_base (364)..(364): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactctggctcccagagacctccggagaaattgtcttgacacagtctccagccattctgtctctctctccgaggggagacagccaccctctcatgcagggccagtcagagtatagaacatactggctggtatcaatacaagcctggccgacgggtccccgctcctcatctatgatgctcagcagggccagtggcactcccagcccgtaggttccaggtgggcgggttgggtttcggacncgagaccttcactctcaacatcagcacgccctaccaaccgtagaaagtattttcgactagttacttaattacctagggtacaaactaggtacgtacaaggtagtttcggacccgtcttaccgtacgtttaccggggcggggaacgggaacgttaaaggggtcggaaagtacgtaaacgaaacggacgttacggtggacctggaccacgttactccgttaagtttcc

SEQ ID NO: 407521 - DNA, 536 bp, Homo sapiens
  misc_feature: GZ8MTXP01BZWOQ.45.35.D02.1.454.CMB.2.raw
  modified_base (200)..(200): a, c, t, g, unknown or other
  modified_base (212)..(212): a, c, t, g, unknown or other
  modified_base (284)..(284): a, c, t, g, unknown or other
tcagacgcgatcgacacgaccggtgctcgatttagcacacgatagttgggtttgggggaggaactgctcagttaggacccagagggaaccatggaagcccagctcagcttctcttcctcctgctactctggctcccagagacctccggagaaattgtcttgacacagtctccagccattctgtctctctctccagggganacagccaccctntcatgcagggccagtcagagtattagaacatacttggcctggtatcaatacaagcctggccagggtccccgntcctcatctatgatgcttcagcaggccatggcactcccagccaggttccaggtcggcggtgggtttcggcaacgtagtacctttcaaccttcgtacaactaaatcagcacgcctaccaacctacgaagtattttcgactagtctacttactcggtacaacacgcgtacagagttcggcctctctacgttcggcggaacgggacgagggtggagagtacgaaacgacttaggtgctcgcacgactcgttgttc

SEQ ID NO: 407522 - DNA, 522 bp, Homo sapiens
  misc_feature: GZ8MTXP01BNY6N.45.35.D02.1.454.CMB.2.raw
  modified_base (200)..(200): a, c, t, g, unknown or other
  modified_base (211)..(211): a, c, t, g, unknown or other
  modified_base (282)..(282): a, c, t, g, unknown or other
  modified_base (287)..(287): a, c, t, g, unknown or other
  modified_base (361)..(361): a, c, t, g, unknown or other
  modified_base (428)..(428): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccacctntcatgcagggccagtcagagtattagaacatacttggctggtatcaatacaagcctggccagggtccccgntcctnatctatgatgcttccagcaggccatggcactccagccaggttcaggtggcggtggttgcaagagtacttcactncaacaatcagcacgcctaccaacctgaatactttgacagtctattactggtacaactagacgtaacngtaagttcggaccgtctcacgtttcggcgggaaggtaaccaagggtcggaagtagtaacgaaacgacgttgtgggtcaagcacatccttgttcc

SEQ ID NO: 407523 - DNA, 579 bp, Homo sapiens
  misc_feature: GZ8MTXP01CYA3G.45.35.D02.1.454.CMB.2.raw
  modified_base (202)..(202): a, c, t, g, unknown or other
  modified_base (402)..(402): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacaagcctggccagggtccccgctcctcatctatgatcgcttccagcgagggcccatggcatcccagccaggtttccaggtcggtcgggtggggtttagggcctaacgacggtactttccaactccgtacacaactcancacgccctaccaacctagaacgttatttcgcttagtcttattacctaggttacaaacgagtacgtacagtacgttggcccgtctccgtacgttcgggacgggtaacggaccgaagggtcggaagtaacacgaaacggttcttgggtaacgctcggactaccgattcgttcgttaacc

SEQ ID NO: 407524 - DNA, 580 bp, Homo sapiens
  misc_feature: GZ8MTXP01C63CQ.45.35.D02.1.454.CMB.2.raw
  modified_base (202)..(202): a, c, t, g, unknown or other
  modified_base (287)..(287): a, c, t, g, unknown or other
  modified_base (455)..(455): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacaagcctggccacgggtccccgntcctcatctatgatgcttcagcaggcccagtggcactcccagcccgtaggttccaggtcgggcgggttggggttacgctaacgagtacctttcgactcacacaatcagcacgcctaccaactagaacgtatttgactagtacttattactggtacaacgtagacgtanagtacgttcggacctctaccgtaccgtttcggggccgggtaacgggtacccgaaggggtcggaacgtaacgtacgaaaacggttacgttaggtggactcggacctacgttacttcgttcgtttcc

SEQ ID NO: 407525 - DNA, 525 bp, Homo sapiens
  misc_feature: GZ8MTXP01ASVNZ.45.35.D02.1.454.CMB.2.raw
  modified_base (201)..(201): a, c, t, g, unknown or other
  modified_base (213)..(213): a, c, t, g, unknown or other
  modified_base (431)..(431): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagaacatacttggcctggtatcaatacaagcctggccagggtccccggctcctcatctatgatgcttccagcagggccagtggcatccccagccaggttccaggtcggcggtgggtttggctaacgagacttcactctcaacatcagcagccctaccaacctgaagtatttgctagtctattactggtacaacngacgtacagtagttcggccgtctctacgtttcggcggaagggaccgaagggtgagatacgaaacgacttcggtaaggctgcaccgatccttgtc

SEQ ID NO: 407526 - DNA, 682 bp, Homo sapiens
  misc_feature: GZ8MTXP01CN2V2.45.35.D02.1.454.CMB.2.raw
  modified_base (202)..(202): a, c, t, g, unknown or other
  modified_base (294)..(294): a, c, t, g, unknown or other
  modified_base (298)..(298): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatgcgagggccagtcagagtaattaagaactatacttggctggtatcaatacaagccgtggccacgggtcccccgntccnctatctatgatcgccttcgaagcgacggcccacgtcggacacgtcccagtccgtaacggttccgagggtcggggtcgggtttggggttacggactaacgacgttaaccgttccaccttctacctaacaaactcacgtaccacgtacccctaacctaaaccgtagtaaacgttatttacgacttaacgtttacttaactttaaccgtacggtaacctaaacgtacgtaccgttaacgacggttacgtttccgggacccgttaccttacccgttaccgggtttaccggggaccggggtaaacggggtaaccggttaaggggtaggaacgtaacgtaacgaaaacggttcgttaggtaacgactcgacacttactcgttcgttaacc

SEQ ID NO: 407527 - DNA, 555 bp, Homo sapiens
  misc_feature: GZ8MTXP01BCRGA.45.35.D02.1.454.CMB.2.raw
  modified_base (199)..(199): a, c, t, g, unknown or other
  modified_base (283)..(283): a, c, t, g, unknown or other
  modified_base (288)..(288): a, c, t, g, unknown or other
  modified_base (348)..(348): a, c, t, g, unknown or other
  modified_base (350)..(350): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctnatctatgatcgcttccagcaggccactggcactccagccagtcagtggcggtgggttgcncngtaccttcactctacaacatcagcacgcctaccaacctagaatatttcgctagtctaatttactagggtacaaactagtacgtacagtacgttcggaccgtctaccgtacgtttcgggcgggtaacgggaaccgagggtggaaggtactaacgaaaccgttagttaggttaacgggctaaggctacccgttcttcgttaacgttc

SEQ ID NO: 407528 - DNA, 592 bp, Homo sapiens
  misc_feature: GZ8MTXP01B2C8A.45.35.D02.1.454.CMB.2.raw
  modified_base (213)..(213): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctntcatgcagggccagtcagagtattagaacatacttggcctggtatcaatacaagcctggccagggtccccggctcctcatctatgatgcttccagcagggcccacgtggcatcccagccacggttcaggtgggcgggtggggtttcggctcgagtacttcactctcacatcagcacgcctaccaacctagaagtattttcgctagtcttattactggtacaacgagacgtacagtagttcggaccgtctccgtacgtttccgggcgggtaacggggtaacccgttaaaggggtacgggaaggtaacgttaaccgaaaaccggttacgttacggtaacgggtcgttaacggacctaccgacgttccgttcgtttaacccg

SEQ ID NO: 407529 - DNA, 694 bp, Homo sapiens
  misc_feature: GZ8MTXP01CHTGY.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagatatagaacatacttggcctggtatcaatacaagcctggcccgacgggtccccgctcctcatctatgatgcttccagcgagggcccacgtcggccactccccaggccctacgggttcaggttggggtcggggtgggggtttacgccaacgtacggtaaccttcgaccttctaccaaacactccgagacctacgtacccctacccgaaacccttagtaaacggttactttttacggaccgttaacgtttaccttaactttaaccgttacggggttacctaaaaccggtacgtacccgttaacgtaggtaacgtttacgggccccgttcttacccgttaccgggtttccggggaccggggtaacggggaacccgttaagggggtacgggttagaaacgttaacgaaaccgggttacgttgggtcggaccgttcggacctacccgattcccgttggtttaaccc

SEQ ID NO: 407530 - DNA, 506 bp, Homo sapiens
  misc_feature: GZ8MTXP01EMGE9.45.35.D02.1.454.CMB.2.raw
  modified_base (350)..(350): a, c, t, g, unknown or other
  modified_base (427)..(427): a, c, t, g, unknown or other
  modified_base (491)..(491): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacaagcctggccagggtccccgctcctcatctatgatgcttcagcagggccacgtggcatcccagccaggttcagtggcgtggttgcncagacttcactctcactaaatcagcagcctaccaacctagaagtatttgctagtctattactagtcaacagcgtaanagtatcgccgtctctacgttcggcggaacggaacgagggtgaagataacgaaacgacgttgtgntgcacactcgttgtc

SEQ ID NO: 407531 - DNA, 645 bp, Homo sapiens
  misc_feature: GZ8MTXP01C90ZF.45.35.D02.1.454.CMB.2.raw
  modified_base (201)..(201): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaactatacgtggcctggtatacaatacaagcctggcccgacgggtccccgctcctcatctatgatcgtctccagccgagggcccacgtcggccacgtcccagcccgtagggttccgagggttcggggtcgggttggggttgacctaacgacgtacttcactctacaacatcagcacgcctaccaaacgtagaacgttatttagctagttcttaacgttactacgggtactaaacgacgtacgtaacagtacgtcggacccgtcttaccgtaccggtttcggggaaccggggaacggggtaaccgttaaagggggtacgaaacggtaaacgtaaaccgaaaacggttaccgttggggttaacgggccttaacggacccgtaacccgttactttccgtttcgttaaccc

SEQ ID NO: 407532 - DNA, 612 bp, Homo sapiens
  misc_feature: GZ8MTXP01D6F4U.45.35.D02.1.454.CMB.2.raw
  modified_base (201)..(201): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagcctattctgtctctctctccgagggganacacgccaccctctcatgcagggccagtcagatattagaactatacttggctggtatcaatacaagcctggccacgggtccccgctcctcatctatgatcgcttaccagcgagggcccacgtcggcactcccagccgtacggttcgagggtcgggtcgggttggggtttacggactaacgacgtacttccaacctctacacaatcgagcacgcctaccaacctagtaacgttatttcgactacgtacttaattactggtaactaagtacgacgtagagtacgttcggcccgtcttaccgtacgtttccgggcggggtaacggtaaccgaagggttaggaagtaacgttaacgaaaacggttacgttgggtaacgggccttgacccgtacgttacttccgttcgtttaaccc

SEQ ID NO: 407533 - DNA, 633 bp, Homo sapiens
  misc_feature: GZ8MTXP01CIAHR.45.35.D02.1.454.CMB.2.raw
  modified_base (358)..(358): a, c, t, g, unknown or other
  modified_base (408)..(408): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggacacagccacctctcatgcagggccagtcagagtattagaacatacttggacctaggtatacaaatacaagcctggccagggtccccgctcctcatctatgatgcttcagtcaggccagtggcatcccagccaggttcaggtggcgtggttcgctaanagtacttcactctacacaatcagcaacgcctaccaaacctagtaaagttntttcgactagtacttaattactaggtactaaacgtagtaccgttaacgaggtaacgttcggggtaaccctcgttaccgttaacggttttaccggggaaccggggaaacggggttaacccgaaagggggttaggaaacgggtaaactaaccggttaaaaaccgttacgttagggttaacgggaccttaacggacccgtaacgttacttcccgttcggttttaaccc

SEQ ID NO: 407534 - DNA, 526 bp, Homo sapiens
  misc_feature: GZ8MTXP01AH29H.45.35.D02.1.454.CMB.2.raw
  modified_base (201)..(201): a, c, t, g, unknown or other
  modified_base (213)..(213): a, c, t, g, unknown or other
  modified_base (350)..(350): a, c, t, g, unknown or other
  modified_base (421)..(421): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagacatactgcctggtatcaatacaagcctggccagggtccccgctcctcatctatgatgctcagcagggccactggcatcccagccaggttcagtgggcggtgggtttggcncagacttcactctcacaatcagcacgcctacaacctgaatactttgactagtctattactgggtacaaacngaccgtaacaggtattcggccgtctcgtacgtttcgggcgggaacgggaccaagggtgaacgtatacgaaacgacgttgtcgggctggccacagtcttcgtttcc

SEQ ID NO: 407535 - DNA, 601 bp, Homo sapiens
  misc_feature: GZ8MTXP01BRXMW.45.35.D02.1.454.CMB.2.raw
  modified_base (202)..(202): a, c, t, g, unknown or other
  modified_base (288)..(288): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactctggctccagagacctccggagaaattgtcttgacacagtctccagccattctgtctctctctccgagggganacagccaccctctcatgcagggccagtcagagtattagaacatactggcctggtatcaaatacaagcctggcccacgggtccccgntcctcatctatgatgcttcagcaggccatggcactccagcctaggttcaggtcgggcgggttggggtttcggcaacgtagtacctttcactctacaacaatcagcacgcctaccaacctagaacgtatttcgactagtcttaattactaggtactaacacgtacgttaacagtacgttcggaccgtcttaccgtacgtttccgggacgggtaacggggaaccgttaaaggggtacggaaagtaacgtaacgaaaaccggttacgttacgggttcgggacttaacggacctaccgttacgttccttcgtttccc

SEQ ID NO: 407536 - DNA, 544 bp, Homo sapiens
  misc_feature: GZ8MTXP01BH59A.45.35.D02.1.454.CMB.2.raw
  modified_base (202)..(202): a, c, t, g, unknown or other
  modified_base (286)..(286): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacaagcctggccagggtccccgntcctcatctatgatgcttccagcaggccagtggcactcccagccgtaggttcaggtgggcggttgggttcggcaacgagtaccttcacttctcaacatcagcacgcctaccaactacgaagttatttcgctagtctattactggtacaacgtgacgtacagtagttcggccgtctcgtacgttcgggacggaacgggaccgaagggtggagaagtacgaaacgcgttggtcggctcggacaccacgtcttcgttaacc

SEQ ID NO: 407537 - DNA, 609 bp, Homo sapiens
  misc_feature: GZ8MTXP01ESIFZ.45.35.D02.1.454.CMB.2.raw
  modified_base (450)..(450): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacagccaccctctcatgcagggccagtcagagtattagaacatacttggcctggtatcaatacaagcctggccagggtccccgctcctcatctatgatgcttcagcaggccagtggcatcccagcctaggttcaggtgggcgggttggggtttacgctaacgtagtaccttcacttctacactaatcagcacgcctaccaactagaagttatttgctagtcttattactggtacaacgagtacgtaanagtacttcggacccgtctaccgtaccggtttcgggacgggtaacggggtaccgttaaaggggtcgggaaacgtaaacgttaaccgaaaaacgggttacgttacggggttaacgggaccttaacggacccgtaaccttacgttccgttcgtttaaccccg

SEQ ID NO: 407538 - DNA, 580 bp, Homo sapiens
  misc_feature: GZ8MTXP01DBZ4V.45.35.D02.1.454.CMB.2.raw
  modified_base (201)..(201): a, c, t, g, unknown or other
  modified_base (357)..(357): a, c, t, g, unknown or other
  modified_base (408)..(408): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacacgccaccctctcatgcagggccagtcagagtatagaacatactggcctggtatcaatacaagcctggccagggtccccgctcctcatctatgatgcttccagcagggcccagtggcactccagcctaggttcaggtggcggttgggttcggcncgtagtactttcactctcaacaatcagcacgcctaccaacctagtaacgtntttacgctagtcttaattactggttacaacagtacataacagtattcggccgtctcgtcgtttcgggcgggtaacgggaccgtaagggcgggtaacgacgttaaacgaaaccggttaacgttaacgggttacgggtccgttacgggacccaacccgtaagttccgtttcccg

SEQ ID NO: 407539 - DNA, 513 bp, Homo sapiens
  misc_feature: GZ8MTXP01BC7NF.45.35.D02.1.454.CMB.2.raw
  modified_base (201)..(201): a, c, t, g, unknown or other
  modified_base (285)..(285): a, c, t, g, unknown or other
  modified_base (362)..(362): a, c, t, g, unknown or other
  modified_base (494)..(494): a, c, t, g, unknown or other
  modified_base (502)..(502): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttccagtcagggcccacgtggcactcccagcctaggttcaggtggcggtggttgctaacgngtacttcactctcacatcagcagcctaccaactagaactatttgactagtctattactggtacaacagacgtacagacttcggcctctcgtacgttcgggcggaaggacagggtgagatacgaacgacttgngctcgacncatcttgttcc

SEQ ID NO: 407540 - DNA, 535 bp, Homo sapiens
  misc_feature: GZ8MTXP01BHS6M.45.35.D02.1.454.CMB.2.raw
  modified_base (201)..(201): a, c, t, g, unknown or other
  modified_base (290)..(290): a, c, t, g, unknown or other
  modified_base (355)..(355): a, c, t, g, unknown or other
  modified_base (366)..(366): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaactatacttggcctggtatcaatacaagcctggccagggtccccgctccncatctatgatgcttcagcagggcccacggcatcccagccaggttccaggtggcggtgggttgcangacttcactcncacatcagcacgcctaccaacctgaacgtatttgactagtctattactcgtacaacgtagacgtacagtagttcggccgtcgtcgtacgttcgggacggaggtaacgaggttaggacgttagtaaccgtaaacgacgttggacggtctggcaccgtgttcgtcgttctc

SEQ ID NO: 407541 - DNA, 560 bp, Homo sapiens
  misc_feature: GZ8MTXP01CYKNK.45.35.D02.1.454.CMB.2.raw
  modified_base (199)..(199): a, c, t, g, unknown or other
  modified_base (356)..(356): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccacgggtccccgctcctcatctatgatgcttcagcaggccacgtggcactcccagccacggttcaggtggcggttgggttcggcncgacgtacttcactcacacaatcagcagcctaccaacctagaacgtatttcgctagtacttattactggtacaacacgtacgtacagtacgttggcccgtctccgtacgttcgggacgggaacggggtaccgaagggtaggaagtaacgtaccgaaaacggttacgttggtaacggacgtcgaccaccttatccgttcgtttcc

SEQ ID NO: 407542 - DNA, 515 bp, Homo sapiens
  misc_feature: GZ8MTXP01AUDC1.45.35.D02.1.454.CMB.2.raw
  modified_base (201)..(201): a, c, t, g, unknown or other
  modified_base (285)..(285): a, c, t, g, unknown or other
  modified_base (290)..(290): a, c, t, g, unknown or other
  modified_base (296)..(296): a, c, t, g, unknown or other
  modified_base (349)..(349): a, c, t, g, unknown or other
  modified_base (357)..(357): a, c, t, g, unknown or other
  modified_base (365)..(365): a, c, t, g, unknown or other
  modified_base (423)..(423): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagatattagaacatacttggcctggtatcaatacaagcctggccagggtcccccgntcctnatctangatgcttccagcaggccatggcactccagccaggttcagtggcggtggttgcnagaccttnactctcanaatcagcacgcctaccactagatatttgcagtcttattctggtacaatagacgttaanacgattcgggaccctcgtcctacgtttcgggcggaacgggtaccgaagggtggagagttacaaaacgcttggtgactgacacgatcttgttc

SEQ ID NO: 407543 - DNA, 565 bp, Homo sapiens
  misc_feature: GZ8MTXP01AOP82.45.35.D02.1.454.CMB.2.raw
  modified_base (201)..(201): a, c, t, g, unknown or other
  modified_base (284)..(284): a, c, t, g, unknown or other
  modified_base (288)..(288): a, c, t, g, unknown or other
  modified_base (294)..(294): a, c, t, g, unknown or other
  modified_base (356)..(356): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacacgccaccctctcatgcgaggccagtcagagtatagaacatacttggctggtatcaatacaagcctggccagggtccccgntccnatctangatgctcagcgacggccacgtggacactccagcctaggttcaggtggcggtggttgcaacgngtacttcactctacactatcagcacgcctaccaactagaacgtatttgactagtcttaattactcggtaacaacgacgtacgttaaccagtagttcggacctctaccgtacgttcgggacgggtaacgggaaccgttaagggtacggagtaacgtaacgaaacgcgttacggcggtacgtcggccaaccttacgttcttcgtttaaccc

SEQ ID NO: 407544 - DNA, 652 bp, Homo sapiens
  misc_feature: GZ8MTXP01EGEVL.45.35.D02.1.454.CMB.2.raw
  modified_base (200)..(200): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccgaggganacacgccaccctctcatcgcgaggccagtcaagtagtatagaactatacgttggctaggtactacaatacaagcctcggaccgacgggtcccccgctcctcatctatgatcgtctcgagcgacggcccagtcgacacgtccagccgtaggtccgaggtcgggtcgggttggggttacgacaacgtacgtaccttctaccttccacaactaactcacgtccaccgtaccctaacctaaccgtagtaacgttactttacgacttacgttacttaattacctacgggtaactaacgtaacgtacgtaacgtacgtacgttcggtacccgtcgtaccgttaccggttccgggacgggttaacgggaaccggttaagggtaaggaaacgtaaacgttaaaccgaaaacggttcgttaggtcgacttaacggacctacttacttcgttaacgtttccg

SEQ ID NO: 407545 - DNA, 585 bp, Homo sapiens
  misc_feature: GZ8MTXP01BRMWO.45.35.D02.1.454.CMB.2.raw
  modified_base (442)..(442): a, c, t, g, unknown or other
  modified_base (514)..(514): a, c, t, g, unknown or other
  modified_base (573)..(573): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacagccaccctctcatgcagggccagtcagagtatagaacatacttggcctggtatcaatacaagcctaggccacgggtccccgctcctcatctatgatgccttcagcgagggcccagtcggcactccccgagcccgtaggttccgaggtcggggtcgggttggggtttacggcctaacgacggtaccttccgaccttccgtacaactaactcacgccacgccctaccaactaggtaatntttacgactagttacttattacctaggtacaaacgtcgacgttacagtagtcggcctctcgtacgttcgggnggaacggacgaaggtcgaagtactacgaaacggttattcggcggtactcggacacgttnttcgttcgttcc

SEQ ID NO: 407546 - DNA, 649 bp, Homo sapiens
  misc_feature: GZ8MTXP01D6R9B.45.35.D02.1.454.CMB.2.raw
  modified_base (203)..(203): a, c, t, g, unknown or other
  modified_base (295)..(295): a, c, t, g, unknown or other
tcagacgcgatcgacacgaccggtgctcgatttagcacacgatagttggggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcatgcagggccagtcagatattagaacatacgttggcctggtatcaatacaagcctggccgacgggtccccgctcctnactctatgactcgcttccgaagcgaacgggccctaacgtcgggacctaacgtccccgaaggtcccgtaaggttccgagggtcggggtaccggggtttgggtttacgggactaacgagtaccttccaacttctcaaacaatcacgacacgcctaccaacctagtaagtatttcgactaacgttctattacctggtaccaaagtacgacgtacgtacgtagttcggcccgtccttacgtacgggtttcggacggggtaacgggtaaccggaaggggtcggaagtaacgtaacgaaaacggttccggttaggtcgggtactaacggccctaaccgttattccggttcgtttaacccg

SEQ ID NO: 407547 - DNA, 703 bp, Homo sapiens
  misc_feature: GZ8MTXP01D8F1L.45.35.D02.1.454.CMB.2.raw
  modified_base (202)..(202): a, c, t, g, unknown or other
  modified_base (257)..(257): a, c, t, g, unknown or other
  modified_base (288)..(288): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcatgcgagggccagtcagagtatagaacatactgctgtatnaatacagcctggccgacgggtcccgctcctnatctatgatgccttaccgagccgacggggccctacgtcggacacctcccgagcccgtacgggttcagggttcggggtcgggggtttggggttacgggacctaacggacgttacccttaccgtacttccctaacaactaaacttccaacggacctaacccggtcccctaacccgtaaacccgttaaggtaaacgtttacgttttacggaccttacgttactttaaacttaccgttacgttaactaaacgtacgtaccgtaacgtagttacgttcgggaccgtaccgttccgttaccggtttccgggacgggggtaaacgggtaaccggttaagggggtcgggaacgtaaacgtaacggttaaaacgttaccgttgggtaacgacgtaacgaccgacttacttcgttcgtttaaccg

SEQ ID NO: 407548 - DNA, 601 bp, Homo sapiens
  misc_feature: GZ8MTXP01CRVNM.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatgcagggccagtcagagtatagaacatacttggctggtatcaatacagcctggccacgggtccccgctcctcatctatgatgccttccagcgagggcccacgtggcactcccagcctacggttcgaggtgggtcgggttggggttcggcaacgacgtacttcactctacaacaatcagcacgcctaccaacctagtacttagtactatacttattatttactacggtaactaagtacgtaccgtaagtacgtcgttaccggtccgtcgttaccggttaccgggtacggggacggggtaacggtaacggggttaggtacgggaagtaaacgtaacgaaacgttgttcggtaacgtcgaacgacctattcttgttccttaaccg

SEQ ID NO: 407549 - DNA, 594 bp, Homo sapiens
  misc_feature: GZ8MTXP01BF3PH.45.35.D02.1.454.CMB.2.raw
  modified_base (199)..(199): a, c, t, g, unknown or other
  modified_base (281)..(281): a, c, t, g, unknown or other
  modified_base (286)..(286): a, c, t, g, unknown or other
  modified_base (361)..(361): a, c, t, g, unknown or other
tcagacgcgatcgacacgaccggtgctcgatttagcacacgatagttgggtttgggggaactgctcagttaggacccagagggaaccatggaagccccagctcagcttctcttcctcctgctactctggctcccagagacctccggagaaattgtcttgacacagtctccagccattctgtctctctctccgagggganacagcccacctctcatgcagggccagtcagagtatagaacatactggcctggtatcaatacagcctggccacgggtccccgntcctnactctatgatcgctcgagcagggccacgtggcatcccagccgaggttccaggtgggtcggtgggttcggacacgngtacttcactctacacatcagcacgacctaccaaccgtagtaaagttactttcgacgtacgttacttaacttacgtcgtaacaacgtaggtactaacgtagtacgtcggccgtacctcgtaccgttcgggacgggacgggtaacgtaagggttggaaagttacgtaaacgtaaacggttacgttcgggttacgggctcggaacctaactcgttacgttcgtttcgttaacccg

SEQ ID NO: 407550 - DNA, 594 bp, Homo sapiens
  misc_feature: GZ8MTXP01DOECL.45.35.D02.1.454.CMB.2.raw
  modified_base (203)..(203): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggcctcccagagacctccggagaaattgtcttgacacagtctccagccattctgtctctctctccgagggganacagccaccctctcatgcagggccagtcagagtatagaacatacttggctggtatcaatacaagcctggccacgggtccccgctcctcatctatgatgcttcagcagggccagtggcactccagccgtaggttcaggtcgggcggttggggttacgctcgtagtaccttcacttcacacaatcagcacgcctaccaacctagacttatttcgctagtacttattactggtacaatagacgtagagtacgtttcggaccgtctaccgtacggtttccggggcgggtaacggggtaaccgttaagggtcgggttaacgaacgtaacgttaaaacggttaccgttagggtaacggtcgttcggacctaccgttacgttcgtttcggtttaaccc

SEQ ID NO: 407551 - DNA, 549 bp, Homo sapiens
  misc_feature: GZ8MTXP01ADBCO.45.35.D02.1.454.CMB.2.raw
  modified_base (201)..(201): a, c, t, g, unknown or other
  modified_base (406)..(406): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagatattagaacatacttggcctggtatcaatacaagcctggccacgggtccccgctcctcatctatgatgcttccagcagggccacgtggcactcccagccaggttcaggtggcgggttggttcggcaacgagtacttcacttctacacaatcagcacgcctaccaacctgaagtntttgctagtcttattactggtcaactagaccgtaacagtgttacggccgtcttcgtaaccgtttcgggcgggtaacgggacccgttaagggtcggaacgataacgaaacgacttcggtaagctcggacaccattcgttgttcc

SEQ ID NO: 407552 - DNA, 587 bp, Homo sapiens
  misc_feature: GZ8MTXP01C98M0.45.35.D02.1.454.CMB.2.raw
  modified_base (201)..(201): a, c, t, g, unknown or other
  modified_base (243)..(243): a, c, t, g, unknown or other
  modified_base (287)..(287): a, c, t, g, unknown or other
  modified_base (291)..(291): a, c, t, g, unknown or other
  modified_base (356)..(356): a, c, t, g, unknown or other
  modified_base (374)..(374): a, c, t, g, unknown or other
  modified_base (401)..(401): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccacctctcatgcagggccagtcagagtattagaacntacttggcctggtatcaaatacaagcctggccacgggtccccgntccnatctatgatgctccagcagggcccagtgcactcccagcctaggttcaggtggcggttggttgacncagtacttcactctacanaatcagcacgcctaccaaactgaagtntttcgactacgtcttaattactaggtactaaacgtacgacgttaacagtacgttcgggacctccgttcgttaaccgtttccggggacgggtaaacgggtaaccggaaaggggttcgggaaataacgtacgaaaaccggttcgttaggttaacggactcggaccacccgttagtttccttgtttccc

SEQ ID NO: 407553 - DNA, 541 bp, Homo sapiens
  misc_feature: GZ8MTXP01CV0HB.45.35.D02.1.454.CMB.2.raw
  modified_base (348)..(348): a, c, t, g, unknown or other
  modified_base (351)..(351): a, c, t, g, unknown or other
  modified_base (364)..(364): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagcccaccctctcatgcagggccagtcagatatagaacatacttggctggtatcaatacagcctggccacgggtccccgctcctcatctatgatgctcagcaggtccatggcatccagccacggttcaggtggcggtggttcgcngancttcactctacanatcagcacgcctaccaacctagtaacgtatttgctagtactattactggtacaacgtacgtacgtacagtcttcggacgtctccgtacgtttccggcgggtaacggaaccgaagggtaggaagtaacgtcgaaaacggttacgttagtaacggactcggacacacttcttaagttcc

SEQ ID NO: 407554 - DNA, 593 bp, Homo sapiens
  misc_feature: GZ8MTXP01BQC95.45.35.D02.1.454.CMB.2.raw
  modified_base (201)..(201): a, c, t, g, unknown or other
  modified_base (285)..(285): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgctcagcagggccagtggcactcccagcctaggttccaggtgggcggtgggtttcgcaacgagtaccttcactctacaactaactcagcacgcctaccaacgtagtaactatttcgactagtcttaattactacggtactaacgtacgacgtaactagtacgttcggcctcgttcgtaaccgtttccggggacgggtaacggggaaccgttaaggggtacggaagtaaacgtaaccgaaaacgttaccgttggtaacgggtactaacggaccctaccttagtccttcgttaacc

SEQ ID NO: 407555 - DNA, 651 bp, Homo sapiens
  misc_feature: GZ8MTXP01BRTEV.45.35.D02.1.454.CMB.2.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacacgccaccctctcatgcagggccagtcagagtattagaacatacttggcctggtatcaatacaagccgtggccgacgggtccccggctcctcatctatgatgcttcagcagggcccagtcggccactcccacgtccgtacggttcgagggtcgggtcggggtttgggttacggcaacgtagtaccttcacttcctacaactaactcagccacgaccctacctaacgtagtaacgtttatttacgacttacgttacttaacgtttacgtacggtaactaaacgtacggtacgtaaacgacggttagttccggacccgtcgttaccgttaccggtttaccggggacggggtaacggggtaaccggttaaaggggtcggaaacggtaacgtaaaccgaaacgttcgttcggtaagtacgtaacgactacgttacttccgttaagtttccc

SEQ ID NO: 407556 - DNA, 699 bp, Homo sapiens
  misc_feature: GZ8MTXP01C5AZK.45.35.D02.1.454.CMB.2.raw
  modified_base (200)..(200): a, c, t, g, unknown or other
  modified_base (290)..(290): a, c, t, g, unknown or other
tcagacgcgatcgacacgaccggtgctcgatttagcacacgatagttgggtttgggtgaggaactgctcagttaggacccagagggaaccatggaagccccagctcagcttctcttcctcctgctactctggctccagagacctccggagaaattgtcttgacacagtctccagccattctgtctctctctccagggganacagccaccctctcatgcgagggccagtcagagtattagaacatactggctggtatcaatacaagctggccgacgggtccccgctccgtnactctagtgatcgccttacgagccgtacggggcccacgtcggacctaaccgtcccgagtccccccgtaaggggtttccgagggttcgggggtccggggtttgggggtttcggcctaacgtaacgggtaaccctttcccgaacttacctacaaacctaaacttaccgaacggtaccaaccgtacccctaacccgtaaaccgttacggtaaacgttacgtttttacggacttacggttactttactttaacgttcgttaacaaacgtacgacgttaacgagtacgttacggtccgtcttacgtaccggtttcgggaacgggtaacgggacggtaacgggttaggaaagtaacgttaacgaaacggttacgtcgggtcgccgtcgaccgttaccgtaacgttcgtttaaccg

SEQ ID NO: 407557 - DNA, 628 bp, Homo sapiens
  misc_feature: GZ8MTXP01EJXZP.45.35.D02.1.454.CMB.2.raw
  modified_base (200)..(200): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaactatactggcctggtatcaaatacaagcctggcccgacgggtcccccgctccctcatctatgatgccttcagcgaggcccacgtggcactcccagccctaggttccaggtcgggtcgggttcggggtttgctaacgagtaccttcactctacataatcagcacgaccctaccaacctagaacgttatttcgactagtcttaattactggtacaacgagtacggtacagtacgttcggaccctctccgttaaccgtttccggggaacggggtaacggggaacccgttaaagggggttcgggaacgtaaacgttaacgaaaaccgggttaccgttaggggtcgggtaccttaacggacccgtaaccgttacgttccttcggttttaaccc

SEQ ID NO: 407558 - DNA, 627 bp, Homo sapiens
  misc_feature: GZ8MTXP01BERZY.45.35.D02.1.454.CMB.2.raw
  modified_base (201)..(201): a, c, t, g, unknown or other
  modified_base (352)..(352): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttcagcagggccagtggcatcccagcctaggttcagtggcggtggttggcncgagacttcactctcacaatcagcacgcctccaactagaacgtatttacgctacgttcttaatttactggttactaaacgtagaccgttaacagtacgtttacgggcccggtcttccgtaccgtttttccggggaccggggaaacgggggtaccccgttaaagggggttcggggaaacggtaacgtaaacccggaaaaacgggttaacccgttggggtaacgggtaccgttaacggacccctaacccggttactttcccggtttcgtttaacccg

SEQ ID NO: 407559 - DNA, 570 bp, Homo sapiens
  misc_feature: GZ8MTXP01CFE2F.45.35.D02.1.454.CMB.2.raw
  modified_base (203)..(203): a, c, t, g, unknown or other
  modified_base (283)..(283): a, c, t, g, unknown or other
  modified_base (287)..(287): a, c, t, g, unknown or other
  modified_base (361)..(361): a, c, t, g, unknown or other
  modified_base (437)..(437): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagatatagaacatacttggctggtatcaatacagcctggccacgggtcccgntccncatctatgatgctcagcagggccacgtggaccatcccgagccgtacggttcaggtcggcgggttgggttacgcncagtcttcactctacacaatcagcacgccctacaacctagaactatttgacgtatcttattactggtactaaacgngacgttacagtacgtcggcctctccgtaccgttcgggacgggtaacgggaaccgttaaggggtcggaacgtaacgtacgaaaacccggttagttcggtgcgtcgaccgtaccttagttccgttgtttaacccg

SEQ ID NO: 407560 - DNA, 608 bp, Homo sapiens
  misc_feature: GZ8MTXP01AZ3DO.45.35.D02.1.454.CMB.2.raw
  modified_base (202)..(202): a, c, t, g, unknown or other
  modified_base (215)..(215): a, c, t, g, unknown or other
  modified_base (296)..(296): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctntcatgcagggccagtcagagtattagaacatacttggcctggtatcaaatacaagcctggccgacgggtccccggctcctnatcatgatgcttcagcagggcccacgtggcactccccagccaggttcagtgggtcgggtgggttgcaacgtagtacttcactctcaacaaactcacgcacgtaccctacctaacctaggtaaactattttcgacttagttaccttattactacgggttacaaacgtagacgttaacgagtacgttcggtccgtacttccgtaccgtttcggggcggggtaacgggaaccggttaaagggtaggaaggaaacgtaacgaaaacggttacgttgggtcggtcgtaacgccaaccttacttaacgttcgttaacc

SEQ ID NO: 407561 - DNA, 632 bp, Homo sapiens
  misc_feature: GZ8MTXP01EWAE2.45.35.D02.1.454.CMB.2.raw
  modified_base (201)..(201): a, c, t, g, unknown or other
  modified_base (204)..(204): a, c, t, g, unknown or other
  modified_base (278)..(278): a, c, t, g, unknown or other
  modified_base (282)..(282): a, c, t, g, unknown or other
  modified_base (296)..(296): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacncgccacctctcatgcagggccagtcagatatagaacatctgctgtatcaatacagctggccgacgggtccccgntccnatctatgatgctcngtcgacggccacgtcggaccacgtccccaggacccgtagggtttccaggggttcggggtcggggtttggggttacgacctaacgacgtacctctactctacaacaatacacgacacgtacctaccaaccgtacgaacgtatttacgtactacgttacttacttactacggtctaacgtacgtacgtacgtagtacgttcggtccgtccgtccgtaccgttccgggtacggggaacggggtaaccggttaaacggggtaggaacggtaaacggttaaaccgttaaacgttaacggtaacggtacggtcgtacggtaccgttacctaacgttcgttcg

SEQ ID NO: 407562 - DNA, 545 bp, Homo sapiens
  misc_feature: GZ8MTXP01EVFQH.45.35.D02.1.454.CMB.2.raw
  modified_base (202)..(202): a, c, t, g, unknown or other
  modified_base (287)..(287): a, c, t, g, unknown or other
  modified_base (292)..(292): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcaggccagtcagagtattagaacatacttggctggtatcaaatacaagcctggccacgggtccccgntcctnatctatgatgctccagcagggcccatggcactcccagccaggttcaggtggcggtgggttgcaagtagacttcactctacaactaaactcagcagccctaccaacctaggaatatttgactagtactattactggtactaaacagacgtacagattcgacctctctacgttcgcgggaaggtaccgagggtggaagagtaacgaaaacgacgttggtaagggctaacggcaccacgttaacgttcgttaaccg

SEQ ID NO: 407563 - DNA, 681 bp, Homo sapiens
  misc_feature: GZ8MTXP01DX7FL.45.35.D02.1.454.CMB.2.raw
  modified_base (205)..(205): a, c, t, g, unknown or other
tcagacgcgatcgacacgaccggtgctcgatttagcacacgatagttgggtttgggggggaggaactgctcagttaggacccagagggaaccatggaagccccagctcagcttctcttcctcctgctactctggctcccagagacctccggagaaattgtcttgacacagtctccagccattctgtctctctctccgaggggganacagcccaccctctcatgcagggccagtcagagtataagaacatactggctggtatacaatacaagcctggacccgacgggtccccgctcctcatctatgatgccttccagtcgacggcccagtcggacaccgtaccaggaccgtaggttcgaggtcggggtcggggttagggttcgacgtaacgtacgtacctttaccacctactacaactaactaccgatccgaccaccctaccgtaaaccgttaaggtaacgtttagtttaccgacgttaacgttacttaaactttaccgttaacgggtaacccttaaacgaccggtaacgttaaccgtagtaaccggttccggtacccgtctacccgttacgggttccgggggacggtaaacggggtacgaaaggggttcggaaacgaacttaacggaaaaccggttgttacggtggtacaaccgtaccacgttacttcgttcgtttaaccc

SEQ ID NO: 407564 - DNA, 573 bp, Homo sapiens
  misc_feature: GZ8MTXP01AVVWT.45.35.D02.1.454.CMB.2.raw
  modified_base (202)..(202): a, c, t, g, unknown or other
  modified_base (291)..(291): a, c, t, g, unknown or other
  modified_base (295)..(295): a, c, t, g, unknown or other
  modified_base (468)..(468): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagagtattagaactatacttggcctggtatcgaaatacaagcctggccacgggtccccgntccnactcatgatgcttcagcgaggcccagtggctactcccagccgtaggttccgaggtcggggtccgggttgggttacggactaacgtaggtaccttcaccttcacaaactactcacgacacgcctaccaactagagttatttgactagtctattactgttacaactagtacgtanagtacgtacggcctctcgtacgttcggcgggaacggacgagggtgaacgtacgtaacgaaaacgttcgttaggtcgacgtcgaccacttattccgttgtaacccg

SEQ ID NO: 407565 - DNA, 689 bp, Homo sapiens
  misc_feature: GZ8MTXP01ASI5O.45.35.D02.1.454.CMB.2.raw
  modified_base (203)..(203): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagtaaattgtcttgacacagtctccagccattctgtctctctctccgagggganacacgccaccctctcatgcagggccagtcagatattagaactatactggcctggtatacaatacaagcctggccacgggtccccgctcctcatctatgactcgccttcgagcgacgggcccacgtcggccactccccgaggccgtacgggttccgagggttcggggtccgggggttggggtttacggacctaacgacggtaccttccaccttcacaaactaactcacgtccaaccgtcccctaaccaaaccgttagtaaacgtttacgttttacgacttacgttactttaacgtttacgtacggggtaactaaacgtacggtaacgtaacgtacgttacggtccggtacccgtacgttccggttaccgggttccggggaacggggaacgggtaaccggttaaagggtaggaacggtaaacgtaaaccggttaaacggttcggttacgggtaacgcgtaaccgaccacgttcttccgttcgtttccc

SEQ ID NO: 407566 - DNA, 516 bp, Homo sapiens
  misc_feature: GZ8MTXP01A2ZE5.45.35.D02.1.454.CMB.2.raw
  modified_base (199)..(199): a, c, t, g, unknown or other
  modified_base (348)..(348): a, c, t, g, unknown or other
  modified_base (421)..(421): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccacgggtccccgctcctcatctatgatgcttcagcaggccagtgcactcccagccaggttcagtggcggtggttgcngagacttcactctacactaatcagcacgcctacaactagaacgtatttgctagtcttattactggtacaacgngacgtacagtagttcggccgtctcgtacgttcggcggaagggaccagggtgaagtagtacgaaacgattggtaagcgtcgctacatcgttgttcc

SEQ ID NO: 407567 - DNA, 643 bp, Homo sapiens
  misc_feature: GZ8MTXP01DV4WX.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatcgcgagggccagtcaagagtattagaactatactggcctggtatcaatacaagcctggccgacgggtccccgctcctcatctatgatcgtcttccagcgagggcccagtcggcactcccagccgtacggttcaggtcgggcgggttgggttcggactaacgagtacctttccactcctacaactaactacagcacgccctacctaacgtagtaacgtatttcgactacgttaccttaattacgttacggggtaactaaacgtaacgtaccgtaacgtaagtacggtttcggacccgttctacccggttacggtttccgggacggggtaacgggtaaccgttaaaggggtacggaacgaaagtaaccgaaaaccggttagttacggtcgggtactcggacctaccacgttcgttcgtttaaccc

SEQ ID NO: 407568 - DNA, 707 bp, Homo sapiens
  misc_feature: GZ8MTXP01EBCD3.45.35.D02.1.454.CMB.2.raw
  modified_base (293)..(293): a, c, t, g, unknown or other
  modified_base (591)..(591): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaattgtcttgacacagtctccagccattctgtctctctctccgaggggacacacgccacctctcatgcgaggccagtcagtatattaagactatacgttgctggtatcgaatacaagcctaggacccgtacgggtcccccgntacccgtctaactctaatcggacttcggtcccttaccgaggccgtacggggccctaacgtcgggacctacgtccccgagtcccgtaggtccgtaggtcgggtacggggttcgggttacgactaacgtagtacctttccgaccttacctacgaaacgtactacgacggacctaccggtacccctaaccgtaaaccgttaggtaactttacgtttcgacttacgttacttaaacgtttacctacggggtaaacctaaacggtacggtaccgttaaagcggttacgttcggggaccccttntccgggttaaccggtttcgggggaaccggggtaaacggtaaccggagggttccgaaagtaaacgttaacgaaacggttcgttaggcgtcaacgtaccacttattcgttaacgttcc

SEQ ID NO: 407569 - DNA, 737 bp, Homo sapiens
  misc_feature: GZ8MTXP01CS47K.45.35.D02.1.454.CMB.2.raw
  modified_base (202)..(202): a, c, t, g, unknown or other
  modified_base (216)..(216): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctntcatcgcgacgggcctagtcgaagtagtaattaacgaactattacgttcggccgttaggtatacaatacaagcctggccaccgggtccccgctcctacattctagtgactcgtcctaccgaggacgacgggcctacgtcggaccctacctccccgagtcccgtaagggttccgtaggggtcggggtccggggtttggggtttaccgggacctaaccggtacgtaccgtttacccacccgttcctaaccgtaacgtaaaccttaccgacggtacccaccggtaccccctaaccgtaacccgtaagttaacgtttacttttcggaccttacgttactttaattacgttacgtaactaacgtacgtacgtaacgtagacgttcggcccgtcgttacccgttcgggttaccgggacggggtaacggaaccggttaggggtacggaacgtaaacgtaaccgaaacggttcgttacgggtaacgtaccttcgggaaccctaccggttacttccgttcgtttaacccg

SEQ ID NO: 407570 - DNA, 699 bp, Homo sapiens
  misc_feature: GZ8MTXP01C7SU1.45.35.D02.1.454.CMB.2.raw
  modified_base (203)..(203): a, c, t, g, unknown or other
  modified_base (294)..(294): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagcctattctgtctctctctccgagggganacacgcccaccctctcatgcgagggccagtcagtagtattaagaacatacttggctggtatcaatacaagcctggcccgacgggtccccgntcctcatctatgatgccttcagcgagggcccagtcggacacgtcccagccctagggttccagggttggggtcggggttgggtttacggactaacgacgtacctttcaccgtctacaaacgtaaactccgagacctacggacccttaacccgtaaacccgttaaggttaaacgttactttttacgggaccttaacgttacctttaaatttacccgttaaggggttaacctaaaccgtaacgtaccgttaacgtagtaacgttcggtacccgtcgttaccgttaccggtttcggggaacggggtaacgggaaccgttaaggggttggaaacggtaacgtaaccgttaaaacggacgttcggtaacggcgttaacggactacgttacgttaacgttcggttttaaccc

SEQ ID NO: 407571 - DNA, 724 bp, Homo sapiens
  misc_feature: GZ8MTXP01AV4Z4.45.35.D02.1.454.CMB.2.raw
  modified_base (202)..(202): a, c, t, g, unknown or other
  modified_base (214)..(214): a, c, t, g, unknown or other
  modified_base (281)..(281): a, c, t, g, unknown or other
  modified_base (286)..(286): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctntcatgcagggccagtcagagtatagacatactgcctgtatcaatacagcctggccacgggtccccgntcctnatctatgatgctcagcgacggccacgtcggcacgtcccgaacgtccgtaaggtttccaggggttcggggtcgggggtttgggtttcggacctccgtaagtaccctttaccacctttaccacaaactaaactccgaacggtacctaaccggaccccttaacccgtaaacccgttaaggtaaacgtttacgtttttacggaccttaacggttacctttaaactttaccgtacggggttaaccaaacggtccgtaaccggttaaacgtacgttacggtttccgggacccgttaccgttaccgtaccgggtttaccggggaacggggtaacgggtaaacccggttaaaggggaggttaaacgtaacgttaaacccggaaacggttaacgttcgggttaacgggaccttaacggaccgaaccttacgtccgttcgtttaaccc

SEQ ID NO: 407572 - DNA, 673 bp, Homo sapiens
  misc_feature: GZ8MTXP01CV61B.45.35.D02.1.454.CMB.2.raw
  modified_base (214)..(214): a, c, t, g, unknown or other
  modified_base (398)..(398): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccgaggggacacacgccaccctntcatgcgaggccagtcagtatatagaactatacgtggcctggtatacaatacgaacgccgtcggccgacggggtccccgctcctacatctatgtatgccttcagccgtaggccctagcggacactcccgaggtcccgtaaggttccaggggttcggggtcggggttgggtttaacggctaacgngtaaccttcgtactctactaacacgtcagcacgacctacctaactagtaagtttacttacgacttacgttacttaacgtttaccgtacggttaacgtaaacgtacgtacggtaaccgtaagtacggtttccggacccgttcgtaccgggttaccggtttaccggggaacgggtaaacgggggaaccgttaaggggagggaacgtaaacgttacggaaaaacggttcggttacgggtcgtacgtcggtacctaccgttattccgttcgtttaaccc

SEQ ID NO: 407573 - DNA, 615 bp, Homo sapiens
  misc_feature: GZ8MTXP01B5JAG.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagcccagctcagcttctcttcctcctgctactctggctcccagagacctccggagaaattgtcttgacacagtctccagcctattctgtctctctctccgagggganacacgccacctctcatgcagggccagtcagatatagactatacgtggctaggtacacaaatacagccgtggaccgacggggtccccgctcctgtatctatgatcgcttcagcgtacggccacgtgaccactcccgagcctaggttcgagggttcgggcggggttgggttcgcaacgtacgtaacttcaacgttcacgaactatcgagcacgcctacaacgtagtaagtattcgacttagtacttattactacgtactaacgacgtacgtacgaagtcgttacggaccgtctaccgtacggtttccggacgggtaacgggtaaccgttaagggtacggaacgtaacgtaaccgttaaaacgttcgttacggtcggtcgttcgacccgtacgttacgttaacgttcgtttaaccc

SEQ ID NO: 407574 - DNA, 755 bp, Homo sapiens
  misc_feature: GZ8MTXP01EVA9N.45.35.D02.1.454.CMB.2.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacacgcccaccctctcatgcgacgggccagtcagagttattagaactatactggctggtatcaatacaagctggccgacgggtccccgctccgtcactctatgatcgcttcagcgacggccacgtcggcactcccgagtccgtacggttcgtaggtcgggtcggggttacggggtttcggacctaacgtacgtaccttccgtacctaccgttacaactaaaattcccgaacgtaccgaccggtaccccttaacccgaaacccgttaaacggtaaacggttttacgttttacgacgttaacgttacctttaaatttaccgttacggggttacctaaacgtacggtacccgtaaacgtacgtacggtttcggtacccgttcgttaccggttaaccggtttccgggggaaccggggtaaacgggggtaaccggttaaacgggggtacgggttaaacgggtaaacgttaaacccgaaaacgggttaccggttacgggtaaccgggcgttaacgggtaaccctaaccggttaactttcccgtttcggttttaaccccg

SEQ ID NO: 407575 - DNA, 614 bp, Homo sapiens
  misc_feature: GZ8MTXP01AZJTZ.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcatgcagggcagtcagagtatagaacatacgtgctgtatcaatacagccgtggccgacgggtccccgctcctcatctatgactgctccagcgacggcccagtcggcacgtcccgagtccgtaggttcaggggttcggggtcgggttggggttaacgctaacgtagtacctttacacttctacaaactactcacgcacgtccctaccaacgtagtaacgttacttcgactacgttacttaattacgtagggtactaacgtacgtacgtacgagtacgtcggtccgtacttccggtaccggtttcggggacgggtaacgggaaccggttaagggtacggaagtaacgtaacgaaacgttcgttaggtcggactaacgactacgttattcgttgttaaccc

SEQ ID NO: 407576 - DNA, 742 bp, Homo sapiens
  misc_feature: GZ8MTXP01AEFCJ.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcgagggccagtcagatatagaactatactggctgtatcaatacaagcctggccacggggtccccactcctcatctatgatcgtccttcagtcgacgggcccacgtcggacctacgtcccgaagcccgtaggttccgagggtcggggtcgggttggggtttacgacctaacgtaggtacccttcgacctcgtacaactaactcgacgtaccaccgtcccgtaacccgtaaccgtaggtaaacgttacgttttacggaccttacggtttaaccttaacgtttaaccgtacggggttaaacctaaaccggtacggttaaccccggttaaagtacggttaaccggttccgggtaacccggttccgttacccgggttaaaccgggttttcccgggggaacgggtaaccgggggtaaacccgttaaagggggttacggaaacgtaaacgttaaccggaaaacggttacggttacgggtaacgggttcaaccgggtaccgtaaccttacgttcccgttaacggtttcccg

SEQ ID NO: 407577 - DNA, 591 bp, Homo sapiens
  misc_feature: GZ8MTXP01A7G1B.45.35.D02.1.454.CMB.2.raw
  modified_base (203)..(203): a, c, t, g, unknown or other
  modified_base (295)..(295): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcatgcgagggccagtcagagtattagaactattacttggcctggtatacaatacaagcctggcccgacgggtccccgntcctcatctatgatcgcttccagcgacggccacgtcggcactcccaggcctagggttccgaggttggggccgggttgggttacgctaacgaggtaccctttcgaacctctacaactaactcacgcacgcctaccaacgtagtaatactttcgactagtcttaacttacgtacggtacaaacgtacgtacgtaacgagtacgttcggaccgtctcgtaacgttcgggacggaacgggaacgagggtaggacgaactaacgaaacgcgttggtaagcgtaacgcacactcgttgttcc

SEQ ID NO: 407578 - DNA, 620 bp, Homo sapiens
  misc_feature: GZ8MTXP01A7IM7.45.35.D02.1.454.CMB.2.raw
  modified_base (197)..(197): a, c, t, g, unknown or other
  modified_base (265)..(265): a, c, t, g, unknown or other
  modified_base (356)..(356): a, c, t, g, unknown or other
tcagacgcgatcgacacgaccggtgctcgatttagcacacgatagttgggtttggggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagaacatacttggcctggtatcaatacaagccnggccagggtccccgctcctcatctatgatgcttcagcagggcacgtggcactcccagccaggttccaggtggcggttgggttggactacgngtcttcgactctacacaatcacgtcacgtcctaccaaccctagaaacgtacttttcgactagttacttaattaacttcgtactaaacaggtaccgtaacgtagtaagttcggtccgtcctcgtaaccggtttccgggacgggtaacggggaaccgtaaaggggttaggggaacgttaacgttaacgaaaaccggttaacgttcgggttacgggtaaccgtcggaaccctaccgtaacgttaccgttcggttaaccgtttaaccg

SEQ ID NO: 407579 - DNA, 651 bp, Homo sapiens
  misc_feature: GZ8MTXP01BCIQG.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcatcgcgagggccagtcagagtattagaactatactggcctggtatacaatacaagcctggccacgggtccccgctcctcatctatgatgctcagcgaggcccagtggcactccgagcctaggttcaggtgggcgggttgggttaggcaacgtagtaccttcacttctacaacatcacgcacgtcctaccaacctagtaacgttatttcgactagttcttaacgtttactaggtactaaacgtacggtacgtaacgtaagtaacgttcgggacccgtcgttaccgtaccgtttaccgggggacccggggtaaacggggaacccgttaaagggggttacgggaaacggtaaacggttaaccggaaaaaccgggttaccgttaggggtcgggtaccgttccggacccgtaaccgttacttccgtttaacggtttccc

SEQ ID NO: 407580 - DNA, 637 bp, Homo sapiens
  misc_feature: GZ8MTXP01EPIW3.45.35.D02.1.454.CMB.2.raw
  modified_base (201)..(201): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggcctcccagagacctccggagaaattgtcttgacacagtctccagccattctgtctctctctccgagggganacagccacactctcatgcagggccagtcagagtattagaacatacttgcctggtatcaatacaagcctggccgacgggtccccggctcctcatcgtatgatcgtcttcagcgtacgggcacgtggcactacccgagaccccctagggtccagggtcggggtccgggttgggggtttcgccgacgtaacggtacctttccgaactttccactaacaaactcaacgcacgcccttacgtaaaccgtagtaagttacttttacggacctaggttaccttaatttacggggttacttaaccgtaacgtacgtacgtaaccaggttactacgggccctcgtaccgtacgtttcgggaacgggtagggaccgtagggacggaagtaacgaacgttaaacgaccgtggttaccggcttacgccgacgttaacttcggtttccg

SEQ ID NO: 407581 - DNA, 664 bp, Homo sapiens
  misc_feature: GZ8MTXP01CDGKN.45.35.D02.1.454.CMB.2.raw
  modified_base (202)..(202): a, c, t, g, unknown or other
  modified_base (404)..(404): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatgcaggccagtcagatatagaactatacgttggctggtatacaaatacaagccgtggccgacgggtccccgctcctcatctatgactcgcttaccagcgacgggcccacgtcggaccactcccagccgtacggtcgaggtcgggtcgggttggttcgactaacgacgtaccttcgactcgacaanactcgacgcacgtccctaaccgtaacgtagtaacgttatttacgacttagttacttattaccgtacggtaactaaacgtacgtaccgttaacgtacggttacgttcggtaccccgttcgttaccggttaccggtttaccggggaacggggtaacgggtaacccggttaaggggtacggaacgtaaacgtaaccgttaaaaccggttcgttacgggtaacggtactccggtacctaccttacgttccgtttcgtttaaccc

SEQ ID NO: 407582 - DNA, 649 bp, Homo sapiens
  misc_feature: GZ8MTXP01DRUM8.45.35.D02.1.454.CMB.2.raw
  modified_base (202)..(202): a, c, t, g, unknown or other
  modified_base (258)..(258): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagcctattctgtctctctctccgagggganacacgcccacctctcatgcgacggcagtcagagtatagaactatacgtgctggtancaatacagctggccgacgggtcccgctcctacactcgtatgatgtccttccgaggcgtacggcccaacgtcggaccacgtcccgagtcccgtaagggttccagggttcgggtcggggttgggtttacggctaacgacgtaccttccaccgttactacgaaacaacgtaccagacctacgacccttaacctaaacctagtaaacttagtttacgacttacgttacttaagtttacctagtacgtaaacgtacgaacgtaacgaaagttcgtcgggtaccctccgttacgttaccggtttcggggaacgggtaacggtaacggttagggtacgaaagtacgttaaacgaaacgttcgttggtcgacgtcgaccacttacgtcttcgttaaccc

SEQ ID NO: 407583 - DNA, 656 bp, Homo sapiens
  misc_feature: GZ8MTXP01BKJPZ.45.35.D02.1.454.CMB.2.raw
  modified_base (201)..(201): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaattgtcttgacacagtctccagccattctgtctctctctccgagggganacacgcccaccctctcatgcagggccagtcagtagtattagacatactggcctggtatcaatacaagccctaggccaacgggtccccggctccctcgatcctatgatcgcttccagcgagggccacgttggactactcccaggcccagggttccaggtcgggtcggggttgggtttacgggacctaagacgtacgttcacttcctcgaaacaacttcaacgccacgccctaccctaactaagggtaaaccttggttttacgaccttaaggtctttaacgtttacctacggggttacaaacgtacggaccgttaactaaacggtctttccgggaacccgttcctaaaccggttcgtttaccgggggacggggtaaccggaacccggttaggggttacgagaccgttaacgaaacgttacgttgtcgggactcggcacggttacttcgttggttccc

SEQ ID NO: 407584 - DNA, 660 bp, Homo sapiens
  misc_feature: GZ8MTXP01DO23I.45.35.D02.1.454.CMB.2.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagcctattctgtctctctctccgaggggacacacgccaccctctcatcgcacgggccagtcagtagtaattagaaactattacgttggacctggtatacgaatacaagcctggcccagggtcccccgactccgtctatctatcgtatcgtccttccagtcgacggggccctagtcggcactcccagcccgtaggtccgaggttcgggcgggttgggtttaacggactcggaatccgttactactacgacatacgtcagccacgccctacctaaacgtagtaaacgttattttacgacttaagtctttaaacttccgttaaggggtaactaaacgtacgtacgttacgaacgtacgttcggtaccgttctaccggtaacgttcggggacccgggtaagggaccgttaagggttaggacgtacgtaaacgaaaccggttagttacggtggaccgttaacggctaacccttagttccttaacggtttccc

SEQ ID NO: 407585 - DNA, 582 bp, Homo sapiens
  misc_feature: GZ8MTXP01E1U3E.45.35.D02.1.454.CMB.2.raw
  modified_base (198)..(198): a, c, t, g, unknown or other
  modified_base (368)..(368): a, c, t, g, unknown or other
tcagacgcgatcgacacgaccggtgctcgatttagcacacgatagttgggtttgggggaactgctcagttaggacccagagggaaccatggaagccccagctcagcttctcttcctcctgctactctggctcccagagacctccggagaaattgtcttgacacagtctccagccattctgtctctctctccaaggganacagcccacctctcatgcagggccagtcagtagtattagaactatacgttggcctaggtatacaatacaagcctggaccgacgggtccccgctcctcatctatgatcgcttcagcacgggcacgtggcactcccagcctaggtccagggtggcgggtggttggaactacngtactcactctacaactatacacgctacgaccctaccaacctagtaaacgtattttcgactagttactaatttacgtcttaacgaaactacgtacgtactaagcgttcggccgtacctcgtacgttcgggacgggaacggaacggaagggttagagttacgaacgaacgacgttgttcggaactcgaactacctagttcttaacgttcttcccg

SEQ ID NO: 407586 - DNA, 758 bp, Homo sapiens
  misc_feature: GZ8MTXP01BUV9D.45.35.D02.1.454.CMB.2.raw
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccgaggggacgacgacgcctaccctctcagtcgcgacgggccagtacgaaggtagtaataacgaactattacgtcggtacctaggtactacgaaatacgaacgccgtcggacccgtacggggtccccgctcctacattctagtgactcgtcctacgagtcggacggcctacgtcggacaccgtcccgagtccgtacggttcgtaggggtcggggtcggggtttggggttacgggacctaacggtaacggtacctttaccaccgtttcctactaaacgtaacctcgaacgtccgaaccgtcccctaaacccgtaaacccgttaaggtaaacgttttacggttttacggaccgttaacttactttaacgtttaaccgttacggggtaaacctaaaccggtacgtaaccggttaaacgaacggttggttacccggtccgttccgttaaccggttccgggttaccggggacggggtaacgggtaacggaacggggttaggaaacgtaaccgtaacgaaaaccggttgttacgggtcgtcgtcggacccaacgttcgtaactttcgtttcccg

SEQ ID NO: 407587 - DNA, 589 bp, Homo sapiens
  misc_feature: GZ8MTXP01EXGZN.45.35.D02.1.454.CMB.2.raw
  modified_base (203)..(203): a, c, t, g, unknown or other
  modified_base (287)..(287): a, c, t, g, unknown or other
  modified_base (323)..(323): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatgcagggccagtcagagtatagaactatacgtgctggtatcaatacaagcctggccagggtccccgntcctcatctatgatgcttcagcagggcccatggcancccagctacggtcaggtgggcgggttggggttagcaacgagtacttcactctacacaatcagcacgccctaccaacctagaacgttattttcgactagttacttaattacttaggggtactaaacgtacgtacgtaacaggtaacgttcggacccgtcttcgtacggtttccggggacgggtaacgggaaccgttaaggggtacgaagaactaacgaaaacgttcgttggtaacggcgtaacgcgtaacttcgtcgttcgttaacc

SEQ ID NO: 407588 - DNA, 665 bp, Homo sapiens
  misc_feature: GZ8MTXP01B4WZO.45.35.D02.1.454.CMB.2.raw
  modified_base (300)..(300): a, c, t, g, unknown or other
  modified_base (592)..(592): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccaggggacacacgccaccctctcatgcgagggccagtcagagtattagaacattactggctggtatcaatacagcctggcccagggtccccgctcctcatccatgatcnctcgagcgagggccactcggcactccgacgccgacggttcgaggtgggtcggtggggtttggcaacgtagtacccttcgactcctacgactaactcaggccacgccctacctaacgtgaaagttctttagctagttcttattaccgtgtacgaaacgtacgtacgtacgtaacgtacgttcggaccccgtctttacccggtacggtttcccggggaacggggtaaccggggtaacccgttaaacgggggttcgggaaacggtaaccgttaaacccgaaaaacccgggggttnttaaaccgggggtcggggtccctttaaggggaaccccaccggttaccgtttaaccgttccgggttttaacccc

SEQ ID NO: 407589 - DNA, 672 bp, Homo sapiens
  misc_feature: GZ8MTXP01EXQ67.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcaggccactcaagagtaattaagaactatacgttggcctaggtatcaaatacaagccgtggccgacgggtccccgctccctcatctatgatcgtcttaccgagccgacgggcccaacgtcggacctacgtccccagtccgtacggttccagggtcgggtcgggttgggtttaacggctaacgacgtaccttcgaccttctacaactactcaagccaacgtccctaccgaacctaggtaacgtttatttacgtagttacttaagttacgtcgttacaaacgtagtacgtaaccgagtacgttccggaccgtcttacgtcggttaccggggacgggaacggggtaaccggtaaggggttcgggaaacgttaacgtaaaccgtaaaacgggttaacgttcgggacggtaaccgtaggaaccggtaaacgtgttaccgtcggtttaaccttaacccg

SEQ ID NO: 407590 - DNA, 503 bp, Homo sapiens
  misc_feature: GZ8MTXP02GCEKY.45.35.D02.1.454.CMB.2.raw
  modified_base (199)..(199): a, c, t, g, unknown or other
  modified_base (345)..(345): a, c, t, g, unknown or other
  modified_base (347)..(347): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagaacatacttggcctggtatcaatacaagcctggccagggtccccgctcctcatctatgatgcttccagcagggccactggcatcccagccaggtcagtgcgtggttgcncngacttcactctcacatcagcagcctccaacctgaacgtatttgcagtctattactgtactaacagacgtacagattggccgtctcacgtttcggcggtacgggaccaagggtcggaagactacgaaacgaactgtaagctacgcaccatcctgttc

SEQ ID NO: 407591 - DNA, 598 bp, Homo sapiens
  misc_feature: GZ8MTXP02G0HNP.45.35.D02.1.454.CMB.2.raw
  modified_base (200)..(200): a, c, t, g, unknown or other
  modified_base (284)..(284): a, c, t, g, unknown or other
  modified_base (451)..(451): a, c, t, g, unknown or other
  modified_base (575)..(575): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatcaagcctggccagggtcccccgntcctcactctatgatcgtcttccgagcgacggccctagtcggacactcccgacgtccgtaacggttccaggtcggggtccggggtttggggtttcggacacgtacgtaccttcaccttcctacaaacaaactcgagaccacgtccctaccaaaccgtagaaacgttntttcgactacgtacttaattctagtacaacgacggtactaacagtagttcggcctactacttacggttcgggacgggacgggtaacgaaggggtcggaaagtacgtaacgaaaacgtagttggnggactcggacactatcttagtcc

SEQ ID NO: 407592 - DNA, 528 bp, Homo sapiens
  misc_feature: GZ8MTXP02I8ES2.45.35.D02.1.454.CMB.2.raw
  modified_base (201)..(201): a, c, t, g, unknown or other
  modified_base (285)..(285): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgntcctcatctatgatgcttccagcagggccagtggcatcccagccaggtcagtggcggttggttgcacgagacttcactctacacaatcagcagcctaccaaacctgaacgtatttgacagtctaattacctgtacaacagcgttaacagtattggcctctcacgtttcgggacggacggggaccaagggtcggaagactacgaaaacgtaactggtaacggctacggctaaccatctagttcc

SEQ ID NO: 407593 - DNA, 525 bp, Homo sapiens
  misc_feature: GZ8MTXP02JILTR.45.35.D02.1.454.CMB.2.raw
  modified_base (201)..(201): a, c, t, g, unknown or other
  modified_base (284)..(284): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatactggcctggtatcaatacaagcctggccagggtccccgntcctcatctatgatgcttccagcagggccactggcagtcccagccaggttcagtggcggttggttggctcgagacttcactctcacaatcagcacgccctccaaccctgaacgtattttcgctacgttcttattactgtacaacagacgtacagtattcgaccgtctctacgtttcggcggacgggaccgagggtcgagactacgaaaacgacgtaggtggctcggacacctatctgttcc

SEQ ID NO: 407594 - DNA, 536 bp, Homo sapiens
  misc_feature: GZ8MTXP02GZWGU.45.35.D02.1.454.CMB.2.raw
  modified_base (200)..(200): a, c, t, g, unknown or other
  modified_base (343)..(343): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtatagacatactggcctggtatcaatacagctggccagggtccccgctcctcatctatgatgcttcagcacggccactggcatcccagcaggttcagtggcggtggttgcncgagacttcactctacacaatcagcacgcctaccaaaccgtagaacgtatttcgactagttctaattactagtacaacagtacgtacagtagttcggccgcttacctacgttcggacggacgggaccgtaagggtcggaagtaacgtacgaaaacgtacgtaggtaacggctacgacacctatcgtcgtttac

SEQ ID NO: 407595 - DNA, 486 bp, Homo sapiens
  misc_feature: GZ8MTXP02GY51B.45.35.D02.1.454.CMB.2.raw
  modified_base (199)..(199): a, c, t, g, unknown or other
  modified_base (344)..(344): a, c, t, g, unknown or other
  modified_base (346)..(346): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtccccgctcctcatctatgatgcttccagcaggccatggcatcccagccaggtcagtggcgtggttgcncngacttcactctcacaatcagcagcctcaacctgaagatttgcagtctattactgtcaacagacgtacagattggccgctcacgtttcggcggagggaccaaaggtggagatcaaaacgactagtgctgcaccatctgttc

SEQ ID NO: 407596 - DNA, 512 bp, Homo sapiens
  misc_feature: GZ8MTXP02FSENX.45.35.D02.1.454.CMB.2.raw
  modified_base (201)..(201): a, c, t, g, unknown or other
  modified_base (213)..(213): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagaacatacttggcctggtatcaatacaagcctggccagggtccccgctcctcatctatgatgcttccagcaggccatggcatcccagccaggttcagtggcggttggttggctcgagacttcactctcacatcagcagcctcaacctgaacgtatttgctagtctattactgtacaacagcgtacagattggcgtctctacgtttcggcggtacgggaccgaaggtcggaagtactacgaaaacgaacgtgtggctggacaccatctcgtttcc

SEQ ID NO: 407597 - DNA, 523 bp, Homo sapiens
  misc_feature: GZ8MTXP02G44GE.45.35.D02.1.454.CMB.2.raw
  modified_base (200)..(200): a, c, t, g, unknown or other
  modified_base (347)..(347): a, c, t, g, unknown or other
  modified_base (354)..(354): a, c, t, g, unknown or other
  modified_base (361)..(361): a, c, t, g, unknown or other
  modified_base (367)..(367): a, c, t, g, unknown or other
  modified_base (371)..(371): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcaggccatggcatcccagccaggtcagtggcgtgtgtgcanagtctcnctcacanatcacncacncctaccactagattagttcacgtacttacttacttactgtaacaagcgtacgtacagtacgttcggcctctacgtacgttcggacggtacggacgtaggcggaagacgtaacgaaacgtagtggtcgtacgtacgaccaactacgtacgtcg

SEQ ID NO: 407598 - DNA, 511 bp, Homo sapiens
  misc_feature: GZ8MTXP02F4X3A.45.35.D02.1.454.CMB.2.raw
  modified_base (199)..(199): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagtatgttagcaccaattagcctggtaccaacagagacctgcccaggctcccaaactcctcatctctggtgtatctaccagggccactggtgtcccagacaggttcaagggcccagtgggtctggggacagagttcactctcaccatcagcggctgcagtctgaagtatttggactttattactgtcagcagtatatcactgccgtacactttcggcggggtacaagcgtggagatacaaacgactgtacggctgcaaccgtatctcgtcttcacttcttcccg

SEQ ID NO: 407599 - DNA, 577 bp, Homo sapiens
  misc_feature: GZ8MTXP02FKKB0.45.35.D02.1.454.CMB.2.raw
  modified_base (201)..(201): a, c, t, g, unknown or other
  modified_base (257)..(257): a, c, t, g, unknown or other
  modified_base (261)..(261): a, c, t, g, unknown or other
  modified_base (263)..(263): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (286)..(286): a, c, t, g, unknown or other
  modified_base (299)..(299): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccaggggganacagccaccctctcatgcagggccagtcagagtatagaacatactgctgtatcaanacancngcaggcccgctcnatntangatnctcagcaggccangcatccagcagtcagtggcggtgggttggcacagacttcactctacaacaaatcagcacgacctacccaaaccctacgaaagtaatttagtactacgtacttaattaacttacgtactaaacaacgacgtaacaagtaagttacggtccgtcctacctaccgtttacgggtaccggggtaacggggaaaccggaaaacgggtaacgggtaaggaaacgtaacgtaaaaaccgaaaacgtaacggtaaggtacgtacgacgaaccaactacttacgtcg

SEQ ID NO: 407600 - DNA, 523 bp, Homo sapiens
  misc_feature: GZ8MTXP02GM6V2.45.35.D02.1.454.CMB.2.raw
  modified_base (198)..(198): a, c, t, g, unknown or other
  modified_base (349)..(349): a, c, t, g, unknown or other
tcagacgcgatcgacacgaccggtgctcgatttagcacacgatagttgggtttgggggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccaggggtccccgctcctcatctatgatgcttcagcagggccatggcactccagccaggttccagtggcgtgggttgcangacttcactctcacaatcagcacgcctaccaacctagaagtatttgactagtactattactgtacaacagctacagtacttggccgtctctacgtttcgggcggtaacggaccgaaggtggagtacgacgaaaacgtaacgtggtacggcgtcgactaccatctcgtctttacg

SEQ ID NO: 407601 - DNA, 517 bp, Homo sapiens
  misc_feature: GZ8MTXP02JO33Y.45.35.D02.1.454.CMB.2.raw
  modified_base (284)..(284): a, c, t, g, unknown or other
  modified_base (353)..(353): a, c, t, g, unknown or other
  modified_base (363)..(363): a, c, t, g, unknown or other
  modified_base (430)..(430): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtatagaacatacttggcctggtatcaatacaagcctggccagggtccccgntcctcatctatgatgcttccagcaggccacgtggcagtcccagccaggttcagtggcggtggttgcagngacttcactntcacaatcagcagcctacaacctagaagtatttgctagtctaattactgtacaacgtagccgttaanagtagtcgcctctacgtacgttcggacggtacggacgaggacgagacgtacgaaacgacgtagaagcgtacgacactactctacgtc

SEQ ID NO: 407602 - DNA, 528 bp, Homo sapiens
  misc_feature: GZ8MTXP02GQIPI.45.35.D02.1.454.CMB.2.raw
  modified_base (201)..(201): a, c, t, g, unknown or other
  modified_base (346)..(346): a, c, t, g, unknown or other
  modified_base (391)..(391): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtccccgctcctcatctatgatgcttccagcaggccactggcatccagccagtcagtggcggtggttgcncagcttcgactctcacaatcagcagcctaccaaccttagactttntcgactacttattattgtactaactagacgtactagacgttcgtacgcgtctacgttcgtcgggacggtaacggacggaggtacgaagtacgaaacgaacgtagtggaacgtcgacgaccactacgttcgtactttc

SEQ ID NO: 407603 - DNA, 547 bp, Homo sapiens
  misc_feature: GZ8MTXP02IS6RS.45.35.D02.1.454.CMB.2.raw
  modified_base (202)..(202): a, c, t, g, unknown or other
  modified_base (297)..(297): a, c, t, g, unknown or other
  modified_base (325)..(325): a, c, t, g, unknown or other
  modified_base (354)..(354): a, c, t, g, unknown or other
  modified_base (525)..(525): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacaagcctggccagggtccccgctcctcatctangatgcttccagcagggcccacgtggcancccagccaggttcagtggcggtggttgcngagacttcactctacacaatcagcacgccctaccaaacctagaacgtatttcgactacgtcttaattaactgtacaactagtacgtaacagtacgttcggccgtactctaacgtttcgggacggtaacggggacctaaagggtcggaaaggactacgaaaacgacgttagnggactgaccacactctacgttc

SEQ ID NO: 407604 - DNA, 523 bp, Homo sapiens
  misc_feature: GZ8MTXP02GU3NK.45.35.D02.1.454.CMB.2.raw
  modified_base (200)..(200): a, c, t, g, unknown or other
  modified_base (346)..(346): a, c, t, g, unknown or other
  modified_base (396)..(396): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttgctggtatcaatacaagctggccaggtcccgctcctcatctatgatgcttccagcagggcccatggcatcccagccaggtcaggtggcggttgggttgcncgagtacttcactctacactatcagcacgcctaccaacccgtgaaacgtntttcgctagttcttaattactgtacaaacagacgttaacagtagttcggacctctcgtacgtttcggcggaacggacctagggacgagactacgaaacgacgtgcggctacgcgacactcgtattcc

SEQ ID NO: 407605 - DNA, 522 bp, Homo sapiens
  misc_feature: GZ8MTXP02GU4PF.45.35.D02.1.454.CMB.2.raw
  modified_base (201)..(201): a, c, t, g, unknown or other
  modified_base (348)..(348): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcaggccactggcatccagccaggtcagtggcggtggttgcncgagacttcactctcacaatcagcacgcctaccaacctgaagtattttgactagtcttaattactagtacaacgtacgacgttacagtagttcggccgtctcgtacgtttcggcggtacggaccgagggtaggacgacgtacgaaacgaactggtgacgtgacacactctcgtc

SEQ ID NO: 407606 - DNA, 534 bp, Homo sapiens
  misc_feature: GZ8MTXP02HCURS.45.35.D02.1.454.CMB.2.raw
  modified_base (199)..(199): a, c, t, g, unknown or other
  modified_base (211)..(211): a, c, t, g, unknown or other
  modified_base (241)..(241): a, c, t, g, unknown or other
  modified_base (287)..(287): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagaacntacttggcctggtatcaatacaagcctggccagggtccccgctccncatctatgatgcttccagcagggcccatggcatcccagccaggttcaggtcgggcggtgggtttggcacagacttcactctacacaactcagcacgcctccaacctgaacgtatttgactagtctattactgtacaagagacgtaacagtacgttcggccgtactccgtacgtttcggacgggtacgggacccgagggtggaagactacgaaaacgacgtgtaacggctcggacacactctcgttcc

SEQ ID NO: 407607 - DNA, 546 bp, Homo sapiens
  misc_feature: GZ8MTXP02GB77O.45.35.D02.1.454.CMB.2.raw
  modified_base (201)..(201): a, c, t, g, unknown or other
  modified_base (243)..(243): a, c, t, g, unknown or other
  modified_base (526)..(526): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacntacttggcctggtatcaatacaagcctggccagggtccccgctcctcatctatgatgcttccagcgacgggccacgtggcactccagcctaggttccaggtggcggggttgggtttcgcacgagacgtttcaccttctacaactaactcagcacgcctaccaacctagaacgtatttcgactagttactatttactgtacaaacgtagacgtaacagtgttacgcgtctcgtacgttcgggcggacggacgaggtcggagactacgaaacgtacgtgaagtcncgacacacgttctacgtttc

SEQ ID NO: 407608 - DNA, 547 bp, Homo sapiens
  misc_feature: GZ8MTXP02JE4GZ.45.35.D02.1.454.CMB.2.raw
  modified_base (201)..(201): a, c, t, g, unknown or other
  modified_base (352)..(352): a, c, t, g, unknown or other
  modified_base (355)..(355): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggcccatggcatcccagccaggtcagtggcggtgggttgcncgngacttcactctcacaatcagcacgccctaccaaccctagaacgtattttgactagtctaattactagtacaacagacgtacagtattggccgctctacgtttcggcgggacgggtaccgaagggtacggagtaacgtacgaaaacggtaacgtaggtaaggacctaggacccactacgttccttacgtttcc

SEQ ID NO: 407609 - DNA, 646 bp, Homo sapiens
  misc_feature: GZ8MTXP02JFF1N.45.35.D02.1.454.CMB.2.raw
  modified_base (203)..(203): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagcctattctgtctctctctccgagggganacacgcccaccctctcatgcgagggccagtcagagtatagaacatacgtggcctggtatcaatacaagcctggccgacgggtccccgctcctcatctatgatcgctccagcgacggccacgtggcactcccagcctacggttcgaggtcggtcgggttgggttcgactacgtacgtaccttcgacctctacaaactataccgacgtcccgacgtaccctaacctaaaccgtagtaaacgttacttttacgactacgttactttaaacttacgttagtacctaacgtacgtacggtaaccaggtaccgttcgggacccgttcgtaccggttaccggtttcgggggacgggtaaaccggggtacgtaagggggtacggaacgtaaacgttaacgaaaacggtaccgttaggaacgtctacggacctactacgttctacggtttcc

SEQ ID NO: 407610 - DNA, 574 bp, Homo sapiens
  misc_feature: GZ8MTXP02G3S0N.45.35.D02.1.454.CMB.2.raw
  modified_base (201)..(201): a, c, t, g, unknown or other
  modified_base (243)..(243): a, c, t, g, unknown or other
  modified_base (357)..(357): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacntacttggcctggatcaatacagcctggccagggtccccgctcctcatctatgatgcttccagcagggcccactggccatcccagccaggttcaggtggcggttgggttgcacgngtacttcactctcaacactcagcacgcctacccaaccgtacgtaacgtattttcgactacgttcttaatttactacgtactaacgacgtacgttaacgagtaagttcggtaccgtcgttcctacgtttcgggacgggtacgggaccgtaagggtacggaaggacgtaacgaaacgaacgtaggtcggactacggaccacgtactacgttacggttcc

SEQ ID NO: 407611 - DNA, 523 bp, Homo sapiens
  misc_feature: GZ8MTXP02GP7KU.45.35.D02.1.454.CMB.2.raw
  modified_base (201)..(201): a, c, t, g, unknown or other
  modified_base (213)..(213): a, c, t, g, unknown or other
  modified_base (356)..(356): a, c, t, g, unknown or other
  modified_base (427)..(427): a, c, t, g, unknown or other
  modified_base (447)..(447): a, c, t, g, unknown or other
  modified_base (505)..(505): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtatagaacatacttggcctggtatcaatacaagctggccacgggtccccgctcctcatctatgatgcttccagcaggccacgtggcactcccagcctaggttcaggtgggcggttgggttgcncgagacttcacctctacaacaatcagcacgcctccaacctgaagtatttgctagtctattactgtacaacngacgtacagtattcggcctntactacgttcgggacggtacggaccgaaaggtcggaagactacgaaaacgagttaggngcacgacactactctctc

SEQ ID NO: 407612 - DNA, 604 bp, Homo sapiens
  misc_feature: GZ8MTXP02IRPFI.45.35.D02.1.454.CMB.2.raw
  modified_base (199)..(199): a, c, t, g, unknown or other
  modified_base (348)..(348): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccaggtccccgctcctcatctatgatgcttccagcagggcccactggcatcccagccaggttcagtgcggtggttgcncagacttcactctcacatcagcacgcctccaacctagaacgtattttcgactagttcttaatttacctagttaccaaacgtacgtacggttaaccaaggtacgtttacgggcccgtacttcgtaaccgttttccggggaccgggtaacggggaacccggtaaaggggttacgggaaggtaaacgtaccgaaaaaccggtacgttacggtaacgggtccgttacggacctaaccgtaacttccgttacggtttaccc

SEQ ID NO: 407613 - DNA, 535 bp, Homo sapiens
  misc_feature: GZ8MTXP02FZV7Z.45.35.D02.1.454.CMB.2.raw
  modified_base (201)..(201): a, c, t, g, unknown or other
  modified_base (213)..(213): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagaacatacttggcctggtatcaatacaagcctggccagggtccccgctcctcatctatgatgcttcagcaggccatggcatccagccaggttcaggtggcggttgggttcggcacgagacctttcgactctacacaatcagcacgcctaccaactagaacgtatttgctagtcttattactgttacaacacgacgtacagtattcggcctcgtctacgtttcggacggtacgggaccgtaagggtcggagaactacgaaaacgacgtaggtaaggctacggacacctatctgttacc

SEQ ID NO: 407614 - DNA, 518 bp, Homo sapiens
  misc_feature: GZ8MTXP02JXT8M.45.35.D02.1.454.CMB.2.raw
  modified_base (352)..(352): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtatagaacatacttggcctggtatcaatacaagcctggccaggggtccccgctcctcatctatgatgcttccagcagggccatggcatcccagccaggttcagtggcggttggttggcncagacttcactctcacatcagcagcctccaacctgaagtatttgactagttctattactgtacaacagacgtacagtattcggcctctctacgttcgggcggtacgggaccgaagggtcggagactacgaaacgaactagtaaggtctacgcaccactctcgttcc

SEQ ID NO: 407615 - DNA, 523 bp, Homo sapiens
  misc_feature: GZ8MTXP02ISL3Q.45.35.D02.1.454.CMB.2.raw
  modified_base (200)..(200): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagaacatacttggcctggtatcaatacaagcctggccaggtccccgctcctcatctatgatgcttccagcagggccactgcatcccagccaggttcagtggcggttgggttagcacgagtacttcactctcaacatcagcacgcctaccaacctgaacgtatttgactagtctattactgtacaactagacgtacagacttggccgctactacgtttcggacggtacgggacctaaagggtcggaagactacgaaacgaactgtaacggctacgacaccatcgttctc

SEQ ID NO: 407616 - DNA, 618 bp, Homo sapiens
  misc_feature: GZ8MTXP02FP629.45.35.D02.1.454.CMB.2.raw
  modified_base (198)..(198): a, c, t, g, unknown or other
  modified_base (210)..(210): a, c, t, g, unknown or other
  modified_base (358)..(358): a, c, t, g, unknown or other
tcagacgcgatcgacacgaccggtgctcgatttagcacacgatagttgggtttgggggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagaacatacttggcctggtatcaatacaagcctggccagggtcccccggctcctcatctatgatgcttccagcacgggccacgtggcactccccagccaggttccagtggcggtgggttgcacngacttcactctcacaatcagcacgccctaccaacctagaagtattttgactagttacttaatttactacgtacaaacgacgtacgttaacgagtaacgttcgggacccgtcgttaccgtaccgttttaccggggacggggtaacggggtaacccgaaaggggttagggaaacggtaacgttaaccgaaaaccggtaaaaccgttgggtacgggaaccgttacggacccgtaccgtaactttccgtacgttcctttacccg

SEQ ID NO: 407617 - DNA, 557 bp, Homo sapiens
  misc_feature: GZ8MTXP02I4EHE.45.35.D02.1.454.CMB.2.raw
  modified_base (198)..(198): a, c, t, g, unknown or other
  modified_base (260)..(260): a, c, t, g, unknown or other
  modified_base (350)..(350): a, c, t, g, unknown or other
  modified_base (391)..(391): a, c, t, g, unknown or other
  modified_base (490)..(490): a, c, t, g, unknown or other
tcagacgcgatcgacacgaccggtgctcgatttagcacacgatagttgggtttgggggaactgctcagttaggacccagagggaaccatggaagccccagctcagcttctcttcctcctgctactctggctcccagagacctccggagaaattgtcttgacacagtctccagccattctgtctctctctccagggganacagccaccctctcctgcagggccaggtaggagtgtcagtaagtacttaggctggtaccaanagaaacctggccaggctcccaggctcctcatccatgatgcatcccaaacgacggggtcccctgggccgtccccaggacctagggttccgnggcaggtcgggtctggggacaggtagttcactctcaccgtnagcagcctggacgctgatgtatttgacttagtttacttctgtcagtcacgtccgttccgccgacgccgtctccgtacggtttccggggcgggggaccgnggggtcggagagtggagacggtacgtggtcggctcgcaccgtgtcgtcgtctctacttcctacccgc

SEQ ID NO: 407618 - DNA, 585 bp, Homo sapiens
  misc_feature: GZ8MTXP02G23TG.45.35.D02.1.454.CMB.2.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtatagaacatacttggcctggtatcaatacaagcctggccagggtccccgctcctcatctatgatgcttccagcagggccactggcactcccagccaggttcagtggcggtgggtttgcacgagacttcactctacacaactcagcagcctaccaacctagaagtattttcgactacgttacttaattacttagttacaaacgtacgtacgttaacaacggtaagttcggcccggtaccttccgtacgtttacgggccgggtaacggggacccgtaaaggggtcgggaaggaacgtacgaaaaccggaaccgtaggtaacggcgtacggacaaccgtacttcgtacgtttcc

SEQ ID NO: 407619 - DNA, 557 bp, Homo sapiens
  misc_feature: GZ8MTXP02J2JXW.45.35.D02.1.454.CMB.2.raw
  modified_base (201)..(201): a, c, t, g, unknown or other
  modified_base (284)..(284): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtccccgntcctcatctatgatgctccagcagggccatggcactcccagccaggttcaggtgggcggttgggttggcacgaggtaccttcactctacacaactcagcacgaccctacccaaccctgaatagttttcgactagtctattactcgtacaacagacgttaacagtacgttcggccgtctccgtacgtttcgggacgggtacgggaccgtaagggacggaagaacgtacgaaaacgtaactaggtcggactacggacacctacttctcgtttacc

SEQ ID NO: 407620 - DNA, 530 bp, Homo sapiens
  misc_feature: GZ8MTXP02GDHR2.45.35.D02.1.454.CMB.2.raw
  modified_base (201)..(201): a, c, t, g, unknown or other
  modified_base (350)..(350): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtccccgctcctcatctatgatgcttccagcagggccactggcatcccagccaggttcagtggcggtggttgcncagacttcactctacacaatcagcacgcctaccaacctagaacgtatttgctagtctattactgtacaacagacgtacagtagttcggccgtctctacgtttcgggcggtaacggggaccgaaagggtcggaaagacgtacgaaaacgtacgtggcggctcggacacctatctcgtttcc

SEQ ID NO: 407621 - DNA, 647 bp, Homo sapiens
  misc_feature: GZ8MTXP02G6EQI.45.35.D02.1.454.CMB.2.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatactggcctggtatcaatacaagcctggccacgggtccccggctcctcatctatgatgcttcagcagggcccagtggcactcccagccaggttcaggttggcgggttgggtttcggcacgtagtacttccactctacaactaactcagccacgaccctaccaacccgtagaactactttagactagttacttacttacttacgtactaaacgtacgtacgtaacaagtaacgttcgggtacccgtccttaccgttaaccggttttaccggggaccggggttaaacggggaaccccggtaaagggggttacgggaaaggtaaacgttaaaccggaaaaaccggtaaacggttaggtaacgggtccgttacggaccgtaaaacccgtctacccgtttggtttaccc

SEQ ID NO: 407622 - DNA, 592 bp, Homo sapiens
  misc_feature: GZ8MTXP02HIFSU.45.35.D02.1.454.CMB.2.raw
  modified_base (201)..(201): a, c, t, g, unknown or other
  modified_base (353)..(353): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccacgtggcatcccagccaggttcagtggcggtggttgcncagcttcactctcacatcagcagcctaccaacctgaagtatttgctagtcttattacttgtacctaacacgacgttaacagtacgttcggaccgtcttaccgtacgtttccgggaccgggtaacggggtaacccgaaagggggttacggaaggtaaacgttaccgaaaaaccggtaaacgttcggttaacgggccgttacgggacccgtaaccgtaacttaccgtttacggtttacccc

SEQ ID NO: 407623 - DNA, 489 bp, Homo sapiens
  misc_feature: GZ8MTXP02JRRYG.45.35.D02.1.454.CMB.2.raw
  modified_base (201)..(201): a, c, t, g, unknown or other
  modified_base (276)..(276): a, c, t, g, unknown or other
  modified_base (346)..(346): a, c, t, g, unknown or other
  modified_base (472)..(472): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagacatacttgcctggatcaatacagctgcaggtcccgntcctcatctatgatgcttccagcagggccactggcatcccagccaggttccagtggcggtggtttgctcngacttcactctcacaatcagcagcctacacctagaacgatttgctagtctatactagtcacagcgtacagattggcgctcactttcggcggtacggaccaaggtcggagatacaaacgaacttggngctcgacacactctctc

SEQ ID NO: 407624 - DNA, 521 bp, Homo sapiens
  misc_feature: GZ8MTXP02IX1EC.45.35.D02.1.454.CMB.2.raw
  modified_base (199)..(199): a, c, t, g, unknown or other
  modified_base (292)..(292): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtatagaacatacttggcctggtatcaatacaagcctggccagggtccccgctcctcatctangatgctcagcaggccagtgcatccagcagtcagtggcggtggttgctcgagtacttcactctacaactatcagcacgccctaccaacctagaagtatttgactagtctattactagtacaacagacgtaacagagttcgccgctctacgtttcggacgggtacggaccgaagggtacggaaagactacgaaaacgactaggtaaggctacggacaccactctacgttcc

SEQ ID NO: 407625 - DNA, 586 bp, Homo sapiens
  misc_feature: GZ8MTXP02HBMEU.45.35.D02.1.454.CMB.2.raw
  modified_base (199)..(199): a, c, t, g, unknown or other
  modified_base (346)..(346): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcaggccagtgcatcccagccagttcagtggcggtggttgcncgagacttcactctcactaatcagcacgcctaccaacctgaagtattttcgctagtcttattactgttacaacagtacgtaacagtattcggccgtacttccgtaccgttttcgggaccggggtaacggggacccgtaaagggggttcgggaaacggtaacgtaaccgaaaaaccgggtaccgtttagggaacggggtaccttcgggacctaacctaacgtttaccgtttcggtttaccc

SEQ ID NO: 407626 - DNA, 545 bp, Homo sapiens
  misc_feature: GZ8MTXP02FT6V5.45.35.D02.1.454.CMB.2.raw
  modified_base (202)..(202): a, c, t, g, unknown or other
  modified_base (287)..(287): a, c, t, g, unknown or other
  modified_base (323)..(323): a, c, t, g, unknown or other
  modified_base (353)..(353): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctgggcagggtcccccgntcctcatctatgatgcttccagcaggccactggcanccagccagtcagtggcggtgggttgcacgngacttcactctacacaaatcagcacgcctaccaaacctagaacgtattttcgctagtcttaattactagtactaacagtacgtaacagtagttcggccgtctcgtacgtttcgggacgggtaacgggaccgaaagggtcggaagtaactacgaaaacgaacgtaggtggactacgaccacctatcgtgttcc

SEQ ID NO: 407627 - DNA, 534 bp, Homo sapiens
  misc_feature: GZ8MTXP02H0J4W.45.35.D02.1.454.CMB.2.raw
  modified_base (201)..(201): a, c, t, g, unknown or other
  modified_base (360)..(360): a, c, t, g, unknown or other
  modified_base (409)..(409): a, c, t, g, unknown or other
  modified_base (454)..(454): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccacgggtccccggctcctcatctatgatcgcttccagcagggccacgtggcatccccagccaggttcagtggcggttgggtttggcncgagacttcactctcaactatcagcacgccctaccaaccctagaacgtntttgctagtctatttactgtacaacagacgtacagagttcggccnctctacgtttcgggcggtacgggaccgtaagggtggagaacgtacgaaaacgacgtgtaaggctagcacactcctagtcc

SEQ ID NO: 407628 - DNA, 534 bp, Homo sapiens
  misc_feature: GZ8MTXP02F8768.45.35.D02.1.454.CMB.2.raw
  modified_base (201)..(201): a, c, t, g, unknown or other
  modified_base (213)..(213): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtatagaacatactggcctggtatcaatacaagcctggccagggtccccgctcctcatctatgatgcttccagcagggcccacgtggcatcccagccaggttcagtggcggttggggttggcacagacttcgactctcaacaatcagcagccctaccaaccctagaacgtatttgctagtcttaattactgttacaactagacgtacagtattggccgtctcgtacgtttcgggcgggtaacggaccgaagggtcggaagacgtacaaaacgaacgtgaaggctcgacaccatccgtagtcc

SEQ ID NO: 407629 - DNA, 526 bp, Homo sapiens
  misc_feature: GZ8MTXP02F6JA2.45.35.D02.1.454.CMB.2.raw
  modified_base (202)..(202): a, c, t, g, unknown or other
  modified_base (349)..(349): a, c, t, g, unknown or other
  modified_base (429)..(429): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccacctctcatgcagggccagtcagagtattagaacatacttggcctggtatcaatacaagcctggccacgggtcccccggctcctcatctatgatgctcagcaggccatggcatcccagccagtcagtggcggtgggttgcncgagcttcactctacacatcagcacgcctaccaactgaacgtatttcgctagttcttattactgtacaacgagtacgtanagtattcggccgtctctacgtttcgggacggtacgggacgaagggtggagtactacgaaaacgtacgtaggtcggctaggaccacgtatacgtgttc

SEQ ID NO: 407630 - DNA, 535 bp, Homo sapiens
  misc_feature: GZ8MTXP02FNME1.45.35.D02.1.454.CMB.2.raw
  modified_base (199)..(199): a, c, t, g, unknown or other
  modified_base (280)..(280): a, c, t, g, unknown or other
  modified_base (284)..(284): a, c, t, g, unknown or other
  modified_base (342)..(342): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggctggtatcaatacaagctggccagggtccccgntccncatctatgatgcttccagcaggccatggcatccagccaggtcagtggcggtggttgcncgagacttcactctacaacaatcagcacgaccctaccaacctacgaagtattttgactagttcttaattactgtacaacagacgtacagtagttcggcgtctcgtacgtttcggacgggaacggaccgaagggtacggaagaacgtacgaaaacgaacgtggtaacggctacgaccacctatcgtacgtttcc

SEQ ID NO: 407631 - DNA, 568 bp, Homo sapiens
  misc_feature: GZ8MTXP02H0IVY.45.35.D02.1.454.CMB.2.raw
  modified_base (199)..(199): a, c, t, g, unknown or other
  modified_base (283)..(283): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccacgggtccccgntcctcatctatgatgcttcagcaggccactgcactcccagccaggttcagtcggcgggttgggttcgctacgagtactttcacttctacactaatcagcacgcctaccaacctacgaaagtatttacgactagtacttaattactgtactaacacgtacgtacagtagttcggaccgtctactacgtttcgggacgggtacgggaaccgaagggtacggaaggaacgtaacgaaaacggtaacgtaggtaacggtacgtacggaccaaccgtactcttacgttcc

SEQ ID NO: 407632 - DNA, 628 bp, Homo sapiens
  misc_feature: GZ8MTXP02FMHBG.45.35.D02.1.454.CMB.2.raw
  modified_base (200)..(200): a, c, t, g, unknown or other
  modified_base (212)..(212): a, c, t, g, unknown or other
  modified_base (239)..(239): a, c, t, g, unknown or other
  modified_base (349)..(349): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagatatagacntactgctgtatcaatacaagctggccagggtccccgctcctcatctatgatgcttccagcgaggcccagtggcactcccagccaggttcagtcggcggttgggttgcagngtacttcgactctacaacaatcagcacgccctaccaaacctagaaacgttattttacggactacgttcttaaactttactacgttacctaaaacgacgtaccgttaacgaagtaacgtttcgggacccgtcttacccgtaacggttttccggggaccgggtaaacgggggtaacccgaaagggggttacgggaaacgtaaacgtaacgaaaaaacccggtaacgttacggttaagggccgtacggaccaacccggtaatttaccggtttacgtttaccg

SEQ ID NO: 407633 - DNA, 531 bp, Homo sapiens
  misc_feature: GZ8MTXP02GBLS9.45.35.D02.1.454.CMB.2.raw
  modified_base (199)..(199): a, c, t, g, unknown or other
  modified_base (348)..(348): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcaggccacgtggcatccagccaggtcagtggcggtgggttgcngagacttcactctcacatcagcacgcctaccaacctgaacgtatttcgactagtcttattactgtacaacagtacgtaacagtacgttcggccgtctcgtacgtttcgggacggtacgggaccgtaagggtcggaagactacgaaaacgactagtaaggctacggcactactacgtcgttacc

SEQ ID NO: 407634 - DNA, 578 bp, Homo sapiens
  misc_feature: GZ8MTXP02IMEXQ.45.35.D02.1.454.CMB.2.raw
  modified_base (202)..(202): a, c, t, g, unknown or other
  modified_base (483)..(483): a, c, t, g, unknown or other
  modified_base (549)..(549): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacagcctggccacgggcccccgctcctcatctatgatgccttccagcgacgggcccacgtggccacgtccccaagccctaggttccgaggtggggcgggttggggtttcggcacgtagtaccttcgaccttcctacaactaatcacgcacgccctaccaaaccgtagaagttatttcgactagtcttaatttacctagtactaacgagtacgtaacagtnttacgggcctctcgtacgttcgggacggaacgggaccgaagggtcggaagaacgtacgaaaacgtntggtaaggctcggacaccattcgtagttc

SEQ ID NO: 407635 - DNA, 545 bp, Homo sapiens
  misc_feature: GZ8MTXP02GQ0LG.45.35.D02.1.454.CMB.2.raw
  modified_base (201)..(201): a, c, t, g, unknown or other
  modified_base (284)..(284): a, c, t, g, unknown or other
  modified_base (295)..(295): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtccccgntcctcatctangatgcttcagcaggccacgtggcactccagccaggttcaggtggtcggtggggttacgcacagtacttcactctacacaatcagcacgccctacaacctagaatatttgactagttctattactgtacaacacggacgttaacgagtaacgttcggcgtaccttcgtaccgtttcggggacggacgggaccgaagggtcgaagacgtacaaaaccgaagtggtcggactcgaccactcttacgtgtttcc

SEQ ID NO: 407636 - DNA, 590 bp, Homo sapiens
  misc_feature: GZ8MTXP02FZXKF.45.35.D02.1.454.CMB.2.raw
  modified_base (201)..(201): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctcggagaaattgtcttgacacagtctccagccattctgtctctctctccgagggganacacgcccaccctctcatgcgagggccagtcagatatagaacatactggctggtatcaatacagctggccacgggtccccgctcctcatctatgatgcttccagcgagggcccacgtggccactcccagcctaggttcaggtggcgggttgggttcgcacgagtacttcacctctacaactaactcagccacgccctaccaaacccgtgaagtatttgctagtcttattactgtacaactagtacgtaacagtagttcggccgtactccgtacgtttcgggcggtaacgggaccgtaaggggtacggaacgtaacgttaccgaaaaaccggtaacgttcgggtaacggtccgtacggaccctaaccgtacgttactttcggtttaaccc

SEQ ID NO: 407637 - DNA, 602 bp, Homo sapiens
  misc_feature: GZ8MTXP02HOX4N.45.35.D02.1.454.CMB.2.raw
  modified_base (202)..(202): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatactggcctggtatcaatacaagcctggccagggtccccgctcctcatctatgatgcttccagcgaggccacgtggcatcccagccaggttccaggtggcgggttgggtttgcacgagtacttcaccgttctacaactaatcagtaccacgccctaccaaccgtagtaaacgtattttacgactacgttacttaatttacttagtacctaaactacgtacgtaacaagtagttcggccgtactacgtacgtttcgggacgggtacgggtaaccgtaaagggtacgggaacgtaacgtaacgaaaacggtaacgttaggtaacggtacgtacggaccaccgtacgttcttacgtttcccg

SEQ ID NO: 407638 - DNA, 518 bp, Homo sapiens
  misc_feature: GZ8MTXP02IT04M.45.35.D02.1.454.CMB.2.raw
  modified_base (355)..(355): a, c, t, g, unknown or other
  modified_base (370)..(370): a, c, t, g, unknown or other
  modified_base (380)..(380): a, c, t, g, unknown or other
  modified_base (419)..(419): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagcccaccctctcatgcagggccagtcagagtattagaacatacttggcctggtatcaatacaagcctggccgacgggtccccgctccctcatctatgatgcttccagcaggccacgtgcactccagcctaggtcagtggcggttggttgcncgagtacttcactcncaacaatcancacacacaactagatattatatatatattactatactanagtactacagtagtcgcgctcgtacgtcgtacggacggacggaaggtacggagaacgtaacgaaacgaacgtagtaagcgtacgacactactcgtactc

SEQ ID NO: 407639 - DNA, 513 bp, Homo sapiens
  misc_feature: GZ8MTXP02H0AZS.45.35.D02.1.454.CMB.2.raw
  modified_base (285)..(285): a, c, t, g, unknown or other
  modified_base (349)..(349): a, c, t, g, unknown or other
  modified_base (351)..(351): a, c, t, g, unknown or other
  modified_base (416)..(416): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccgaggggagacagcccaccctctcatgcagggccagtcagagtattagaacatactggcctggtatcaatacaagcctggccagggtccccggntcctcatctatgatgctcagcaggccagtggcatcccagccaggttcagtggcggtggttggcngngacttcactctcacaatcagcagcctaccaacctgaagtatttgctagtctagttactgtacaangacgtacagtacttggccgtctcgactttcggcggagggaccaagggtgaggactacgaaaacggactaggtggactaggaccacgactcttacgtc

SEQ ID NO: 407640 - DNA, 589 bp, Homo sapiens
  misc_feature: GZ8MTXP02F66J3.45.35.D02.1.454.CMB.2.raw
  modified_base (199)..(199): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtcccccggctcctcatctatgatgcttccagcagggcccactggcactcccagccaggttcagtggcggtgggttgcagagacttcactctacacaatcagcacgcctaccaacctagaacgtatttgactagtcttattactgtacaacacgtacgtacaagtagttcggccgtacttaccgtaccgtttccggggacgggtaacggggaacccggtaaaggggttacgggaaacgtaacgttaaccgaaaaaccggtaaccgttagggtaacggtcgtacggaccaaccgtaacttccttacggtttacccg

SEQ ID NO: 407641 - DNA, 605 bp, Homo sapiens
  misc_feature: GZ8MTXP02I66CW.45.35.D02.1.454.CMB.2.raw
  modified_base (201)..(201): a, c, t, g, unknown or other
  modified_base (285)..(285): a, c, t, g, unknown or other
  modified_base (349)..(349): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagaacatacttggcctggtatcaatacaagcctggccagggtcccccgntcctcatctatgatgctccagcagggccagtggcactccagccagttcagtggcggtggttgcncgagtacttcactctacaacaatcagcacgccctacaacctagaacgtattttcgactagttacttaattactagttaccaaacgtacgtaccgtaaacacgtacgtttacgggcccgtacttacgtaccggtttcgggaccgggtaacggggaacccgtaaaggggttacgggaaagtaaacgttaaccgaaaaaccggtaccgttagggtaacggtacgttacggaccaaccctacgttccgttacgtttaccc

SEQ ID NO: 407642 - DNA, 577 bp, Homo sapiens
  misc_feature: GZ8MTXP02JVJ6U.45.35.D02.1.454.CMB.2.raw
  modified_base (201)..(201): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccacgggtccccggctcctcatctatgatgtcttccagcgacgggccctacgtggcactccccgagtcccaggtttccaggtcgggtcgggttggggtttcggcacgagtaccttcactctacactaatcagcacgccctacccaacctagaacgtattttacgctagttcttattactgtacaacagtaccgtacagtagttggccgtctctacgtttcgggacggacgggaccgaagggtcggaagtacgtaaccgaaaacgtaacgtaggtcggacgtacggaccaccgacttctcgtttcc

SEQ ID NO: 407643 - DNA, 498 bp, Homo sapiens
  misc_feature: GZ8MTXP02F4T9M.45.35.D02.1.454.CMB.2.raw
  modified_base (201)..(201): a, c, t, g, unknown or other
  modified_base (352)..(352): a, c, t, g, unknown or other
  modified_base (414)..(414): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccactggcatccagccagtcagtggcggtggttggcacgngacttcactctcacatcagcacgcctacaacctgaagtatttgctagtctattactgtacanagcgtacagattcggacctctctacttcggcggtacggaccgagggtgagactacgaaacgtactggtgctgcacactcgtatc

SEQ ID NO: 407644 - DNA, 561 bp, Homo sapiens
  misc_feature: GZ8MTXP02FUKPW.45.35.D02.1.454.CMB.2.raw
  modified_base (202)..(202): a, c, t, g, unknown or other
  modified_base (285)..(285): a, c, t, g, unknown or other
  modified_base (531)..(531): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccacctctcatgcagggccagtcagagtatagaacatacttggcctggtatcaatacagcctggccagtcgtccccggntcctcatctatgatgcttccagcacgggccacgtggcactcccgagccccaggttccaggtggcgggttgggtttggctacgagtaccttcacgttctacaactaactcacgcacgcctaccaacctagaacgtatttgactagttacttattactcgtacaacgagctacgagtacgtcggctctcgtacgtttcggacgggtacgggaaccgaagggtacggagaacgtacgaaaacgtaacgnggtacgacgtacgacctaacctatcttacg

SEQ ID NO: 407645 - DNA, 543 bp, Homo sapiens
  misc_feature: GZ8MTXP02G1WEE.45.35.D02.1.454.CMB.2.raw
  modified_base (201)..(201): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtccccgctcctcatctatgatgcttccagcagggcccatggcatcccagccaggttcagtggcggttgggttgcacgagacttcactctacaacatcagcacgccctaccaacctagaagtattttgactagttacttattactagtacaacagacgtacagtagttcggcctcttcgtacgtttcggacggacgggaccgaagggtacggaagacgtaacgaaaacgtacgtagtaacggctacgaccacctactcgtacgttcc

SEQ ID NO: 407646 - DNA, 642 bp, Homo sapiens
  misc_feature: GZ8MTXP02J3EY5.45.35.D02.1.454.CMB.2.raw
  modified_base (201)..(201): a, c, t, g, unknown or other
  modified_base (286)..(286): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcagggccagtcagagtatagaactatacttggcctggtatcaatacaagcctggccagggtccccgntcctcatctatgatcgcttccagcgtacgggccacgtcggacacgtccccagtcccgtaggttccgaggtcggggcgggtttgggttcggactacgacgtaaccttcacttcctacaactactcaacgcaacgtccctacccaacctggaattagttttcgaccttagttacttaacttactgtacactaggtacccgttaagagtacgtttcgggaccctacgttaccgtaacgtttccgggggacggtaacgggtaaccgtaaggggtcggaaagtaacgtaaccgaaaacggtaacgttacgggtcgggaaccttacggacccttaaacggactttaccgttacgtttacccg

SEQ ID NO: 407647 - DNA, 582 bp, Homo sapiens
  misc_feature: GZ8MTXP02JQBLG.45.35.D02.1.454.CMB.2.raw
  modified_base (199)..(199): a, c, t, g, unknown or other
  modified_base (350)..(350): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctgtatcaatacagcctggccacgggtccccgctcctcatctatgatcgctcagcaggccacgtggcactcccagccaggttcaggtggcggtgggttgcncgagacttcactctacacactcagcacgccctaccaaccgtagaacgtacgttttacgactacgtacttactttaccgtcgttaaccaaacgtacgtacgtaacgtaagtacgttcggacccgtctccgtacgttaccgggacgggtaacgggtaccggaaagggtacggaagtaacgtaacaaaacggaacgttcgaacggcgtacggacctaccgtactccgtacttccc

SEQ ID NO: 407648 - DNA, 532 bp, Homo sapiens
  misc_feature: GZ8MTXP02I9N95.45.35.D02.1.454.CMB.2.raw
  modified_base (201)..(201): a, c, t, g, unknown or other
  modified_base (355)..(355): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggctcctcatctatgatgcttccagcagggcccatggcatcccagccagttcagtggcgtgggttgcacgngacttcactctcacaatcagcagcctcaacctgacgtatttgctagtctattactgtactaacgagacgtacagtattcggcccgctcctacgtttcggcgggaacggacccgaagggtcggaagtagtacgaaaacgacgttaggtaaggccgtaggccaacctagtctacgttcc

SEQ ID NO: 407649 - DNA, 521 bp, Homo sapiens
  misc_feature: GZ8MTXP02F4YK2.45.35.D02.1.454.CMB.2.raw
  modified_base (201)..(201): a, c, t, g, unknown or other
  modified_base (353)..(353): a, c, t, g, unknown or other
  modified_base (434)..(434): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcaggccactggcatccagccaggttcaggtggcggttgggttcgcncgagtacttcactcctacaacatcagcacgcctccaaccgtgaagtatttgactagttctattactgtacaacagacgtanagtagttcggcctctcacgtttcggcggacggtaccgaggtcggagacgtacgaaaacgtacgtagtgcgtacgacacactctgtcc

SEQ ID NO: 407650 - DNA, 576 bp, Homo sapiens
  misc_feature: GZ8MTXP02IN8GQ.45.35.D02.1.454.CMB.2.raw
  modified_base (199)..(199): a, c, t, g, unknown or other
  modified_base (352)..(352): a, c, t, g, unknown or other
  modified_base (423)..(423): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaaatacaagcctggccagggtcccccggctcctcatctatgatgcttccagcagggccactggcatcccagccaggtcagtggcggtgggttgcncgagtacttcactctcaacaatcagcacgcctaccaaccctgaagtatttgctagtctattactgtacaanagcgttaacagtacttcgggcctactcgtaaccgtttcggggaccggtaacggggtaaccgtaaaggggttccggaaaggaacgttaccgaaaaaccgtacgttaggtaacggtcgttacggtaccaaaaccgtacttccgttcggtttaccc

SEQ ID NO: 407651 - DNA, 535 bp, Homo sapiens
  misc_feature: GZ8MTXP02GY6HH.45.35.D02.1.454.CMB.2.raw
  modified_base (203)..(203): a, c, t, g, unknown or other
  modified_base (426)..(426): a, c, t, g, unknown or other
  modified_base (434)..(434): a, c, t, g, unknown or other
  modified_base (443)..(443): a, c, t, g, unknown or other
  modified_base (525)..(525): a, c, t, g, unknown or other
tcagacgcgatcgacacgaccggtgctcgatttagcacacgatagttggggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctaggtatacaatacaagcctaggccacgggtccccgctcctctatcgtatgatgcttcagtcagggccagtggcactccagcacggttcagtcggcggttgggttacgcacgtagacttcactctacaacatcagcacgcctacacctagaagtatttgctagtctattacngtacaacngtaccgtanagtgtcgacctctacgtacgtacggacggtacggacgaggtcggaatacgtaacgaaacgacgttgcgtcgtacgacctacncttcgtcgtc

SEQ ID NO: 407652 - DNA, 571 bp, Homo sapiens
  misc_feature: GZ8MTXP02JFATJ.45.35.D02.1.454.CMB.2.raw
  modified_base (201)..(201): a, c, t, g, unknown or other
  modified_base (364)..(364): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggctcctcatctatgatgcttccagcacgggccacgtggcactccccagccaggttcaggtggcggttgggttggcacgngacttcactctcacatcagcacgcctaccaacctgaacgtattttgactagttcttattacctagtactaaacagtacgtacgagtacgttcggaccgtcttaccgtacgtttccgggacgggacggggtaccgaaagggtcggaagaacgttaccgaaaacggtaacgtcggtaaggtcgtacggacaccgtacttcgtacgtttc

SEQ ID NO: 407653 - DNA, 617 bp, Homo sapiens
  misc_feature: GZ8MTXP02I2J9E.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtatagaacatactggctggtatcaatacaagcctggccacgggtccccgctcctcatctatgatgctcagcgacggccacgtgcatcccagccaggttcaggtggcggttgggttcgcacgagtacttcactctacaactactcagcacgccctaccaaccgtagtaacgtatttcgactagtcttaagttactgtacctaactacgtacgttaaccgagtacgtcggaccgtcttaccgtacgtttccggggacgggtaacgggtaccggtaaaggggttcgggaaacggtaacgttaaccggaaaaaccggtaaccggttaggggtaacggtccgttacgggaaccctaaccggttaacttccgtttaacggttttacccg

SEQ ID NO: 407654 - DNA, 550 bp, Homo sapiens
  misc_feature: GZ8MTXP02JKTS0.45.35.D02.1.454.CMB.2.raw
  modified_base (200)..(200): a, c, t, g, unknown or other
  modified_base (242)..(242): a, c, t, g, unknown or other
  modified_base (394)..(394): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagagtatagaacntactggcctggtatcaatacaagcctggccacgggtccccgctcctcatctatgatgcttcagcaggccagtggcatcccagccaggttcaggtcggcgggttgggttagcacgagtacttcactctacactaatcagcagcctccaacctnaagtatttagctagtacttattactgtacaacgagtacgtaactagtacgttggccgtctacgtacgtttcgggacggtaacgggaccgtaagggtacggaagtaacgtaccgaaaacgtacgtagcggtacgtcgactaccgattcgtcgtttac

SEQ ID NO: 407655 - DNA, 586 bp, Homo sapiens
  misc_feature: GZ8MTXP02FNF7F.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtatagaacatactggctggtatcaatacaagcctggccgacgggtccccgctcctcatctatgatgctcagcgacgggccagtggcacgtcccagcctaggttcaggtcggggcgggttggggtttcggactcgacgtctttcaccttctacaactaatcagccacgccctaccaaacccgtagaaagttattttcgactacgttacttaattacctagttaacaaacgtacgtacgtaacacgtagttcggaccgtctcgtacgttcgggacggacgggacgagggtacggaagtactaacgaaaacgtacgtaggtaacggcgtacgacctaccgtatcgtacgtttacc

SEQ ID NO: 407656 - DNA, 757 bp, Homo sapiens
  misc_feature: GZ8MTXP02IIC8X.45.35.D02.1.454.CMB.2.raw
  modified_base (202)..(202): a, c, t, g, unknown or other
  modified_base (298)..(298): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtcctccagcctattctgtctctctctccgagggganacacgccaccctctcatgcgagggccagtcagagtatagaactatacgttggcctggtatcaatacaacgcctggaccgacggggtccccgctccncatctatgtatcgccttccgagaccgtacgggccctagtcggacctacgtccccgaggtaccctacgggtttccgaggggttcggggtaccggggtttgggggtttacggaccgtaccggtacggtaccctttccgaacccttccctactaaacctaaacttaccgaacggaccctaaaccggtcccccttaaacccgtaaaaccccgttaggttaaaccgtttaacgtttttacgaacccgttaagttacctttaaacgtttacgttacgtaactaaacgtacggtacgtaacgaacggtacggtttccggacccgtacgttaccgttaccggtttaccgggggaccgggtaaacggggtaacccggtaaaggggtacggtaaacggaacgtaaaccgtaaaaaccggtcgttacgggtaacggtcgtacggacctaactacgttcgttacgtttccc

SEQ ID NO: 407657 - DNA, 536 bp, Homo sapiens
  misc_feature: GZ8MTXP02GM2YK.45.35.D02.1.454.CMB.2.raw
  modified_base (201)..(201): a, c, t, g, unknown or other
  modified_base (346)..(346): a, c, t, g, unknown or other
  modified_base (349)..(349): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggccatggcatccagccagtcagtgcggtggttgcncgngacttcactctacacaatcagcacgcctaccaacctagaagtattttgactagtcttaattactagtactaacgagaccgtaacagtagttggacccgtctcctacgtttcggcggtacgggaccgaaagggtcggacgtacgtacgaaaacgaacgtaggtaaggctacgacaccactctagttcc

SEQ ID NO: 407658 - DNA, 499 bp, Homo sapiens
  misc_feature: GZ8MTXP02FFY8T.45.35.D02.1.454.CMB.2.raw
  modified_base (201)..(201): a, c, t, g, unknown or other
  modified_base (213)..(213): a, c, t, g, unknown or other
  modified_base (349)..(349): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtatagaacatactggcctggtatcaatacaagcctggccagggtccccggctcctcatctatgatgcttccagcagggccactggcatccagcaggttcagtggcggtgggttgcncagacttcactctcacaatcagcagcctccaacctcgaagtattttgctagtctattactgtctaacagacgtacagattggccgctcactttcggcggtacgggaccgaaggtggagatacaaacgactgtggctcgcacgatctcgtc

SEQ ID NO: 407659 - DNA, 561 bp, Homo sapiens
  misc_feature: GZ8MTXP02JUDY3.45.35.D02.1.454.CMB.2.raw
  modified_base (290)..(290): a, c, t, g, unknown or other
  modified_base (296)..(296): a, c, t, g, unknown or other
  modified_base (356)..(356): a, c, t, g, unknown or other
tcagacgcgatcgacacgaccggtgctcgatttagcacacgatagttggggtttgggaggaactgctcagttaggacccagagggaaccatggaagccccagctcagcttctcttcctcctgctacctctggctcccagagacctccggagaaattgtcttgacacagtctccagccattctgtctctctctccgaggggagaccagcccaccctctcatcgcagggccagtcagagtattagaacatacttggacctggtatcaatacaagcctggccagggtccccgntccgtnatcatgatgcttcagcaggccagtgcatccagccagttcagtcggcggttggttgcacgngacttcactctcacaatcagcacgcctaccaaccctgaacgtactttgacctagtacttagttactgtactaacgagtacgtacagtaattcggaccgtcttccgtaacgtttcggacgggtaacgggtacccgagggtaggacgtaacgtacgaaaacggtaccgtaggtggaccgttcggaccacccgtatcgtacggtttcc

SEQ ID NO: 407660 - DNA, 526 bp, Homo sapiens
  misc_feature: GZ8MTXP02JOO6N.45.35.D02.1.454.CMB.2.raw
  modified_base (200)..(200): a, c, t, g, unknown or other
  modified_base (280)..(280): a, c, t, g, unknown or other
  modified_base (285)..(285): a, c, t, g, unknown or other
  modified_base (344)..(344): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatactgcctggtatcaatacagcctggccagggtccccgntcctnatctatgatgctcagcagggccatggcatcccagccaggttcagtggcggttggttgcncagcttcactctcacaatcagcacgcctaccaacctagaacgtattttagactagtctattactgtacaacagacgtacagtatcggccgtctactacgtttcggacggtacgggaccgaagggtacggagacgtacgaaacggtactaggtcggacgtacgacaaccgtactactcgttcg

SEQ ID NO: 407661 - DNA, 570 bp, Homo sapiens
  misc_feature: GZ8MTXP02GWH4G.45.35.D02.1.454.CMB.2.raw
  modified_base (200)..(200): a, c, t, g, unknown or other
  modified_base (368)..(368): a, c, t, g, unknown or other
  modified_base (415)..(415): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctcggagaaattgtcttgacacagtctccagccattctgtctctctctccagggganacagcccaccctctcatgcagggccagtcagagtatagaactatacttggcctggtatcaatacaagcctgggccacgggtccccgctccgtcattcatgatgccttcagcgacggcccagtcggcactcccagcctaggttcaggtcgggcgggttgggtttcgacncgtagtacttcactctacacatcagcacgcctaccacgtagaacgtntttacgactagtacttacttactgtactaagcgtacgtaacgagtacgttcggccgcgttacgtacggttacggacgggtaacggaaccggtaggtacggaacgtaacgtaccgaaacgtaacgtgtaacggatacggacactacgtctgttacc

SEQ ID NO: 407662 - DNA, 543 bp, Homo sapiens
  misc_feature: GZ8MTXP02JLAFY.45.35.D02.1.454.CMB.2.raw
  modified_base (201)..(201): a, c, t, g, unknown or other
  modified_base (243)..(243): a, c, t, g, unknown or other
  modified_base (282)..(282): a, c, t, g, unknown or other
  modified_base (425)..(425): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcagggccagtcagagtatagaacntactggctggtatcaatacaagctggccagggtccccgntcctcatctatgatgcttcagcaggccactgcatcccagccaggttcaggtcggtcggtgggttgcacgagacttcactctcacaatcagcagcctcaacctgaacgtatttgctagtactatactgtactaacagacgtaanagtagttcggcctctccgtacgtttcgggacgggtaacgggaccgaaagggtggaacggagtaccgaaaacgtaacgtaggtcggccgttaagccaaaccgttacgttccgtacgttc

SEQ ID NO: 407663 - DNA, 577 bp, Homo sapiens
  misc_feature: GZ8MTXP02JU5CX.45.35.D02.1.454.CMB.2.raw
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgaggggagacagccaccctctcatgcagggccagtcagagtatagaacatactggcctggtatcaatacaagcctggccgacgggtcccccggctcctcatctatgatgcttcagcacgggccacgtggcatcccagccaggttcaggtggcgggttggtttcggctacgacgtacttcgacctctcaacaatcagcacgccctaccaacccgtagaacgtatttcgactagttactattactgtacaactagccgtaacagtattcggccgtctaccgtacgtttcgggacgggtacgggaccgtaggggtaggaacgacgtaaccgaaacgtaacgttggtaacggacgtacggacctaccgtacgttccgtcgtttaccg

SEQ ID NO: 407664 - DNA, 514 bp, Homo sapiens
  misc_feature: GZ8MTXP02F7EQS.45.35.D02.1.454.CMB.2.raw
  modified_base (283)..(283): a, c, t, g, unknown or other
  modified_base (346)..(346): a, c, t, g, unknown or other
  modified_base (413)..(413): a, c, t, g, unknown or other
  modified_base (421)..(421): a, c, t, g, unknown or other
  modified_base (432)..(432): a, c, t, g, unknown or other
tcagacgcgatcgacacgaccggtgctcgatttagcacacgatagttgggtttggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacagcctggccagggtccccgntcctcatctatgatgcttccagcaggccactggcatcccagccagtcagtggcggtggttgcncgagacttcactctcacaatcagcagcctaccaactgaacgtatttgctagtctattactgtacaanagacgtanagtattggccnctcacgtttcggcggacggacgaaggtcggaagacgtacgaaaacggaactggaacggtctacggacaccgtactctcgttc

SEQ ID NO: 407665 - DNA, 543 bp, Homo sapiens
  misc_feature: GZ8MTXP02J3AZ2.45.35.D02.1.454.CMB.2.raw
  modified_base (201)..(201): a, c, t, g, unknown or other
  modified_base (243)..(243): a, c, t, g, unknown or other
  modified_base (285)..(285): a, c, t, g, unknown or other
  modified_base (309)..(309): a, c, t, g, unknown or other
  modified_base (352)..(352): a, c, t, g, unknown or other
  modified_base (367)..(367): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacntacttggcctggtatcaatacaagcctggccagggtccccgntcctcatctatgatgcttccagcnggccacgtggcatccccagccaggtcagtggcggttggttgcncagacttcgacttcncacaatcagcacgcctcccgaaacctgaaacgtattttgacctagtcttattactagtcaactagacgttacagtacttggccgccgttctacgtttcgggacgggacgggaccgtaagggtggaagtactaccgaaaacgtaacgtgtcggctacgccacctactctagtttccc

SEQ ID NO: 407666 - DNA, 536 bp, Homo sapiens
  misc_feature: GZ8MTXP02HDEJQ.45.35.D02.1.454.CMB.2.raw
  modified_base (201)..(201): a, c, t, g, unknown or other
  modified_base (354)..(354): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcaggccagtggcatcccagccaggttcagtggcggttggttgcacgngtacttcactctacactaatcagcacgccctacaacctagaactatttcgactagtcttattactgtacaacagtacgtacgagtacgttcggccgtactcgtacgtttcggacgggtacgggaccgagggtacggaagactacgaaaacgtacgtagcgctacgacactactctagtttcc

SEQ ID NO: 407667 - DNA, 534 bp, Homo sapiens
  misc_feature: GZ8MTXP02I5M45.45.35.D02.1.454.CMB.2.raw
  modified_base (201)..(201): a, c, t, g, unknown or other
  modified_base (243)..(243): a, c, t, g, unknown or other
  modified_base (351)..(351): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacntacttggcctggtatcaatacaagcctggccagggtcccccgctcctcatctatgatgcttcagcaggcccatggcatcccagccagttcaggtggcggtggttcgcngagacttcactctcacatcagcacgcctccaacctagactatttgctagtctattactgtacaactagacgtaacagtattcggacctctctacgtttcgggcggacgggaccgaaggtcggaagtaactacgaaaacgtacgtaggtaacggcttaggacccaccgtattccgtcgtttacc

SEQ ID NO: 407668 - DNA, 573 bp, Homo sapiens
  misc_feature: GZ8MTXP02GI2TH.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcgagggccagtcagagtatagaacatacttggcctggtatcaatacagcctggccgacgggtcccccgctcctcatctatgatgcttccagcgaggccacgtggccactcccagccgtaggttcaggtgggtcgggttgggttcgcacgtagtacttcacttcacaacatacagcacgaccctaccaaaccgtagtaacgtatttgactacgtacttaattactagtactaacacgtacgtaacagtagttcggcctctcgtacgttcggacgggtacggaccgtaagggtcggaaagtacgtacgaaaacggtaacgtcggtaaggtacgtagaccacgtacgtcgtgttacc

SEQ ID NO: 407669 - DNA, 566 bp, Homo sapiens
  misc_feature: GZ8MTXP02F13WP.45.35.D02.1.454.CMB.2.raw
  modified_base (202)..(202): a, c, t, g, unknown or other
  modified_base (214)..(214): a, c, t, g, unknown or other
  modified_base (243)..(243): a, c, t, g, unknown or other
  modified_base (257)..(257): a, c, t, g, unknown or other
  modified_base (279)..(279): a, c, t, g, unknown or other
  modified_base (290)..(290): a, c, t, g, unknown or other
  modified_base (427)..(427): a, c, t, g, unknown or other
tcagacgcgatcgacacgaccggtgctcgatttagcacacgatagttgggtttgggggagggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtatagaacntactggctggtatnaatacagctgccaggtccccgntcctcatctangatgcttccagcagggccacgtggcactcccagccaggttcaggtgggcggttggggtttcgcacgagtacttcacttctacacaatcagcacgcctacaacctagacgttatttgctagtcttattactgtacaanagtacgtaacagtacttggccctactacgtacgtttcggggacggacggggtaaccgtaaggggtggaaacgaacttaaccgaaaaacggaacgttcgggaaggacgtacggaccaccctaagtccgttacggtttccc

SEQ ID NO: 407670 - DNA, 566 bp, Homo sapiens
  misc_feature: GZ8MTXP02JU2NI.45.35.D02.1.454.CMB.2.raw
  modified_base (200)..(200): a, c, t, g, unknown or other
  modified_base (358)..(358): a, c, t, g, unknown or other
  modified_base (451)..(451): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagagtattagaacatacttggcctggtatcaatacaagcctggccacggggtccccgctcctcatctatgatgctcagcagggccacgtggcactcccagccaggttcaggtggcgggttgggttcgcncgagtacttcacctctacaacaatcacgctacgcctaccaacctagaacgtatttcgactagtcttaattcgtagtacaacgagtaccgtaanagtacgttcggccgtcgtaccgtacgtttcggacgggtacgggaaccgaaggggtggaacgacgtaaccgaaacgtaacgtggtaacggctaacgacctagtcttcgtactaccg

SEQ ID NO: 407671 - DNA, 544 bp, Homo sapiens
  misc_feature: GZ8MTXP02JGWFO.45.35.D02.1.454.CMB.2.raw
  modified_base (201)..(201): a, c, t, g, unknown or other
  modified_base (242)..(242): a, c, t, g, unknown or other
  modified_base (257)..(257): a, c, t, g, unknown or other
  modified_base (261)..(261): a, c, t, g, unknown or other
  modified_base (263)..(263): a, c, t, g, unknown or other
  modified_base (265)..(265): a, c, t, g, unknown or other
  modified_base (277)..(277): a, c, t, g, unknown or other
  modified_base (282)..(282): a, c, t, g, unknown or other
  modified_base (422)..(422): a, c, t, g, unknown or other
  modified_base (442)..(442): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacntacttggcctgtatnaatnancngccaggccccgntcctnatctatgatgcttcagcaggccatggcactcccagcaggttccaggtcggcggttaggggtttgctacgagtaccttcacttcacaacatcgagcacgcctaccaaacctgaagtatttagcctagtacttaattacctntaccaaagacgacgttaacngtaacgttcggccgacttctacgtttcggcggtaacgggacaagggtcggaagtactaacgaaaaccgaattggaacgtctacggcaacctgtactgttccc

SEQ ID NO: 407672 - DNA, 554 bp, Homo sapiens
  misc_feature: GZ8MTXP02J3OAZ.45.35.D02.1.454.CMB.2.raw
  modified_base (201)..(201): a, c, t, g, unknown or other
  modified_base (242)..(242): a, c, t, g, unknown or other
  modified_base (283)..(283): a, c, t, g, unknown or other
  modified_base (288)..(288): a, c, t, g, unknown or other
  modified_base (382)..(382): a, c, t, g, unknown or other
  modified_base (406)..(406): a, c, t, g, unknown or other
  modified_base (433)..(433): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcgaggccagtcagagtatagaacntacttggcctggtatcaatacaagcctggccaggtccccgntcctnatctatgatgctccagcaggccacgtggcactcccagcctaggttcgagtcgggcggttgggttcggctacgagtaccttcacttcacactacncagcacgcctaccaacctgaagtntttagcttatctattactcgtacaacngtacgtacagtacgttcggcctcgttcgtacgttcggggacggtacggaacgaggtacgaaggtactacgaaaacgtacgttacggtcggactacggacctaaccgtacttcgtcgtttcc

SEQ ID NO: 407673 - DNA, 546 bp, Homo sapiens
  misc_feature: GZ8MTXP02IGZAN.45.35.D02.1.454.CMB.2.raw
  modified_base (202)..(202): a, c, t, g, unknown or other
  modified_base (367)..(367): a, c, t, g, unknown or other
  modified_base (388)..(388): a, c, t, g, unknown or other
  modified_base (437)..(437): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggganacagccaccctctcatgcagggccagtcagagtattagaacatacttggcctggtatcaatacaagcctggccacgggtcccccgctcctcatctatgatgcttccagcacgggccacgtggccactccccagccaggttcaggtgggcggtgggtttggcacgngtacttcactctcacaatcancacgcctaccaactgaagttatttgctagtcttattacctgtaccaacncgacgtacagtattcggcctactctacgtttcgggacggtacggaccgagggtcggaagactacgaaaacgtacgtagtggtcctaggaccacctacgttctacgttcc

SEQ ID NO: 407674 - DNA, 635 bp, Homo sapiens
  misc_feature: GZ8MTXP02G38RU.45.35.D02.1.454.CMB.2.raw
  modified_base (201)..(201): a, c, t, g, unknown or other
  modified_base (213)..(213): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagaacatacttggcctggtatcaatacaagcctggccacgggtcccccgctcctcatctatgatgccttccagcagggcccacgtggccactccccagccgtacggttcaggtcgggcggggttggggtttcgctacgagtaccttcgacttcctacaactaactcacgccacgccctaccaacctgaacgtatttcgactagtcttaagttactagtacaacgagtaccgtacgtagtacgttcggtaccgtacttccgtaacggtttccgggacggggtaacgggtaccgtaaaggggttcgggaaacgtaacggttaaccgaaaaacggaccgttaggtaacggggtacttacgggacccgttaacctacggtttacccgttaggttttaccccg

SEQ ID NO: 407675 - DNA, 588 bp, Homo sapiens
  misc_feature: GZ8MTXP02HZM13.45.35.D02.1.454.CMB.2.raw
  modified_base (203)..(203): a, c, t, g, unknown or other
  modified_base (291)..(291): a, c, t, g, unknown or other
  modified_base (297)..(297): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactatggctcccagagacctccggagaaattgtcttgacacagtctccagccattctgtctctctctccgagggganacagcccaccctctcatgcagggccagtcagagtattagaacatacgtggctggtatacaatacaagcctggcccacgggtcccccgntccctnatcatgatgcctcagcaggccagtggcactcccagcctaggttcaggtggcgggttggttcggcacgtagcttcacttctacgaacaatcagcacgccctacaaacctgaagtctttgacctagtactattactgtactaaacgagtacgtaacgagtaacgttcggaccgtctacgttaccggtttacggggacgggttaacggggaaacccgtaaggggtggtaaacgtacgtaaccgaaaacggtaacgtgtaacgggctacggacctaactacgtccgtttacgtcc

SEQ ID NO: 407676 - DNA, 590 bp, Homo sapiens
  misc_feature: GZ8MTXP02JJTFO.45.35.D02.1.454.CMB.2.raw
  modified_base (202)..(202): a, c, t, g, unknown or other
  modified_base (284)..(284): a, c, t, g, unknown or other
  modified_base (288)..(288): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtatagaacatacttggcctggtatcaatacaagctggccacggtccccgntccnatcatgatgctcagcaggccactgcactcccagccacggttcaggttcggcggttggggttcgacgacgtacgtaccttcgaccttcttaccgaacaaactcgaacgaccacgaccctacctaaacccgtagtaaacgttacttttacggactacgttaccttaattacgtacgtacaaacgtagtacgttaacacgtagttcgggctcgtcgtacgttcggacggtacggaacctagggtacggaagactaacgaaacgtaactaggtaacgcgtacgtaccgactactccgtacgttacc

SEQ ID NO: 407677 - DNA, 556 bp, Homo sapiens
  misc_feature: GZ8MTXP02IPUSE.45.35.D02.1.454.CMB.2.raw
  modified_base (198)..(198): a, c, t, g, unknown or other
  modified_base (358)..(358): a, c, t, g, unknown or other
tcagacgcgatcgacacgaccggtgctcgatttagcacacgatagttgggtttgggggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatactggcctggtatcaatacaagcctggccacgggtccccgctcctcatctatgatgcttccagcgacgggccactggcactccagcctaggtccaggtggcggttgggttcgcacgngtacttcgactctcaacatcagcacgccctaccactagaatatttgctagtactattactgtacaactagacgtacagtagttcggacctcgtacgtacgtttcggggacggacgggtaaccgaagggtaggacgtaaacgtacgaaaacgtaacgtggttacggcgtacggacgtacctagttctacgttctttacc

SEQ ID NO: 407678 - DNA, 689 bp, Homo sapiens
  misc_feature: GZ8MTXP02GE9OX.45.35.D02.1.454.CMB.2.raw
  modified_base (202)..(202): a, c, t, g, unknown or other
  modified_base (455)..(455): a, c, t, g, unknown or other
  modified_base (497)..(497): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatcgcacgggccagtcagagtattagaacattacgttggcctaggtatacaatacaagccgtggccgacggggtcccccgactcccgtcacttctaatgattcgcctttccgagaccgacgggcccacgtggacctacgtcccgacgtccgaacgggttccgaggggtggggtcggggtttcggggttaggaccgtacgtacggtaacctttcaaccttctaacaactaactacgacnccgacgaccctacaaacccgtagaacgttatttcgatacgtnttaaattactaggttaccaaacgtacgtaacgtaaccgaagtacgttcggaccgtctaccgtacggttacgggacggggtaacgggtaacccgtaaaggggtacggaaacgtaacgttaacgaaaaaccgtacggttacggaacgggtaacctcggaacccgtaaacccgtttacgttaccgttacttaccg

SEQ ID NO: 407679 - DNA, 648 bp, Homo sapiens
  misc_feature: GZ8MTXP02IGV5M.45.35.D02.1.454.CMB.2.raw
  modified_base (201)..(201): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtattagaactatacttggcctggtatcaatacaagcctggccagggtccctggcctcctcatctatgatgcttcagcagggccactggcactcccagccccaggttccaggtcgggcggttggggtttgcgacaggtacctttcacctctacaactaatcagacacgaccctaccctaaaccctagtaaagtacttttacggacgtagttactttaactttaactacggtttaaccaaaccgtacggtaccgttaaccgtaaggtaacgtttcgggacccggttcttaccgtaccggttttaccggggaccggggtaacggggtaacccggtaaaggggttacgggaaagtaacgtaaccgtaaaacggtaaaccgtgggttacggacgtacggacctaccgtaacgtactttacg

SEQ ID NO: 407680 - DNA, 614 bp, Homo sapiens
  misc_feature: GZ8MTXP02JB562.45.35.D02.1.454.CMB.2.raw
  modified_base (203)..(203): a, c, t, g, unknown or other
  modified_base (254)..(254): a, c, t, g, unknown or other
  modified_base (352)..(352): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactctggctcccagagacctccggagaaattgtcttgacacagtctccagccattctgtctctctctccgagggganacagccacctctcatgcagggccagtcagagtatagaacatactgctgtancaatacagcctggccacgggtccccgctcctcatctatgatgctcagcgacggccagtgcactccagcctaggtcaggtggtcgggttggttcgcagngtacttccactctacaacaatacagacacgaccctaccgtaacctagtaacgtactttacgacttagtactttaacttacttacgtaactaacgacgtacgtaacgaacgtacgttacggaccgtacgtaccgtaccggtttccggggacggggtaacggggtaaccggtaaaggggtacggaaacggtaacgtaaaccgaaaacggtaacgttacggtaaggaccgttacgaccgtaacctacgttcgttacgtttacccg

SEQ ID NO: 407681 - DNA, 528 bp, Homo sapiens
  misc_feature: GZ8MTXP02IO8P3.45.35.D02.1.454.CMB.2.raw
  modified_base (201)..(201): a, c, t, g, unknown or other
  modified_base (350)..(350): a, c, t, g, unknown or other
  modified_base (352)..(352): a, c, t, g, unknown or other
  modified_base (426)..(426): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagacatacttggcctggtatcaatacaagcctggccagggtccccgctcctcatctatgatgcttccagcagggcccatggccatcccagccaggtcagtggcggtggttgcngngacttcactctcacatcagcacgcctaccaactagagtattttgactagtctaattactgtacaacagcgtaanagtacgtggccgtactctacgttcggcggtacgggtaccgaagggtggaagactacgaaaacgtactaggtaacggctacgactaccgacttcgtacgttcc

SEQ ID NO: 407682 - DNA, 518 bp, Homo sapiens
  misc_feature: GZ8MTXP02H1M6Z.45.35.D02.1.454.CMB.2.raw
  modified_base (200)..(200): a, c, t, g, unknown or other
  modified_base (256)..(256): a, c, t, g, unknown or other
  modified_base (352)..(352): a, c, t, g, unknown or other
  modified_base (371)..(371): a, c, t, g, unknown or other
  modified_base (422)..(422): a, c, t, g, unknown or other
  modified_base (428)..(428): a, c, t, g, unknown or other
  modified_base (437)..(437): a, c, t, g, unknown or other
  modified_base (509)..(509): a, c, t, g, unknown or other
tcagacgcgatcgacacgaccggtgctcgatttagcacacgatagttgggtttgggggaggaactgctcagttaggacccagagggaccatggaagccccagctcagcttctcttcctcctgctactctggctcccagagacctccggagaaattgtcttgacacagtctccagccattctgtctctctctccagggganacagcccaccctctcatgcagggccagtcagagtatagaacatactggcctggtancaatacaagcctggccacgggtccccggctcctcatctatcgatgctcagcaggccatggcactcccagccaggttcagtcggcggtggttggctnagtacttcactctcaatancagcaacgccctaccaacctagaacgtatttagacctagtacttattactntacaanagacgtaanagtagtcgcgtctactacgtcggacggacggacgaggacgacgacaacgaaacgtacgtcgtgcacgacacnctctacgtc

SEQ ID NO: 407683 - DNA, 640 bp, Homo sapiens
  misc_feature: GZ8MTXP02HQHU4.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatgcagggccagtcagagtattagaactatactggcctggtatcaatacaagcctggccgacgggtcccccgctcctcatctatgatcgtccttccagcgacgggtccacgtggcactcccgagccaggtcaggtggcgggtgggtttgctcgagtacttcacctcacaactactcacgcacgtccctaccaaccgtagaacgttacttttcgacctagttacttaactttacgttacgtactaaacgtacggtacgtaacgagtacgtttcgggcccgtacgttccgttaaccggtttcgggggaccgggtaacggggtaaacccgtaaagggggtacggaaacggtaacgtaaccgaaaaaccggtaaccgttgggtaacggtacgtacggaccctaccgtaacttccgttacgtttccc

SEQ ID NO: 407684 - DNA, 669 bp, Homo sapiens
  misc_feature: GZ8MTXP02F75BV.45.35.D02.1.454.CMB.2.raw
  modified_base (365)..(365): a, c, t, g, unknown or other
tcagacgcgatcgacacgaccggtgctcgatttagcacacgatagttgggtttgggggaactgctcagttaggacccagagggaaccatggaagccccagctcagcttctcttcctcctgctactctggctcccagagacctccggagaaattgtcttgacacagtctccagccattctgtctctctctccgaggggagacagcccaccctctcatgcgagggccagtcagagtatagaactatacttggctggtatcaatacaagctggccgacggggtccccgctcctcatctatgatgcttcagcgagggccacgtggcactcccagcctaggtccgaggtggcgggtgggtttggcaacgngtacttcactcctacaacatcagccacgccctaaccaacctagtaaagtacttttacggactaagttactaactttaacttacggtactaaaaccgtaacgtaccgttaaacgtagtaacgtttcggggacccttccgtaccgttaaacccggttttccgggggaaccgggggtaaacggggtaaacccgggtaaaagggggttacgggaaacggtaaacgtaaaaccggtaaaacggtaaaaccgttgggtacggtaacgtacggtacccaaccgtaacgttccttacggttacctttaaccc

SEQ ID NO: 407685 - DNA, 606 bp, Homo sapiens
  misc_feature: GZ8MTXP02GWT01.45.35.D02.1.454.CMB.2.raw
  modified_base (378)..(378): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggagacagccaccctctcatgcagggccagtcagagtattagaacatacttggcctggtatcaatacaagcctggcccagggtccccgctcctcatctatgatgcttccagcagggcccactggcactcccagccaggttcagtggcggttggttgcagacgtacttcactctcacatcancacgcctaccaacctagaacgtattttacgactagtacttaattacttacgtacctaacctaagttaattaaaagtaacgtacggtacccttaccggtagggtaccgtttacgggaccgtaaacggggaaacccgtaagggtaaggtaaaacgttaacgaaaaccggtaaaccgttagtaacgggaccgtaacggacgtaacctacgtacttacgttcttacgtaacc

SEQ ID NO: 407686 - DNA, 529 bp, Homo sapiens
  misc_feature: GZ8MTXP02FPIW7.45.35.D02.1.454.CMB.2.raw
  modified_base (201)..(201): a, c, t, g, unknown or other
  modified_base (214)..(214): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctntcatgcagggccagtcagagtatagaacatacttggcctggtatcaaatacaagcctggccagggtcccccgctcctcatctatgatgcttccagcagggccactggcactccagccaggttcagtggcggttgggttgcacagacttcactctacaacaatcagcacgccctaccaacctagaagtatttgctagtactattactgtacaacagtacgtacagacgttcggccgtctctacgtttcgggacggaacgggaccgaagggtaggaagactacgaaaacgacgtaggtggctacgcacactctgttc

SEQ ID NO: 407687 - DNA, 581 bp, Homo sapiens
  misc_feature: GZ8MTXP02G1CBT.45.35.D02.1.454.CMB.2.raw
  modified_base (202)..(202): a, c, t, g, unknown or other
  modified_base (293)..(293): a, c, t, g, unknown or other
  modified_base (299)..(299): a, c, t, g, unknown or other
  modified_base (355)..(355): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctgggccacgggtccccgctcctnatctangatgctcagcaggccagtgcatccagccaggttcaggtgggcggttgggttcgacngagtacttcgactctacaactaactcacgccacgccctaccaacctacgtaacgttactttgactagttcttacttacgttactactaacgtacgtacgtacaagtacgtcgggacctcgtacgtacgtttcgggaccggaacgggtaccgaagggtacggaacgtaacgtaacgaaaacggtacgtacggtaacggtctacggacaacctagttctacgtttccg

SEQ ID NO: 407688 - DNA, 609 bp, Homo sapiens
  misc_feature: GZ8MTXP02I5GRC.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcgaggccagtcagagtattagaacatacttggcctggtatcaatacagcctggaccacgggtccccgctcctcatctatgatgccttccagcgacgggcccacgtcggccacgtccccaggccctaggtttccagggttggggtcggggttggggtttcggcctacgtacgtaccttcgacctctacactaatcacgcacacccgtacccaacgtagtaagtatttcgactacgtacttaacttacttcgtactaacgtacgtacgtaacgtacgtacgttcggccgtacgttccgtacgtttccgggacggtacgggacgtaaagggtcggaagacgtacgaaaacgtacgtacggtgtcgtacgacctacgtacgttcgtacgtttcc

SEQ ID NO: 407689 - DNA, 614 bp, Homo sapiens
  misc_feature: GZ8MTXP02F6R22.45.35.D02.1.454.CMB.2.raw
  modified_base (202)..(202): a, c, t, g, unknown or other
  modified_base (248)..(248): a, c, t, g, unknown or other
  modified_base (295)..(295): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagtagttattagaactntacttgggcctggtatcaatacaagcctggaccaggggtcccccggntccctcatctatgatgcttcagcacggccacgtggctactcccagccaggttccaggtgggtcggttgggttcgcacgtagtccttacgacttctacactaatcgagcacgacctacctaaactagaacgttatttacgcgtaagttctttaaacttaccgtagttacccaaactacggtaccgtaacctaaggtacgtttcggacccgtacttcgtaccggtttcggggacgggtaacgggaccggtaaaggggtcggaaagtaaacgtacgaaaaccgtgttcggaagtccgtagaccaccgtatcgtacgtttacc

SEQ ID NO: 407690 - DNA, 566 bp, Homo sapiens
  misc_feature: GZ8MTXP02JS1LE.45.35.D02.1.454.CMB.2.raw
  modified_base (202)..(202): a, c, t, g, unknown or other
  modified_base (289)..(289): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggcctggtatcaatacaagcctggccacggggtcccccgntcctcatctatgatgcttcagcaggccacgtggcactcccagccaggttcaggtgggcggttgggttcgctacaggtcttcgactctacacatcagcacgccctaccaaccgtagaacgtattttgactagtacttaagttactcgtacaactagacgtaacagtacgttcgggccctcgtccgtaacgtttccgggacgggtaacgggaccgtaagggtcgggaagacgtacgaaaaccggagtcggtcggactacgacacacgtctacgtttacc

SEQ ID NO: 407691 - DNA, 581 bp, Homo sapiens
  misc_feature: GZ8MTXP02G9HXJ.45.35.D02.1.454.CMB.2.raw
  modified_base (201)..(201): a, c, t, g, unknown or other
  modified_base (355)..(355): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtccccgctcctcatctatgatgcttccagcaggccacgtggcatcccagccaggttcagtggcggtgggttgctacgngtacttcgactctacacaatcagcacgccctaccaaccctgaacgtatttgactagtctattactgtacaacagacgtaacagtacgttcggaccgtcttccgtacgtttcgggacgggtacggggtaacccgtaaaggggtacggaagtaacgttaccgaaaaacggtaaccgtaggtaacggtaccgtacggtaccaaccgtaactttaccggtacgtttcccg

SEQ ID NO: 407692 - DNA, 528 bp, Homo sapiens
  misc_feature: GZ8MTXP02FKWSQ.45.35.D02.1.454.CMB.2.raw
  modified_base (201)..(201): a, c, t, g, unknown or other
  modified_base (358)..(358): a, c, t, g, unknown or other
  modified_base (438)..(438): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccgctcctcatctatgatgcttccagcagggcccacgtggcactcccagccaggttcagtgggcggttgggttggcncagacttcactctacacatcagcacgcctaccaacctgaagtattttcgactagtacttattactgtacaacagacgtanagattcggccgtctctacgttcggacggacggacgaagggtcggaagactacgaaaacgacgtaggtggactcgacaccactctcgttcc

SEQ ID NO: 407693 - DNA, 588 bp, Homo sapiens
  misc_feature: GZ8MTXP02GB5MX.45.35.D02.1.454.CMB.2.raw
  modified_base (200)..(200): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcgagggccagtcagagtatagaacatactggctggtatcaatacaagcctggccacggggtccccgctcctcatctatgatgcttcagtcgaggcccacgtggacactcccagccgaggttccagtcgggcgggttggggttcgctacgagtaccttctactcctcaaactaatcacgacacgacccttaccaaaccgtacgaagttactttcgactagttactaattacgtagtactaacgagtaccgtacgtaagtacgttcggccgtcgtccgtaacgtttcgggacgggtaacggaccggtaagggtaggaacgacgtaacgaaaacgacgtacggtaacggtcgtacgccacacgtcgtcgtttc

SEQ ID NO: 407694 - DNA, 670 bp, Homo sapiens
  misc_feature: GZ8MTXP02IDNQM.45.35.D02.1.454.CMB.2.raw
  modified_base (201)..(201): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggtcagtcagagtatagaacatacttggcctggtatcaatacaagcctggccgacgggtcccccggctcctcatctatgatgcttccagcagggcccagtcggcactccccagcctagggttccagggtgggtccggggtttggggtttcggctacggtacgtaccttcacctctaacaactaactcgagaccacgaccctaccaaccgtagaacgttattttcgactagttccttaattactagtacaacgacgtacgtaacgagtacgttcgggaccgtcgttaccgttaccggtttacgggggaccggggtaaacgggggtaacccgtaaagggggtacggggaaaggtaaaccgttaaccgggtaaaaaccggttacggttacggggtaacgggtaccgttaacggaccctaaaaccggttcctttaccgttacggttttacccg

SEQ ID NO: 407695 - DNA, 715 bp, Homo sapiens
  misc_feature: GZ8MTXP02H511C.45.35.D02.1.454.CMB.2.raw
  modified_base (200)..(200): a, c, t, g, unknown or other
  modified_base (301)..(301): a, c, t, g, unknown or other
  modified_base (455)..(455): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccagggganacacgcccaccctctcatgcgagggccagtcagtaagtataagaactattacgtggccttaggtatacaatacaacgcctacgggccgacgggtcccccgntcctacactctaagtgactcgtacttccaggtccgacgggtaccctacggtcggactaccgtccccgaggaccctagggtttccgaggggttcggggtacggggtttggggtttcgacgtacgagttaccttaccgtacttccgacaaactaanaccgaacgctaaccgtacccccttaaccgaaacccgttaggttaaacgttacgttttacgaacgttacgttaaacttactttaaaccgtacgttaaactaaccgtagttaaccggtacctaaggttaacgtccgggcccgttacttaccggtacgtttcggggaaccgggaacgggtaaaccgaaggggttagaacggtacgtaaacgaaacgtgtaccggtggtacctaacggtccaaccgtacttacgttcttacccg

SEQ ID NO: 407696 - DNA, 573 bp, Homo sapiens
  misc_feature: GZ8MTXP02GVMOJ.45.35.D02.1.454.CMB.2.raw
  modified_base (201)..(201): a, c, t, g, unknown or other
  modified_base (359)..(359): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatactggcctggtatcaatacaagctggccacggggtccccgctcctcatctatgatgcttccagcagggcccacgtcggcactcccagccaggttcagtggcggttgggttgcacgngacttcgactcctcacatcagacacgccaccaactagaacgtatttacgcgtagttactattactacttacaacgacgtacgtaacgaagtacgttacggccgtctcgtacgtttcgggaccgggttaacgggacccgaagggttacgggaagtaacgtaaccgaaaacgtaacgtaggtaacgtctacggacacctaacttcgtacgtttccc

SEQ ID NO: 407697 - DNA, 618 bp, Homo sapiens
  misc_feature: GZ8MTXP02HN044.45.35.D02.1.454.CMB.2.raw
  modified_base (201)..(201): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtatagacatactggctgatcaatacaacgctggccgacggtccccggctcctcatctatgtatgcttcgagcgacggtccactggcactaccccagaccgagggtttacctagggtcggggtcggggtttggggtttcggaccgtaccgaggtaaaccctttccaccttcctaactaaaccgaaactacgaacgaccgacgtacccccttaccaaacccttaggaaagttactttcggactacgtactttattacgttacgtactaaaccgagtacggtaactaagtacgttcgggaccctcgtacgtaccgtttaggggacggtaacgggacgtaagggagacgaaacaacgaacgacgtgtaagcgacgacactacgtctagtc

SEQ ID NO: 407698 - DNA, 565 bp, Homo sapiens
  misc_feature: GZ8MTXP02IB5U9.45.35.D02.1.454.CMB.2.raw
  modified_base (205)..(205): a, c, t, g, unknown or other
  modified_base (398)..(398): a, c, t, g, unknown or other
  modified_base (464)..(464): a, c, t, g, unknown or other
  modified_base (554)..(554): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactctggctcccagagacctccggagaaattgtcttgacacagtctccagccattctgtctctctctccaggggagacngccaccctctcatgcagggccagtcagagtattagaacatactggcctggtatcaatacaagcctggaccagggtcccccgctcctcatctatgatgcttcagcgaggtccacgtggcactcccagccacggttcgagtgggcgggttgggtttcggcacgagtaccttcgactctacacaataccagctacnccctaccaaccgtagtaacgtattttagcctagtcttaattaccttgtactaacgagtaccgtaanagtagtcggccgtcttacgtacgtacgggacggtacggaacgtagggaggacgtaacgtaacgaaacgtagtaggtgacgtacgactacncgtacgtactc

SEQ ID NO: 407699 - DNA, 633 bp, Homo sapiens
  misc_feature: GZ8MTXP02FLGWM.45.35.D02.1.454.CMB.2.raw
  modified_base (201)..(201): a, c, t, g, unknown or other
  modified_base (285)..(285): a, c, t, g, unknown or other
  modified_base (597)..(597): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcagggccagtcagagtatagaacatacttggcctggtatcaatacaagcctggccagggtccccgntcctcatcatgatcgcttccagcagggcccactggactactcccagcctaaggttccaggtgggcgggttggggtttcggactaccgagactttacaccttctacaaacgaatccaagccaacgccctaacccaaaccctagtaaacgttattttacgacttaacgttccttaaatttacctaggttaccaaacacggtacgttaaacacgtagttcggacccgtacgtccgtaaacgtttccggggaccgggtaacggggaaacccgtaagggttcgggaaaagtacgtaacgaaaaaccggtacttaggnggtaccgtagacccgtaactacgtcgttacgtttcc

SEQ ID NO: 407700 - DNA, 589 bp, Homo sapiens
  misc_feature: GZ8MTXP02H1QNV.45.35.D02.1.454.CMB.2.raw
  modified_base (199)..(199): a, c, t, g, unknown or other
  modified_base (290)..(290): a, c, t, g, unknown or other
  modified_base (295)..(295): a, c, t, g, unknown or other
  modified_base (383)..(383): a, c, t, g, unknown or other
  modified_base (415)..(415): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcagggccagtcaagtagtattagaactatacgttggcctggtatcaatacaagcctggccgacgggtccccgntcctnatcatgatgcttcagcgacggcagtgcactcccgagcctaggttcaggtcggcgggttggttcggcacgtacgtacttcacttcacanaatcacgcacgccctaccaacctagtaacgtntttacgactagttactattacctagtactaacgtagtacgtaacgtagtacgtcgggtccctacgttaccgtacgtttaccgggggacggtaacggggaaaccggttaagggagtaacgggaactaaacggaaacgtaaccgttgaaggtcacgactacgtactcgttacgtcc

SEQ ID NO: 407701 - DNA, 546 bp, Homo sapiens
  misc_feature: GZ8MTXP02F1C5M.45.35.D02.1.454.CMB.2.raw
  modified_base (199)..(199): a, c, t, g, unknown or other
  modified_base (435)..(435): a, c, t, g, unknown or other
  modified_base (444)..(444): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccacgggtccccgctcctcatctatgatgcttccagcgagggcccacgtggcactccagccaggttcagtggtcggtgggtttcggcagagctcgactctacacatcagcacgccctaccaacctagaagttactttgcctagttcttacttaactgtacaacgngtacgtaanagtgttacggcctcaccgtacgttcgggacggtacggaccggagggtacggagactacgaaaacgtacgtgtaacggcgtacgtcaacccgtctacgtcgtc

SEQ ID NO: 407702 - DNA, 579 bp, Homo sapiens
  misc_feature: GZ8MTXP02HGJ2O.45.35.D02.1.454.CMB.2.raw
  modified_base (288)..(288): a, c, t, g, unknown or other
  modified_base (379)..(379): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagccattctgtctctctctccaggggagacagccaccctctcatgcagggccagtcagagtattagacatactggcctaggtatcaatacaagcctggccagggtccccgctcctnatctatgatgctcgagcagggccagtggcatcccagtccaggtcaggtggacgggttggttcgcacgacgtacttcactctacaactaacncacgcacgtacctaccaacgtagtaacgtacttacgactacgtacttaattactacgtacaacgtacgtacgtaacgagtacgtcggaccgtcgtacgtacgttacgggaacggtaacgggaacgtagggtacggaacgaacgtaaccgaaaacgtaacgtacggtaacgtacgtacgactacctacttacgtacgtacc

SEQ ID NO: 407703 - DNA, 602 bp, Homo sapiens
  misc_feature: GZ8MTXP02GBG8J.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtatagaacatacttggcctggtatcaatacaagcctgggccacggggtccccgctcctcatctatgatcgcttccagcgacgggcccacgtcggcacgtccccagtccgaggtttccgaggttcggggtcggggttggggtttcggctacgtacggacctttcgaccttctacgaaactaactcagccacgccctaaccgaaaccctgaaacgttattttacgactagttcttacttactagtaccaatagtacgtaacagtagttcggaccgtctaccgtacgtttcggggacggtaacgggaccgaagggtcggaaagacgtaacgaaaacgtacgtggaacgtcgtacgcacctatcgtcgttac

SEQ ID NO: 407704 - DNA, 663 bp, Homo sapiens
  misc_feature: GZ8MTXP02GHNTV.45.35.D02.1.454.CMB.2.raw
  modified_base (198)..(198): a, c, t, g, unknown or other
tcagacgcgatcgacacgaccggtgctcgatttagcacacgatagttgggtttgggggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccgacggggtccccgctccctcatctatgatcgtcttccgagcgtacgggcccacgtcggacctacgtccccagtacccgtaggtttccccgaaggggttcgggtccggggtttggggttttaccggacctaacggtacgggtaccctttccgtaacccgttaccttaccgaaacctaaattcccgaacgacccgtaacgtcccctaacccgaaaccttacggtaaaacgttacgtttttacgaccgtaagttaccttaacgtttacttacggtaactaaacgtacgaccgtaagtacgtacgttcggacctcgtacgtacgttcggacggtacggaacgagggtagacgatacgaaacgacgtggacgtctcgacactagtactcgtcttacg

SEQ ID NO: 407705 - DNA, 509 bp, Homo sapiens
  misc_feature: GZ8MTXP02GNJMM.45.35.D02.1.454.CMB.2.raw
  modified_base (201)..(201): a, c, t, g, unknown or other
  modified_base (284)..(284): a, c, t, g, unknown or other
  modified_base (319)..(319): a, c, t, g, unknown or other
  modified_base (343)..(343): a, c, t, g, unknown or other
  modified_base (415)..(415): a, c, t, g, unknown or other
  modified_base (422)..(422): a, c, t, g, unknown or other
  modified_base (493)..(493): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatacttggcctggtatcaatacaagcctggccagggtccccgntcctcatctatgatgcttccagcaggccatggcanccagcagtcagtgcggtggttgcnagacttcactctacacaatcagcaacgccctacaaacctagaagttatttgactatactatactgtacaaanagactanagtagtcggctctactacgttcggacggaacggacgaaggtagaagacgtaacgaaacgtacgtagcgtcncgacactactcgtctc

SEQ ID NO: 407706 - DNA, 617 bp, Homo sapiens
  misc_feature: GZ8MTXP02HN5FX.45.35.D02.1.454.CMB.2.raw
  modified_base (201)..(201): a, c, t, g, unknown or other
  modified_base (294)..(294): a, c, t, g, unknown or other
  modified_base (475)..(475): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtatagaacatactggcctggtatcaatacaagcctggccagggtccccgctcctcatctangatgcttcagcagggccatggcactcccagcctaggttccaggtcgggcgggttggggtttcggacacgtaggtacctttccaccgttcctacaactaaatcagccacgtccctaccaaaccgtagtaaacgtattttcgactagttacttaatttacctgttaccaacgtagtcgtaaancgtaagttcgggacctcttacgttacgtttcgggacgggtaacgggaaccgtaaaggggtcggtaaagtaacgtaaccgaaaaacggtaacgtcggttaacggacgttacggacctaacctaacgttccgtttgtttacccc

SEQ ID NO: 407707 - DNA, 670 bp, Homo sapiens
  misc_feature: GZ8MTXP02HF693.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcatgcagggccagtcagagtatagaacatactggcctggtatcaatacaagcctggccgacgggtccccgctccgtcatctatgatgccttccgagccgacggcccacgtcggccactccccgagccgtacggttcagggttggggacggggtttggggttcggactaccgtacgtacttccactctacacatcagccacgccctacaaccgtgtaacgtagttttcgacttagttcttaaattacccgttagtacctaacgtacgtaccgtaaacgtaggttacgtcgggtacccttcgttaccgttaccgggtttacggggaaccggggttaacgggggtaacccgtaaggggtacgggtaaacgtaacggtaaaccgtaaaacggtaaccgttaggggtaaccggtacgttaacggacccgtaaaccgtcgtttaccggttacgtttcccg

SEQ ID NO: 407708 - DNA, 680 bp, Homo sapiens
  misc_feature: GZ8MTXP02JP6R7.45.35.D02.1.454.CMB.2.raw
  modified_base (202)..(202): a, c, t, g, unknown or other
  modified_base (244)..(244): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagagtatagaacntactggctggtatcaatacaagcctggcccgacggggcccccgctcctcactctatgatcgcttcgagcgagggcccacgtggcctacgtcccgagtccagggttccaggtggggtccggggttggggtttcggactacgtacggtacttccgacttctacaacaatcagccacgccctacccaacccgtagtaaacgttagttttacgacttacgttactttaaagtttaccgttacgttaaccaaaccgtacggttaccggtaaacgtaacggttacgttaccgggtacccgtacgttaccgttaccgggtttccggggaccggggtaaacgggtaacccgtaaaggggtacggaacgtaaacgtaccgaaaaacggtacgttacggtaacggtacgttaacggacctaaccgtacgttccgttacgtttaccc

SEQ ID NO: 407709 - DNA, 746 bp, Homo sapiens
  misc_feature: GZ8MTXP02GK7RG.45.35.D02.1.454.CMB.2.raw
  modified_base (201)..(201): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatactggcctggtatcaatacaagcctggcccgacgggtcccccggctcccgtacacttctatgaatcgtcctttaccgaagtcgaacgggtcccaacgttcgggaccactcccccgaaagtcccgaggggtttcccaaggtcggggtcgggttggggtttacggccgtacgtacggtacctttccgaccgttacttcaaacctaacttccgaacggaccaacgtaccccctaacccaaacccgtaacggtaagttactttttacgacgtacgttaccttaacgtttacctacggttacaaacgtacggtacgttaaccgaagtacgttaccgggacccgtacgttaccgtaccggttttaccggggaaccgggtaaacggggtaacccggtaaaggggtaggggtaaaacgtaaccgtaaacggtaaaaaccgaacggttacgggtccggtaccggttaccggaccgtaaacccgtaacgtttcccgttaacgttttaccccg

SEQ ID NO: 407710 - DNA, 644 bp, Homo sapiens
  misc_feature: GZ8MTXP02JKMMI.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcgagggccagtcagagtatagaactatacttggcctggtatcaatacaagccgtggacccgtacggggtcccccgctcccgtcacttcctaatgatcgccttaccgagtcgagggcccacgtcggactacgtcccagtccgtaggttcagggtggcgggttgggttcgactacgacgtaccttcgaccttcgtacaactatccgacgtccaccgtaccctaccgaaaccgtagtaacgttactttacggactacggttacttaaacgttacgtcgtaactaaacgtacgtaccgtaagaacgtacgttcgggacctcttaccgtacggtttcgggacggtacgggactaggggtacgaacgtacgtaacgaaaacgtcgttagaacgggtccttacggaccctaactccgttcggtaacgtttcc

SEQ ID NO: 407711 - DNA, 542 bp, Homo sapiens
  misc_feature: GZ8MTXP02I6OF3.45.35.D02.1.454.CMB.2.raw
  modified_base (201)..(201): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtcccccggctccgtcatctatgatgcttccagcagggcccatggcactcccagccaggtcagtggcggtggttggctcgagacttcactctcacaatcagcacgcctaccaacctgaagtatttgactagtcttaattactgtacaacagtcgtacagtattcggccgtctcctacgtttcggcggtacggggacctaaggggtcggaagtacgtacgaaaacgacgttaggtaacgcgtacgaccgacctactcgtacgttcc

SEQ ID NO: 407712 - DNA, 620 bp, Homo sapiens
  misc_feature: GZ8MTXP02HEZR8.45.35.D02.1.454.CMB.2.raw
  modified_base (289)..(289): a, c, t, g, unknown or other
  modified_base (301)..(301): a, c, t, g, unknown or other
  modified_base (304)..(304): a, c, t, g, unknown or other
  modified_base (312)..(312): a, c, t, g, unknown or other
  modified_base (343)..(343): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctccagagacctccggagaaattgtcttgacacagtctccagcctattctgtctctctctccaggggacacagccacctctcgatgcagggccagtcagagtattagaactattactggcctggtaatcaatacaagcctggaccacgggtccccgntccgtcatctangangcctcgancgaaggcacgtgcagtccagtccaggttacnggtcggtcggttggtcgactagtacgtaccttcgtactctacaaactaacgtacaacgaccgtacgaccctaccgtaaacgtagtaacgttacgttacgactagttacttaattactagtaactaacgacgtacgtaacgtagtacgtacggtaccgtcgtaccgttaacgttcggaacggtaacggtaaccgtaagggacgtaaacgtaaacgtaaaccgaaacggttaacgtacggtaacggtacgtaccgacctaacgtacttacgttacgtcg

SEQ ID NO: 407713 - DNA, 639 bp, Homo sapiens
  misc_feature: GZ8MTXP02GBBZZ.45.35.D02.1.454.CMB.2.raw
  modified_base (199)..(199): a, c, t, g, unknown or other
  modified_base (379)..(379): a, c, t, g, unknown or other
tcagacgcgatcgacacgaccggtgctcgatttagcacacgatagttgggtttgggggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagagtattagaactatacttggcctggtatcaatacaagccgtaggccgacggggtcccccggctcctcatcctatgatgcttccagcaggcccagtcggcactcccgagccgtaggtccgaggtgggtcggggttgggtttcggcgaacngtaccttcgactctacaacaatcagtcacgccctaccaaccgtagtaacgtattttcgacctaagttacttaatttaccgttacgtaccaaacgtacgtaccgtaaacgtagtacgttcggcccgtcgtaccgttaccggtttcggggtaccggggaacgggaaaccggtaaggggtacggtaaggtaaacttaaccggaaaacgtaacgtaggttcggaacgtacggacctaaccgtacgttacgttcgttctttaccg

SEQ ID NO: 407714 - DNA, 559 bp, Homo sapiens
  misc_feature: GZ8MTXP02IYRHH.45.35.D02.1.454.CMB.2.raw
  modified_base (201)..(201): a, c, t, g, unknown or other
  modified_base (305)..(305): a, c, t, g, unknown or other
  modified_base (353)..(353): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatacaatacaagcctggccacggtccccgctcctcatctatgatgctcngcaggccacgtgcactccagccagtcagtgggtcggtgggttgcacgngtactccactctacaacactcagcacgtcctaccaacctgtaactatttcgacgtatactactttactagtactaacacgtacgtacgtaagtacgttcgggcctctaccgtacgtttcggacgggtaacggaaccggagggtacggaagtaacgtaacgaaaacgacgttaggtaacggctacgaccactacgtctcgtttaccg

SEQ ID NO: 407715 - DNA, 601 bp, Homo sapiens
  misc_feature: GZ8MTXP02FH3L6.45.35.D02.1.454.CMB.2.raw
  modified_base (201)..(201): a, c, t, g, unknown or other
  modified_base (213)..(213): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtattagaacatacttggcctggtatcaatacaagcctggccagggtcccccggctcctcatctatgatgcttccagcaggccactggcatcccagccaggttcagtggcggtgggttgcacagacttcactctcacaatcagcacgcctccaacctagaagtattttgcagtcttaattactagtacaacagacgttaacacgtaagttcggacccgtcctccgtaccgttttaccggggaccgggtaacgggggaacccgtaaagggggttacgggaaagggtaaactaccgaaaaaaccggtaaaccgttagggttaacggggccgttacggacctaaccccgaaacttccgttacggtttacccg

SEQ ID NO: 407716 - DNA, 651 bp, Homo sapiens
  misc_feature: GZ8MTXP02GUXCT.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcacgggccagtcagagtattagaacatactggcctggtatcaatacaagcctggccacgggtccccgctcctcatctatgatgtccttccagcagggcccacgtggcctaacgtccccgagcccgaggtttccagggttggtccggggttggggtttggacctacgtagtaccttccaccgttcctacaactactcagccacgccctaccaacccgtagtaactatttcgacttactacttaactttaccgtagtactaaacgtacgtaccgttaagaagttacggttacggaccgtccgttaccgttaccggtttacggggaccggggtaacggggtaaacggtaaacgggttaggggaaactaacggtaaccgtaaaaacggtaccgtagggtaacggtacgtacggactaccgtactacttcgttaccc

SEQ ID NO: 407717 - DNA, 691 bp, Homo sapiens
  misc_feature: GZ8MTXP02GLPL3.45.35.D02.1.454.CMB.2.raw
  modified_base (212)..(212): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccaggggacacagccacctntcatgcagggccagtcagagtattagaacatacttggcctggtatcaatacagctggccaggtcccgctccgtcactcgtatgatcgcttcaggtcacgggcccacgtggactacgtacccgagtccccgtagggtttacccagggttcgggtccggggtttcgggggttttacggaccgtacgtacggtactttaccgacttaccgtacaactaaactcgacgcacgtcctaccaacctagtaacgtacttttacgactacgttacttacgttacttacgtactaaacgtaacgtacgttaacgtacgtaacgttacgggtaccgtcgttaccgttaaccggtttcggggtaccgggaacggggtaaaccccggtaaagggggtacggtaaacggaaaccgttaaccgaaaaccgtaacggttacggaaccgggttacggtacgaccgtaaccgtactttccggttaacgtttacccg

SEQ ID NO: 407718 - DNA, 625 bp, Homo sapiens
  misc_feature: GZ8MTXP02HUWO8.45.35.D02.1.454.CMB.2.raw
  modified_base (204)..(204): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagacgacctccggagaaattgtcttgacacagtctccagcctattctgtctctctctccgagggganacacgccaccctctcatgcgagggccagtcagagtattagaacatacgtggcctggatacaatacgaagcctgggcccgacggggtcccccgcttccctacgtatcctatcgtatcgtccttccgagcgacgggcccacgtcggcactcccagcctaggtcaggtcggtcgggttggggttcgactacgtagtaccttcaccttcctacaactaaactcgaacgccacgccctaaccgtaaaccgtagtaaacgttacgttttcgacttacgttactttaacttcgttacgtaacaacgtacgtacgtaactagtacgttcgggacctcgtcgtaacggtcggacgggtacggacgagggtacgaagtaacgaacgaaaacgtgtacggtaacgtcgtacgaccaactcgtcgttcgttcc

SEQ ID NO: 407719 - DNA, 592 bp, Homo sapiens
  misc_feature: GZ8MTXP02HTHYO.45.35.D02.1.454.CMB.2.raw
  modified_base (200)..(200): a, c, t, g, unknown or other
  modified_base (412)..(412): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccgagggganacagccacactctcatgcgaggccagtcagagtatagaactatatgctggtatcaatacaagcctggacccgacgggtcccccggctcctacatctatgatcgcttcgagcagggccatgcactccagccccaggtccaggtcgggtcgggttgggttcgctacgagtactccactctacacaactcagcacgcctacctaacgtgaacttnttacgactagttacttatttaactcgttaacaacgtagacgtaacgaagttcgtacggccggtccttaccgtacggtttaccggggacgggtaacgggtacggtaaacgggtcggaaagacgttaaaccgaaacgtaaagtgggtacgaccgttacggacctaccgactttcggttaccg

SEQ ID NO: 407720 - DNA, 606 bp, Homo sapiens
  misc_feature: GZ8MTXP02IO3G3.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagagtattagaacatacttggccttggtatcaaatacaagcctggccacggggtcccccgctcctcatctatgatgccttccagcgagggcccagtggcactcccagcctaggtcaggtcgggcggttggggttcgcacgtagtaaccttcaccgttctcaaacatcagaccacgtccctaccaaccgttagtaacgttactttacgacgttacttacttaacgttaccttaggtaacctaagtacgtaccgtaactagtacttcgggaccctctccgtaacggttccgggacggggtacggtaaccgaagggtggaagtaactaacgaaaacgtacgtggaacggctacggtaccacgtacttacggttcttacc

SEQ ID NO: 407721 - DNA, 623 bp, Homo sapiens
  misc_feature: GZ8MTXP02GHPHN.45.35.D02.1.454.CMB.2.raw
  modified_base (202)..(202): a, c, t, g, unknown or other
  modified_base (214)..(214): a, c, t, g, unknown or other
tcagacgcgatcgacacgaccggtgctcgatttagcacacgatagttgagtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctntcatgcaggccagtcagagtattagaactatacttggcctaggtatcaatacaagcctggccacgggtccccgctccgcatctatgatgtcctcagtcagggccacgtggcacgtcccagccccgaggttccgaggtcgggtcgggttggggtttacgcgtaacgacggtacctttacaccttcgtacaactaaatcacgcaacgccctacgaaaccctagaacgttatttcgactacttacgttaacttactacgtaccaaacgtacggtacgttaaccagtacgttacggggcctccttacgtaccggtttcgggacgggtacggggtaaacccgtaaggggtacggaacgtactaacgaaaaccgtaagtcggtacgacgtacgaccgtaacctacgtactttcgg

SEQ ID NO: 407722 - DNA, 642 bp, Homo sapiens
  misc_feature: GZ8MTXP02FLWUZ.45.35.D02.1.454.CMB.2.raw
  modified_base (199)..(199): a, c, t, g, unknown or other
  modified_base (211)..(211): a, c, t, g, unknown or other
  modified_base (265)..(265): a, c, t, g, unknown or other
  modified_base (280)..(280): a, c, t, g, unknown or other
  modified_base (390)..(390): a, c, t, g, unknown or other
  modified_base (395)..(395): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctcggagaaattgtcttgacacagtctccagccattctgtctctctctccgagggganacagccaccctntcatgcagggcctagtcagtagtattagacatacgtgcctgtatcaatacagcnggccacgggtcccgntcatcatcatgatcgctcagcacgggtccacgtgacctactccccgagccccgtaggttcaggtcggggtacgggttggggtttacgcaacgagtaccttcgaacctttnacaanaaactcgaacgtaccacgtaccctaaccctaaaccgtagtaaacgttaagttttacggaacttacgttaacttaacttaacgttacgtaacccgtaaaactacggtaaccgtaaacgtacgttaacggttcggtacccgccgttaccgtacggttcgggaacggtacgggaaccgtaaacgggtagaacgtacgtaaacgaaacgtaaaccggtggtacgtacgtacgacctactacgtacgttacg

SEQ ID NO: 407723 - DNA, 621 bp, Homo sapiens
  misc_feature: GZ8MTXP02H0R9R.45.35.D02.1.454.CMB.2.raw
  modified_base (202)..(202): a, c, t, g, unknown or other
  modified_base (332)..(332): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcatgcgagggccagtcagtagtatagaactattacttgccttgtatacaatacaacgcctggccgaccgggtccccgctcctcatctatgtatcgccttcagtcgacggggtaccncgtcggacctaccgtcccacggtccgtaggttaccgacggtcggggtcgggttggggtttcggcgtacgtacgtacttccgactctacaactaactcacgcaccgtccacccgaacgtagtacttgtttacgactacgttactactttacgtagtacctaagtacgtacgtaagtagtacgtcggccgttacgtacgtaccggttcggacgggtacggacggtagggtacgtacgacgtaacgaacgttacgaggtaacgcgttacggacctatacgtctttacgtccc

SEQ ID NO: 407724 - DNA, 706 bp, Homo sapiens
  misc_feature: GZ8MTXP02F4NX4.45.35.D02.1.454.CMB.2.raw
  modified_base (202)..(202): a, c, t, g, unknown or other
  modified_base (241)..(241): a, c, t, g, unknown or other
  modified_base (253)..(253): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcagggccagtcagatataganatatggctgatnaatacagctggccgacggtccccgctcctcatctatgtattcgttacagcgacgggccacgtcggactaccgtacccgagccgttaggtcccgtaggggttcgggtcggggtttacggggtttcgggactaacgtacgggtaccctttaccacgttacctaaccgaacgtaaacttcccgaaacggtccaaacccggtacccccttaaccggaaaacccgtttgggtaaaacccgttttcgtttacggaactttaacgttacttaacgttaacgtaccgtaaacggtaaaccgtacgtaccgtaacgtacggtaccggttccgggtaccttaccgttaccgggttaccgggtacggggaacggggaacggtaaacggaggggtacggaacgtaaaccgaaacgtaacgtacgtgacgtaacgacgactacgtctttacgtcctttacttaccg

SEQ ID NO: 407725 - DNA, 703 bp, Homo sapiens
  misc_feature: GZ8MTXP02IDZ4L.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgcccacctctcatgcgagggccagtcagtagtattaagaactatacttggcctggtatacaatacagtcctggccgacgggtccccgctcctcatctatgatgctccgagcgacggcccacgtggcctactcccgagtccgtaggttccgagggttcggggcggggtttggggtttcgacctacgtacgtaccttccgtaccttccgtacaaactaacgtccgacgccaaccgtaccctaacccgtaaacccgtaacggtaacgtttaacgttttacggaccttaagttacttaaacgtttaccgttacgttaaccgtaacgtaacggtaccgtaaccgtaggttaacgttccgggtacccgtacgttaccgttacgggtttaccgggacggggtaaacggggtaaccggtaaggggtacggtaaacggtaaaccgtaacggtaaaacccgtacgttagggaacgtcgtacggacctacgtcgttacgtcgtttacc

SEQ ID NO: 407726 - DNA, 742 bp, Homo sapiens
  misc_feature: GZ8MTXP02G44T9.45.35.D02.1.454.CMB.2.raw
  modified_base (199)..(199): a, c, t, g, unknown or other
  modified_base (282)..(282): a, c, t, g, unknown or other
tcagacgcgatcgacacgaccggtgctcgatttagcacacgatagttgggtttgggggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcgagggccagtcagagtatagacatactgctgtatacaatacagctgccgacgggtccccgctccnatctatgatcgctcagcgaggccacgcggcactcccgagtccgtaggttccccagggttcggggtcggggttggggtttacggacctaacgacggtacctttacgaccgttcctaccgaaactaaactccgaagtcccgtaaaccggtaccccctaacccgtaaacgtagttaaaagttcttttacgacgttaacgttaccttaaagtttaccgtagtaaaccgtaaacgtaggtacccgttaaacgtacggtaacgtttccggggacccgtacgtttaacccgttaccgggggtttacccggggaacgggggttaaaacccggggtaaccggtaaaagggggttccggggaaactaaacggtaaaacccggaaaaacgggtttaaccggtacggggttaccggaacgtaccggtaaacccgtaaccgttcgtttaccggttaccgtttaccctttaccg

SEQ ID NO: 407727 - DNA, 601 bp, Homo sapiens
  misc_feature: GZ8MTXP02GEQI7.45.35.D02.1.454.CMB.2.raw
  modified_base (202)..(202): a, c, t, g, unknown or other
  modified_base (254)..(255): a, c, t, g, unknown or other
  modified_base (262)..(262): a, c, t, g, unknown or other
  modified_base (279)..(279): a, c, t, g, unknown or other
  modified_base (283)..(283): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcagggccagtcagatatagaacatactggctgtannaatacanctggccacggtccccgntccnatctatgatcgctcgagcgacggccatggacacctccagccgaggttcaggtgggcggttgggttcgctacgtgtacttcgacctctacaaactaactacaacgtccaccgtaccctaccctaaaccgttagaaacgttacttttacggactacgtacttaaacttacgtacgttaacgaactacgtaccgtaacaagttacgtcggcccgtactaccgtacgttcgggacgggtaacggaaccggtaagggtcgaaagtaacgtacgaaaaacgtacgtaggtcggactacgaccacgtacttccgtactttacccg

SEQ ID NO: 407728 - DNA, 551 bp, Homo sapiens
  misc_feature: GZ8MTXP02FLCXH.45.35.D02.1.454.CMB.2.raw
  modified_base (199)..(199): a, c, t, g, unknown or other
  modified_base (356)..(356): a, c, t, g, unknown or other
  modified_base (368)..(368): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagacattctgtctctctctccagggganacagccaccctctcatgcagggccagtcagagtattagaacatactggcctggtatcaatacaagcctggccaggggtccccgctcctcatctaatgatgcttacagcagggcccactggcatccagccagtcagtggcggtggttgctcagacttnactctcacatcngcagcctaccaactgaatatttgcagttctattacctagtacctaaacgagtactagacgtaacgttggaccgtctacgtaccgtttcgggaccgggtaacggacccgtaaggggcggaaagactacgaaaaaccgacctttaaggcggtactacggacccaaccgtagtaccgtcgttcccg

SEQ ID NO: 407729 - DNA, 692 bp, Homo sapiens
  misc_feature: GZ8MTXP02HEBKF.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcacgggccagtcagagtattagactatacgttggcctggtatctaatacaacgcctgggccgacggggtccccgctcctcatctatgatcgcctcagcgacggcccacgtggaccacgtaccccgaggtcctaggtcgacgggtcggggtacgggttggggttcggactacggtagtccttcgacctccgtacaaacctactaccgacgccaacgtcccctacccgtaaacgttacggtaaacgtttacgtttacggaccttacgttctttaaacttaccgtttacggtaccctaaaacgcggtaccgtaacgtaaggtacgttccgggacctaccggttaccgttacgggtttacgggggacccgggttaaacggggacccggttaaaggggaccgggtaagtaaaccgtaacgtaaaacccggtagtacggtaacggtcgtacgaccgtacctacgttcgttactttaccg

SEQ ID NO: 407730 - DNA, 677 bp, Homo sapiens
  misc_feature: GZ8MTXP02GMEFK.45.35.D02.1.454.CMB.2.raw
  modified_base (202)..(202): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctctcatcgcgaggccagtcagagtatagaacatacgtggctggtatacaatacaagccgtggccgacgggtccccgctccgtcactctagtgtatcgtccttaccgagcgacgggccctaacgtcgggacctaacgtccccgaggtcccgaggttaccgagggtcgggtcggggttggggtttacgacgtacgtacgtacttaccacctctaacaactaaactacgacgaccacgtaccctacccaaaccgttacgtaacgttactttacgacttaacgttacttaaagttacgttacgtactaaacgtacgtaacgtacgaagttaacgttcggtaccgtacgttaccgttaccgggtttacggggacgggtaaaacgggtaccggaaaggggttacgaaacgaaacgttaacgaaaaccggtgtacgggaagtcgtacgacaacgtactacgttcgttaccg

SEQ ID NO: 407731 - DNA, 901 bp, Homo sapiens
  misc_feature: GZ8MTXP02HBI8R.45.35.D02.1.454.CMB.2.raw
  modified_base (682)..(682): a, c, t, g, unknown or other
tcagacgcgatcgacacgaccggtgctcgatttagcacacgatagttggggtttgggggaggaactgctcagttaggacccagagggaaccatggaagccccagctcagcttctcttcctcctgctactctggctccagagacctccggagaaatttgtcttgacacagtcctccagccattctgtctctctctccgaggggacgacacgcccaccctctcatcgcgacgggccaggtacaggtagtaattagaaactattacgttggccttaggttactacgaaattacaaacggtccgtacggggaccccgaccgggggtccccccggccttaccctactaacgttcctaagtcgtacgtccgtaccttaccgacggaccggtaccgggacccctacggtacggtaccctaaacccgtaccgaaccgggtaccggttacccggggttaacggttcgggggtcggggtttaccgggggttttcggggttccggaacccgtaggtttaacccgtttaaactttacccggttaaccctaaccggttaaactaaaccgtacccgaaaccgtacccgtaaccccgttaaacccctaaaccccgttaaacggtaaggtttaaaacttttcggttaccgtacggggttaaactttaccgttaaactttacggtacctaaaaccccgnggttaaacccggttacggttaacccggaattttcccggggtaaccgtcccccgttaagttaacccggtttccggggtaacgggggaacccgggaaaccggggtaaaacgttaggggggttaacaaacgtaaaccggttaaaaccggaaaaccggtcgggtttaggaccgttaacggaaccgtaccctaacgggttctcccggttacctttacgtaaccc

SEQ ID NO: 407732 - DNA, 575 bp, Homo sapiens
  misc_feature: GZ8MTXP02IS90X.45.35.D02.1.454.CMB.2.raw
  modified_base (357)..(357): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaattgtcttgacacagtctccagccattctgtctctctctccgaggggagacagccaccctctcatcgcagggccagtcagagtatagaactatacttggcctggtatcaatacaagcctaggccgagggtccccgctcctcatctatgatgctcagcaggccatggcatcccagccaggttcagtggcggttggttcggctacgngtaccttcactctacactaaatcaacgcagcccttaccaaaccgttagaacgttattttcgactagtctttaattacctaggtacaacgtacgaccgttaacagtacgttcggcctacttacgtacgtttccgggcgggtaacgggtacgaaagggtcgggaataaacgttcgaaaaaccgtgtaggtcggacttcgactacacgttctacgtttccg

SEQ ID NO: 407733 - DNA, 618 bp, Homo sapiens
  misc_feature: GZ8MTXP02G83M0.45.35.D02.1.454.CMB.2.raw
  modified_base (204)..(204): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccatttctgttctctctctccgagggganacagcccaccctctcatcgcgagggccagtcagatatagaactatacttgcctgtatcaatacagtctggccacgggtccccgctcctcatctatgatgccttccgagcgaggccacgtggcctacgtccgagccgtacggttcgaggtcgggtacggttgggttacggctacgtaggtactttccgactcctacgaactatacagcacgcctaccaacgtagtaacgtagtttcgactacgtcttactttacgtacttacgaacgtacgtacgtaacgaagtacgttcggaccgtacgtaccgtacgtttacggggacggtaacgggtaccggaagggttaggaagtaaacgtaccggtaaaacgtaacgtacggtaacgtacgtacgtacaccgtactaccgtacgtttccg

SEQ ID NO: 407734 - DNA, 623 bp, Homo sapiens
  misc_feature: GZ8MTXP02JXRT0.45.35.D02.1.454.CMB.2.raw
  modified_base (201)..(201): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagcccaccctctcatgcagggccagtcagagtattagaacatacttggcctggtatcaatacaagcctggccacggggtccccgctcctcattctatgatcgtcttccagccgacgggcccacgtcggacactcccaggccctagggttccagggtcgggtcggggttggggttcggactacgtacgtacctttccacttcctacaactaatacacgacacgccctacccaaaccgtagaagttacttttcgactagttacttattactgtacaacgtacgtacgtaacagtacgttcggaccgtcttacgtacgttcggggacgggtaacggggaccgaaggggtacggtaacgacgtaaccgaaaacggtacgttcggtaacggcgtacggacctacctacgttccgttacgtttccc

SEQ ID NO: 407735 - DNA, 569 bp, Homo sapiens
  misc_feature: GZ8MTXP02JLWCH.45.35.D02.1.454.CMB.2.raw
  modified_base (202)..(202): a, c, t, g, unknown or other
  modified_base (216)..(216): a, c, t, g, unknown or other
  modified_base (266)..(266): a, c, t, g, unknown or other
  modified_base (287)..(287): a, c, t, g, unknown or other
  modified_base (292)..(292): a, c, t, g, unknown or other
  modified_base (297)..(297): a, c, t, g, unknown or other
  modified_base (371)..(371): a, c, t, g, unknown or other
  modified_base (472)..(472): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacacgccaccctcncatgcagggccagtcagagtatagaactatacgtggcctggtatcaatanagcctggccacgggtccccgntcctnatcangatgctcagcgaggccagtgacactcccgagccagttcaggtgggacggttggttcggcagcgtactacacctntacaaacgaactacagaccacgtaccctccaaaccgtaggaacttagtttcgactagtacttagttactagtaccaacgacgtactacagtatcgggaccncttacgtacgttcggacgggtaaacggacgaagggttacgacgtaacgtaaccgaaacgtaacgtgtaagacgtcgaccaacctgtaccgtgtaacc

SEQ ID NO: 407736 - DNA, 740 bp, Homo sapiens
  misc_feature: GZ8MTXP02GURAJ.45.35.D02.1.454.CMB.2.raw
  modified_base (203)..(203): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggaagaaattgtcttgacacagtctccagccattctgtctctctctccgagggganacacgccccacctctcatcgcgagggccagtcagtagtattaagaactatacgttggaccgtggtatacaatacaacgccgtcggacccgacgggtcccccggctcctacatctagtgatcgtccttcgagtcggacgggcccacggtcggccacgtcccacggtccgtacgggttcgagggtcggggtcggggtttaggggtttacggacgtacgtagtacccttaccgtaccgttacctacaaaccgtaactaccgacgacccgtaaccgtaccccttaaccaaacccggttagttaaacgttacgttttaacggaccttacgtttaactttaaacgtttacgttaccgttaacgtaaaccgtacggtaacgttaacgtaaacggttacgttccggaccgttccgttaccgttaccgggtttacggggaccgggtaacggggtaccgtaagggggtaacggaacgtaaacgttaaccgaaaacggttacgtagggtcgcgtacggtacctaccttacggtccgtttacgtttccg

SEQ ID NO: 407737 - DNA, 644 bp, Homo sapiens
  misc_feature: GZ8MTXP02H2EYD.45.35.D02.1.454.CMB.2.raw
  modified_base (199)..(199): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactctggctccagagacctccggagaaattgtcttgacacagtctcagccattctgtctctctccgagggganacacgccacctctcatgcagggccagtcagagtatagaacatacgtgctgtatcaatacagccgtggccgacgggtccccgctcctcatctatgatcgctaccgagcgacgggccacgtggacacgtccagcccgtaggttcccaggtgggtcggggttggggttcggacgtacgacgtaccttactacctctacactaactcacgcaccgtcccttacccaaccgtagtaaacgttacgttttacgacgtacgttcttaacttacgttacgtaaccgtaaacgtacgtacgtaacgtaggtaaccgttcggaccgttcgtacgttaccggtttacggggacgggaaccggggtaacgtaaggggttacggaaacgtaaggtaaaccgaaacggtaacgtggtgtaaccgtacggacctacgtctaccgttcgttaacctttccg

SEQ ID NO: 407738 - DNA, 613 bp, Homo sapiens
  misc_feature: GZ8MTXP02FHAGK.45.35.D02.1.454.CMB.2.raw
  modified_base (202)..(202): a, c, t, g, unknown or other
  modified_base (215)..(215): a, c, t, g, unknown or other
  modified_base (318)..(318): a, c, t, g, unknown or other
  modified_base (320)..(320): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccgagggganacagcccaccctntcatgcagggccagtcagagtatagaacatacttggctggtatcaatacagcctggccacgggtccccgctcctcatctatgatgcttcagcaggccatggcncncccagctaggtcagtgggcggttgggttgctacagacttcgactctacaactaactacagccgacacctaccgaacctagaacgtatttagctagtcttaacttactagttaccaaactacgtacgtaacgtagtacgttcggacccgtcgtaaccgttaccgtttcggggaaccggggtaacggggaacccggtaaggggttacggaaacggtaaacgttaaaccggaaaacgtaaccggtttacggaacggtacgtacggaccctaccgtaacttccggtacgtttacccg

SEQ ID NO: 407739 - DNA, 607 bp, Homo sapiens
  misc_feature: GZ8MTXP02FQAYP.45.35.D02.1.454.CMB.2.raw
  modified_base (201)..(201): a, c, t, g, unknown or other
  modified_base (421)..(421): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccacctctcatgcagggccagtcagagtatagaacatacttggctggtatcaatacaagcctaggccagggtccccgctcctcatctatgatgctcagtcagggccactggccactccccgagtccgaggttccaggtgggtcgggttggggtttgctacgtaggtactttaccactctcaaccaatcagcacgtcctaccgaacctgaaacgttntttcggatacgtacttaattaccgtagtactaaagcgtactaacgagtacgtttcgggcctcttacgtaccgtttcgggggacgggtaacgggaaccgtaaagggtccggaaagtaacgttaaccgaaaacgtaaccgtttagggaagggttaccacgggaccctacaacgtttcgtacgtttccc

SEQ ID NO: 407740 - DNA, 530 bp, Homo sapiens
  misc_feature: GZ8MTXP02JHTH4.45.35.D02.1.454.CMB.2.raw
  modified_base (200)..(200): a, c, t, g, unknown or other
  modified_base (212)..(212): a, c, t, g, unknown or other
  modified_base (280)..(280): a, c, t, g, unknown or other
  modified_base (284)..(284): a, c, t, g, unknown or other
  modified_base (350)..(350): a, c, t, g, unknown or other
  modified_base (436)..(436): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccgagggganacagccaccctntcatgcagggccagtcagagtatagaacatactgcctggtatcaatacagcctggccagggtccccgntccnatctatgatgcttccagcaggccagtggcatcccagccaggttcaggtggcggttggttcgcacgngtacttcgactctacaactaatcagccacgtcctaccaactagacgtatttcgactagttctattactgtacaacgtagacgtaanagtagttcggccgtctcgtacgttcggacggtacggacgaggtacggatacgtacgaaacgacgtgtcgcgtacgacgtacactcgtacgttcg

SEQ ID NO: 407741 - DNA, 733 bp, Homo sapiens
  misc_feature: GZ8MTXP02IVOLF.45.35.D02.1.454.CMB.2.raw
  modified_base (203)..(203): a, c, t, g, unknown or other
  modified_base (216)..(216): a, c, t, g, unknown or other
tcagacgcgatcgacacgaccggtgctcgatttagcacacgatagttgggtttggggggaggaactgctcagttaggacccagagggaaccatggaagccccagctcagcttctcttcctcctgctactctggttcccagagacctccggagaaattgtcttgacacagtctccagccattctgtctctctctccgagggganacacgccaccctntcatcgcgagggccagtcaagtagtaattagaacattacgttggctggtatacgaaatacaaaagccgtacggaccgacggggtcccccggaccttccctacgacttacctagtacggattcggtaccttccgaacggtccgaacgggccctaacgtcggtacaccgtaccccgacggaccgtacggttccgacgggtcggggtcggggttaggggtttcggaccgtacgtacgtaccttcacccttcgtaccaacaatccagtacctaccgtacccctaacccaacgttaaccgtaagtttaacgtttcgactacgtttacttaaactttacgttcgttaaacctaggtaaccgtaccggtaaagtacgttacgtccgggtaccgtacttacccgttaccgggtttacgggacgggtacgggtaacggtaacgggtcggaaacgtaaactaaccggaaacgtaacggttcgacggtaaccacggtaacaccgttaggacctttcgtcctttaaccg

SEQ ID NO: 407742 - DNA, 591 bp, Homo sapiens
  misc_feature: GZ8MTXP02HMTO8.45.35.D02.1.454.CMB.2.raw
  modified_base (201)..(201): a, c, t, g, unknown or other
  modified_base (494)..(494): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaactatactggcctggtatcaatacaagcctggcccgacgggtcccccggctcctcatctatgatcgtcttccagcagggcccagtggcactcccagccaggttccaggttcggacggggttggtttcggctacgacgtacttcacttcgtacaactaactcacgctacgccctaccaaccgtagaaacgttatttacgacttagtcttaattactacgtaccaaacgtacgtacgtaacgagtacgtcggaccncttacgtacgttcgggacggtaacggaccggtaagggtacgaaggtaactacgaaaacgacgttaggaacgcgtacgaccacgtactcgtacgttcc

SEQ ID NO: 407743 - DNA, 625 bp, Homo sapiens
  misc_feature: GZ8MTXP02FE3K7.45.35.D02.1.454.CMB.2.raw
  modified_base (200)..(200): a, c, t, g, unknown or other
  modified_base (240)..(240): a, c, t, g, unknown or other
  modified_base (256)..(256): a, c, t, g, unknown or other
  modified_base (292)..(292): a, c, t, g, unknown or other
  modified_base (499)..(499): a, c, t, g, unknown or other
tcagacgcgatcgacacgaccggtgctcgatttagcacacgatagttggggtttgggggaactgctcagttaggacccagagggaaccatggaagccccagctcagcttctcttcctcctgctactctggctcccagagacctccggagaaattgtcttgacacagtctccagccattctgtctctctctccgagggganacagcccaccctctcatgcacgggcagtcagagtataganatacttggctgtatanaatacagccgtgccgacgggtccccgctcctcactntatgatcgacttcgagaccgtagggaccctagcggactacgcccagtcccgtaagttcccgaggggtggacgggttgggttcgacacgtacgtactccgtactcctactaacaagtacaacgacaccggtaccctaccgtaacccgtagtaacgttatttcggaactagtaccttattacgtactaacgaacgtagtaccggttaanagttaccgttacggaccgtcttacgtaacggttacgggacggggaaccggaacggtaggggtagaacgtaacgaacgtaaaaccgtcgtaggtcggtctagacctaacgtctacgtcgtcttaccg

SEQ ID NO: 407744 - DNA, 683 bp, Homo sapiens
  misc_feature: GZ8MTXP02IJ0M9.45.35.D02.1.454.CMB.2.raw
  modified_base (262)..(262): a, c, t, g, unknown or other
  modified_base (307)..(307): a, c, t, g, unknown or other
tcagacgcgatcgacacgaccggtgctcgatttagcacacgatagttgggtttgggggaggaactgctcagttaggacccagagggaaccatggaagccccagctcagcttctcttcctcctgctactctggctcccagagacctccggagaaattgtcttgacacagtctccagcctattctgtctcttctctccgaggggagacacgccaccctctcatgacgagggccagtcagagtaattagaatatactgctggtanactaaatacaagctggccgacggtccccgctcctcatctatgatntctacagcgacggtccacgtcgcactcccagccgtaacggttcgaggtgggtcgggttggggtttacggacgactacgtacttctacgtcctacaactaactcaagacctacgaccctacctaaacgtagtaaagttactttacggactaacgttacttaacgtttacgtacgtaacgtaaaaccgagtaccgtaaacgtaggtaacgttcggtacccgtacgttacgttaccgtttacgggggaaccggggttaacgggaaaccggtaaaggggtcgtaaaaccgggtaacgttaaaccgtaaaaacggtaaccgttagggtaacggttccgaaacggtacctaaaccggttacttacggtttacgtttaacccg

SEQ ID NO: 407745 - DNA, 664 bp, Homo sapiens
  misc_feature: GZ8MTXP02JYL87.45.35.D02.1.454.CMB.2.raw
  modified_base (200)..(200): a, c, t, g, unknown or other
  modified_base (261)..(261): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccgagggganacagccacactctcatgcagggccagtcagtagtattaagaactatactggctggtactanaatacgaacgcctggccgacgggtccccgctcctcatctatgatcgccttcgagcgacgggccacgtcggaccacgtaccccgagcccccgaggtccgtaggtcggggtcgggttcggggttgcctacgacgtacctttacgacttcctacaaacctaacgtcgaacggcctaaaccggtcccctaaacccgaaacccgttaggtaaaacgtttacgttttacggaccttaacgtttacttacgtttaaccgtacgttaacaaacgtacggtacgtaacgtaggttacgttcgggcctcgttacgtacgttcggggacgggaacggaccggtaaagggtggaacgaacgtaaccgaaaacggtacgtggtaccggtacgtacgtaccaccgttacgtctttcg

SEQ ID NO: 407746 - DNA, 653 bp, Homo sapiens
  misc_feature: GZ8MTXP02IXHTP.45.35.D02.1.454.CMB.2.raw
  modified_base (199)..(199): a, c, t, g, unknown or other
  modified_base (258)..(258): a, c, t, g, unknown or other
  modified_base (313)..(313): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggctaggtactnaaatacagcctggccacgggtccccgctcctcatcgtatgtatcgtccttaccgngtacgcggcccctagtcggacctataccccgagtaccgtacggtttccgaggttcggggtcgggtttggggttcgacgtacgacgtacctttccgacttccactacaactcgagcctaacctcctaccgtaacgtagtacgttacgttacgtactacgttacttacgttacgtacgtaactaacgtacgtacgtaactagtacgttccggtaccgtacgtccggttacggtacggggtacgggtaaacgggtaaccggtagggtacggtaaacgaaccgtaaccgaaaacggtcgttacggtaacggtactacgaacctacgtcgtttacgttacgtttc

SEQ ID NO: 407747 - DNA, 729 bp, Homo sapiens
  misc_feature: GZ8MTXP02JUPTQ.45.35.D02.1.454.CMB.2.raw
  modified_base (200)..(200): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccgagggganacacgcccaccctctcatcgcgagggccagtcagaagtattaagaactatacgttggcctggtatacaatacacgcctggccgacgggtccccgctcctcgacttctagtgactcgtccttaccgagcgacgggccctacgtcggccaccgtccccgaggaccgtagggttcgacgggttcggggtaccggggtttggggttacgcgtacgtcgtacgtttaccaccttcgtacaacactcgacgcaccgcctaccaacgtagtaacgttacgtttcgacgttacgttctttaacgtttacgtcgtaaccgtaacgtacggtaccgttaaacgacggttacgttcgggacccgttacttcccggttacccgggtttacgggggaaccgggttaaccgggggaaaacccgggttaagggggtaaccgggtaaacgggaaaccgtaaaaccgggtaaaacccggttaaggttaccggtaacgggtacccgttacggacccttaccggtacgtttccgtaccggtttacccg

SEQ ID NO: 407748 - DNA, 572 bp, Homo sapiens
  misc_feature: GZ8MTXP02FH0V3.45.35.D02.1.454.CMB.2.raw
  modified_base (199)..(199): a, c, t, g, unknown or other
  modified_base (211)..(211): a, c, t, g, unknown or other
  modified_base (282)..(282): a, c, t, g, unknown or other
  modified_base (417)..(417): a, c, t, g, unknown or other
tcagacgcgatcgacacgaccggtgctcgatttagcacacgatagttgggtttgggaggaactgctcagttaggacccagagggaaccatggaagccccagctcagcttctcttcctcctgctactctggctcccagagacctccggagaaattgtcttgacacagtctccagccattctgtctctctctccagggganacagccaccctntcatgcagggccagtcagagtatagaacatacttggcctggtatcaatacaagcctggccagggtccccgntcctcatctatgatgcttccagcagggccactggcatcccaagtccaggttcagtggcggtgggttggctcgagacttcgactctacacaatcagcacgcctacaacctgaagtatttgactagtctaagttacntacgaaacagaccgttaacgacgtaagtttcggccgtcgtccgtaacgtttcgggaccgggtacggggaaacccgtaaaggggttcgggaaagtaacgttacgaaaaaccgtacgtaagtcggtacgtacggctaacccgaattccctaggttcc

SEQ ID NO: 407749 - DNA, 500 bp, Homo sapiens
  misc_feature: GZ8MTXP01AMXF7.38.5.A05.1.454.CMB.2.raw
  modified_base (411)..(411): a, c, t, g, unknown or other
  modified_base (451)..(451): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatgcccccaaaatcatgatttatgagtcactcatcggcctcaggggtttctaatcgccttctctgcatccaagtctggcaaacacggcctccctgaccatctctgggctccaggctgaggacgaggctaattatttcnggcagttcatatacaaccagcaacactctgctaattcggnggagggaccaagcttgccgttcaagtcaagcccaaggctcgcccctcgg

SEQ ID NO: 407750 - DNA, 531 bp, Homo sapiens
  misc_feature: GZ8MTXP01D97A7.38.5.A05.1.454.CMB.2.raw
  modified_base (292)..(292): a, c, t, g, unknown or other
  modified_base (440)..(440): a, c, t, g, unknown or other
  modified_base (523)..(523): a, c, t, g, unknown or other
  modified_base (527)..(531): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaacagtctgagagctgaggacacggccttgtattactgtgacaaaagtnttttgagtttagagtagtaaggtctactatacggtatggacgtctgggggccccaaaggggaccacggtcaccgtctcctcagccctccaccaaggggccccatccggtccttcccctggcgccctgcctccaggcgccacctccganagccacgaggccggccctggggctgcccgtggtacaaggtactacttccacgtgattcgacttgaggcgggcttggcaaggcncagnnnnn

SEQ ID NO: 407751 - DNA, 566 bp, Homo sapiens
  misc_feature: GZ8MTXP01ECP40.38.5.A05.1.454.CMB.2.raw
  modified_base (295)..(295): a, c, t, g, unknown or other
  modified_base (448)..(448): a, c, t, g, unknown or other
  modified_base (462)..(462): a, c, t, g, unknown or other
  modified_base (563)..(566): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaaacagtctgagagctgaggacacggccttgtattactgtgacaaaaagtnttttgagtttagagtagtaagggtctactactacggtatggactcgtggggccccaaaggggaccacggtcacccgtctccctcacgccctcccaaccgtaagggccccatccggtcccttcccccgtggccgcccctgcctcccgaggaccnccaccgtcgagacnccaacgcggccggcccgtgggcctcgccgtggtacaacggtccttacctccgacgtgacttcgacgttgacggcgggcgttggacgaaggcgtaacagtgnnnn

SEQ ID NO: 407752 - DNA, 494 bp, Homo sapiens
  misc_feature: GZ8MTXP01CF3O8.38.5.A05.1.454.CMB.2.raw
  modified_base (219)..(219): a, c, t, g, unknown or other
  modified_base (291)..(291): a, c, t, g, unknown or other
  modified_base (403)..(403): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcatcaccatctcctgcactggaaccngcagtgacgttggtgttataattgtctctggtacaacagcaccggcaatcgacccccaaaatcatgatttangagtcactcatcggcctcgtagggtttctaatcgtccttctctgcatccaagtctggacaacacggccctccctgaccatctctggctcgagctgagcgagctaattattcnggctagtcatatacaaccagcaactactctgctaagtcggcggaggaccaagcttgccttacgtaagtcaacgcccaggcctcgcccctcg

SEQ ID NO: 407753 - DNA, 649 bp, Homo sapiens
  misc_feature: GZ8MTXP01DCG0V.38.5.A05.1.454.CMB.2.raw
  modified_base (229)..(229): a, c, t, g, unknown or other
  modified_base (294)..(294): a, c, t, g, unknown or other
  modified_base (645)..(645): a, c, t, g, unknown or other
  modified_base (647)..(647): a, c, t, g, unknown or other
  modified_base (649)..(649): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctcagagacaacgccaaagaattcccngtatctaacaaatgaacagtctgagagctgaggacacggccttgtattactgtagacaaaaagtnttttgagtttagagtagtaaggtctactactacggtatggacgtcgtggggacccaagggacacggtcaccgtctcctcacgccctaccaaccgaacggggcccctagttcccgggtccctttcccccccgtgggccccgtacccccttggcccttaccccgaaggggaccgaccccaacccgtccggaagaccgaccaaccgggacgggtccccggcccgtggggccttcggcccgttagggtaaccaaacgggtacccttacccgttacccgacggttcgaacgttccggaacgttgggaaccggggccggggttcgttcgggaccgaaggggccaacgttaagtagcngngn

SEQ ID NO: 407754 - DNA, 519 bp, Homo sapiens
  misc_feature: GZ8MTXP01EFHDR.38.5.A05.1.454.CMB.2.raw
  modified_base (292)..(292): a, c, t, g, unknown or other
  modified_base (413)..(413): a, c, t, g, unknown or other
  modified_base (441)..(441): a, c, t, g, unknown or other
  modified_base (487)..(487): a, c, t, g, unknown or other
  modified_base (504)..(504): a, c, t, g, unknown or other
  modified_base (506)..(506): a, c, t, g, unknown or other
  modified_base (513)..(519): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaacagtctgagagctgaggacacggccttgtattactgtgacaaaagtnttttgagtttagagtagtaagggtctactactacggtatggacgtcgtggggccccaaggggacacggtcacccgtctcctcagccctccaccaaggggccccagtccggtcttcccccgnggccgccctgctccaggagcacctcganagcacgagtcggccctgggctgcctggtcaaggtcctattccagtnattcgacttgagcgggngngcaagcnnnnnnn

SEQ ID NO: 407755 - DNA, 544 bp, Homo sapiens
  misc_feature: GZ8MTXP01BBGIQ.38.5.A05.1.454.CMB.2.raw
  modified_base (291)..(291): a, c, t, g, unknown or other
  modified_base (541)..(544): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtaagggtctactactacggtatggacgtcgtgggggccccaaaggggaccacggtcacccggtctccctcacgccctccacccgaagggccccagtccggtcttcccccgtggccgccctgctcccaggcgccacctccgagacgccacgcggccggcccctggggcctgccctggtcaacggtctaccttcacgtgattcgacttgagcgggcttgggccaaggcgcatagnnnn

SEQ ID NO: 407756 - DNA, 496 bp, Homo sapiens
  misc_feature: GZ8MTXP01DY2CP.38.5.A05.1.454.CMB.2.raw
  modified_base (216)..(216): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcatcacatctcctgcactggaaccngcagtgacgttggtgttataaattgtctctggtacaacagcaccgggcaatcgacccccaaaatcatgatttatgaggtcactcatcggcctcgagggtttctaatcgccttctctgcatcccaagtctggcaaacacggcctcctgaccatctctgggctccaggctgaggacgaggctaattattctggctagttcaatatacaaccagacaactatctgctaattcggcggacggacaaagcttagaccgttctaagtcaagccaggctcgccctcg

SEQ ID NO: 407757 - DNA, 566 bp, Homo sapiens
  misc_feature: GZ8MTXP01DPTL9.38.5.A05.1.454.CMB.2.raw
  modified_base (291)..(291): a, c, t, g, unknown or other
  modified_base (422)..(422): a, c, t, g, unknown or other
  modified_base (441)..(441): a, c, t, g, unknown or other
  modified_base (556)..(556): a, c, t, g, unknown or other
  modified_base (563)..(566): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtaagggtctactaactacggtatggacgtcgtggggccccaagggacacggtcaccgtctccctcacgccctccaccaacggggccccagtccggtccttccccccgtggcccncccctgccctccgaggacnccaacccgtcccgaagacgccaacgacggcccgggccctggggctcgccctggtaccaaggtccttaccgttcccagtgaacttcgacttggacggcgggcttcgggcaagggcncgatagnnnn

SEQ ID NO: 407758 - DNA, 576 bp, Homo sapiens
  misc_feature: GZ8MTXP01BB716.38.5.A05.1.454.CMB.2.raw
  modified_base (289)..(289): a, c, t, g, unknown or other
  modified_base (416)..(416): a, c, t, g, unknown or other
  modified_base (444)..(444): a, c, t, g, unknown or other
  modified_base (517)..(517): a, c, t, g, unknown or other
  modified_base (571)..(572): a, c, t, g, unknown or other
  modified_base (574)..(574): a, c, t, g, unknown or other
  modified_base (576)..(576): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaaggccgattcagcatctccagagacaacgccaagaattccctgtatctacaaatgaacagtctgagagctgaggacacggcttgtattactgtgacaaaagtnttttgagtttagagtagtaaggtctactactacggtatggacgtctggggccccaagggaccacggtcaccgtctcctcgacgccctaccacccaaggggcccctaatccgggtccctttcccccgnggccgccccttggcctcccgagggaccnccaccgtcgacgacgccacggcggccggccgtcgggcctcgccgtaggtaccgaacggtaccttaccgtccgngtcgacgttccgacgttgggacggccgggcgttcggacgaacggcgaacagtgnngngn

SEQ ID NO: 407759 - DNA, 538 bp, Homo sapiens
  misc_feature: GZ8MTXP01BMPR2.38.5.A05.1.454.CMB.2.raw
  modified_base (290)..(290): a, c, t, g, unknown or other
  modified_base (410)..(410): a, c, t, g, unknown or other
  modified_base (415)..(415): a, c, t, g, unknown or other
  modified_base (529)..(529): a, c, t, g, unknown or other
  modified_base (535)..(538): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagnttttgagtttagagtagtaaggtctactactacggtatggacgtcgtggggccccaaggggaccacgggtcacccgtctccctcagccctccaccaagggccccatccggtccttccccnggccnccctgctcccaggacgccacctccgagacgccacgagcccgggcccctggggcctgccctggaccaaggtcctacttccacgtgattcgacttgagcgggcttgggcaagggcncatagnnnn

SEQ ID NO: 407760 - DNA, 644 bp, Homo sapiens
  misc_feature: GZ8MTXP01E0YOM.38.5.A05.1.454.CMB.2.raw
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtatgggtctcctggacagtcatcaccatctcctgcactggaaccagcagtgacgttggtagttataaattgtctctgtacaacagcaccggcaatcgacccccaaaatcatgatttatgagtcactcactcgcctgtagggtttactaatcgtccttctctgcataaccaagtcgtcggacaaaccgaccggtccctcccgtcgacccacttcctcgtcgggcctacccgaggtaccgtaggaacgggaccggaggtacttaaatttactttacgtcggggtaccttaagttactaaacttaactaaaccaaaccgacgaaacctaaactaacccttctcgttacgttaacggttccggggaacggggaaacgggaacccgaaacggtccgttaccggttacccgttacccgttaacggtccgaaccggtaccccgaaccgggttccgtccccggttcccccgttcccgg

SEQ ID NO: 407761 - DNA, 529 bp, Homo sapiens
  misc_feature: GZ8MTXP01BKDQ8.38.5.A05.1.454.CMB.2.raw
  modified_base (291)..(291): a, c, t, g, unknown or other
  modified_base (411)..(411): a, c, t, g, unknown or other
  modified_base (522)..(522): a, c, t, g, unknown or other
  modified_base (524)..(524): a, c, t, g, unknown or other
  modified_base (526)..(529): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaacagtctgagagctgaggacacggcttgtatactgtgacaaaagtntttgagtttagagtagtaaggtctactactacggtatggacgtcgtgggaccccaagggaccacggtcaccgtctcctcacgcctccaccgaagggccccatccggtcttcccctggccnccctgcctccaggagcacctccgagagcacgacgccggccctgggctcgccgtggtacaacggtctacttccagtgattcgacttgacgtcgggcttggcgaagggccaanangnnnn

SEQ ID NO: 407762 - DNA, 581 bp, Homo sapiens
  misc_feature: GZ8MTXP01BD5Y0.38.5.A05.1.454.CMB.2.raw
  modified_base (293)..(293): a, c, t, g, unknown or other
  modified_base (450)..(450): a, c, t, g, unknown or other
  modified_base (575)..(575): a, c, t, g, unknown or other
  modified_base (577)..(577): a, c, t, g, unknown or other
  modified_base (579)..(579): a, c, t, g, unknown or other
  modified_base (581)..(581): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaacagtctgagagctgaggacacggccttgtattactgtgacaaaagtnttttgagtttagagtagtaagggtctactactacggtatggacgtgtggggccccaaggggaccacggtcacccgtctccctcacgccctacccaccgaacggggccccagttccgggtcccttcccccgtggccgcccctgcctaccgagggaccnccacctcgagacgccacggacggccggcccgtgggcctcgccgtggtacgaacgtccttactccgacggtcgacgttcgacgttggacggcgggttcgttcgggaccgaagggccgaacagtagngngngn

SEQ ID NO: 407763 - DNA, 507 bp, Homo sapiens
  misc_feature: GZ8MTXP01AZPRX.38.5.A05.1.454.CMB.2.raw
  modified_base (279)..(279): a, c, t, g, unknown or other
  modified_base (291)..(291): a, c, t, g, unknown or other
  modified_base (412)..(412): a, c, t, g, unknown or other
  modified_base (465)..(465): a, c, t, g, unknown or other
  modified_base (478)..(478): a, c, t, g, unknown or other
  modified_base (504)..(507): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaacagtctgagagctgaggacacggcttgtattacngtgacaaaagtnttttgagtttagagtagtagggtctactactacggtatggacgtctggggccccaaagggacacggtcaccgtctcctcagccctcaccagggcccatccgtctccctgcgcctgctcagngcacctccgagagcacgagccggccctgggctgcctggtcaaggactactccncgtgacttcgacngagcgggcgttggcaaggcgcatagnnnn

SEQ ID NO: 407764 - DNA, 529 bp, Homo sapiens
  misc_feature: GZ8MTXP01CV8RA.38.5.A05.1.454.CMB.2.raw
  modified_base (221)..(221): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctcgtgtctggtctcctggacagtcgatcaccatctcctgcactggaaaccngcagtgacgttggtgttataaatttgtctcctggtaccaacagcacccgggcaaatcgcccccaaaatcatgatttatgaggtcactcatcggcctgaggggtttcaatccgcttctctgcaatccaagtctggcaacacggccctcctgaccatctcgtgggctccgaggtctgacggacgagacttaatttatttcgtgctagttcatatacaacagcaaacactctgcttaagttcgggcgaagggaacccaagcgttgaaccgttaataaacggtccacgacccaagggtccttccgtcccccg

SEQ ID NO: 407765 - DNA, 575 bp, Homo sapiens
  misc_feature: GZ8MTXP01BFMCH.38.5.A05.1.454.CMB.2.raw
  modified_base (282)..(282): a, c, t, g, unknown or other
  modified_base (291)..(291): a, c, t, g, unknown or other
  modified_base (357)..(357): a, c, t, g, unknown or other
  modified_base (425)..(425): a, c, t, g, unknown or other
  modified_base (567)..(567): a, c, t, g, unknown or other
  modified_base (570)..(570): a, c, t, g, unknown or other
  modified_base (572)..(575): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtnacaaaagtnttttgagtttagagttagtaaggtctactactacggtatggacgtcgtggggccccaaggggaccncgggtcacccgtccttccctcacgccctccaaccgaacggggccccagttccggtccctttcccccgnggcccgcccctgcctcccgaggacgccaaccgtccgagacgccacgacggccggcccctgggggcctacggcccttgggtacccaaagggtccctacttcccacggtgacttcggacttgacgcgggcttgggcaagggccntangnnnn

SEQ ID NO: 407766 - DNA, 535 bp, Homo sapiens
  misc_feature: GZ8MTXP01E2872.38.5.A05.1.454.CMB.2.raw
  modified_base (219)..(219): a, c, t, g, unknown or other
  modified_base (408)..(408): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtgttataattgtctctggtaccaacagcaccggcaatcgacccccaaaatcatgatttatgaggtcactcatcggcctcgtagggtttctaatcgtccttctctgcatccaagtctggcaacacggcctccctgaccatctctgggctccgaggctgaggacgaggcttaaagttnttctggcagttcaatactaaacacacaacaactctctcgtactcggtcggacgggaacgaacgtacgtcgttaccgttccttacgtaacgacgaaccgaacgcgttccctccccgttcccgttcccg

SEQ ID NO: 407767 - DNA, 630 bp, Homo sapiens
  misc_feature: GZ8MTXP01CL8MN.38.5.A05.1.454.CMB.2.raw
  modified_base (227)..(227): a, c, t, g, unknown or other
  modified_base (289)..(289): a, c, t, g, unknown or other
  modified_base (417)..(417): a, c, t, g, unknown or other
  modified_base (442)..(442): a, c, t, g, unknown or other
  modified_base (628)..(628): a, c, t, g, unknown or other
  modified_base (630)..(630): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaaggccgattcagcatctcagagacaacgccaagaattcccngtatctacaaatgaacagtctgagagctgaggacacggccttgtattactgtgacaaaagtnttttgagtttagagtagtaagggtctactactacggtatggacgtcgtggggacccccaaggggaccacggtcacccgtctcctcagccctaccacccaaaggggccccatccggtcctttcccccgnggcccgtccctgcctaccgaggacnccacccgtccgaagacgccaacggacggtcccgggccccgtggggcctcggacccgttgggtaacccgaaacggtaccctttacccgttacccgaacggttcggtaacgttcccggtaacgttcgggaacgggtcccgggggttaccgttggggaacccgaaacggggccgaacttaagagcgcgngn

SEQ ID NO: 407768 - DNA, 615 bp, Homo sapiens
  misc_feature: GZ8MTXP01APRV4.38.5.A05.1.454.CMB.2.raw
  modified_base (217)..(217): a, c, t, g, unknown or other
  modified_base (252)..(252): a, c, t, g, unknown or other
  modified_base (261)..(261): a, c, t, g, unknown or other
tcagtcgatcacgtcacgaccggtgctcgatttagatagatagacagggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtgttataattgtctctgtacanagcaccggnaatcgaccccaaaatcatgatttactagtagtacgtactactactacggtccgtcctacgggtttacggttaactacgtcccgttcttctcgtcactaacctacgtaacgtcgtacgaaccaaccgtccgtccctcgtaccactctcgtcggtcgtccctacggacgtcgaggaacggacggtacgttaacttaattttacgttcggtacgtacgttactaacttaacttaacaaaccgaacgaacaacctaaacctcttcgcgttaacgttacggttcgggaacggacggtaacgcgttcgaccgttaccgtaacgtacgcgaccgaccggttacgtccgttcccgtccccgg

SEQ ID NO: 407769 - DNA, 535 bp, Homo sapiens
  misc_feature: GZ8MTXP01DZ7NI.38.5.A05.1.454.CMB.2.raw
  modified_base (281)..(281): a, c, t, g, unknown or other
  modified_base (293)..(293): a, c, t, g, unknown or other
  modified_base (434)..(434): a, c, t, g, unknown or other
  modified_base (444)..(444): a, c, t, g, unknown or other
  modified_base (487)..(487): a, c, t, g, unknown or other
  modified_base (490)..(490): a, c, t, g, unknown or other
  modified_base (527)..(527): a, c, t, g, unknown or other
  modified_base (529)..(529): a, c, t, g, unknown or other
  modified_base (532)..(535): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaaacagtctgagagctgaggacacggccttgtattacngtgacaaaagtnttttgagtttagagtagtaaggtctactactacggtatggacgtctggggcccaaaggggaccacggtcaccgtctcctcagccctaccaccaaggggccccagtccggtccttccccctggcgcccctgcctccaggacnccacctcganacgcacgcgccggcctgggctgcctggtacaagtactactccngtnattcgacgttggagcgggcgttggacgaagggctaananagnnnn

SEQ ID NO: 407770 - DNA, 513 bp, Homo sapiens
  misc_feature: GZ8MTXP01CZ43B.38.5.A05.1.454.CMB.2.raw
  modified_base (289)..(289): a, c, t, g, unknown or other
  modified_base (425)..(425): a, c, t, g, unknown or other
tcagtcgatcacgtcacgaccggtgctcgatttagatagatagacagggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctctgcactggaaccagcagtgacgttggtgttataaattgtctctggtacaacagcaccggcaatgacccccaaaatcatgatttangaggtcactcatcggcctcagggtttctaatcgccttctctgcatcccaagtctggcaacacggcctccctgaccatctctgggctccgaggctgaggacgaggctaattatttctggcagtttcatatacaaccngacaactactctgctaattcgggcggacggaccgaaagcttacggccgttacctaagtccaacgcccaaggccttcgcccccgttcgg

SEQ ID NO: 407771 - DNA, 549 bp, Homo sapiens
  misc_feature: GZ8MTXP01EPX82.38.5.A05.1.454.CMB.2.raw
  modified_base (297)..(297): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaattgtctctggtaccaacagcaccggcaatcgacccccaaaatcatgatttangagtcactcatcggcctcgtaggggtttctaatcccgcttctctgcaatccaagtctggcaacaccggcctcctgaccatctctgggcctcgaggctgaggacgagtacttaaatttactttctgtctattacaatactaacaacagacaaactactctgtcttaagttcgggacggaacgggaaccaaacgttcgttacgacccgttaacctaacgtccgaacgacccgaagggtcccttccggtcccccg

SEQ ID NO: 407772 - DNA, 569 bp, Homo sapiens
  misc_feature: GZ8MTXP01DJY2A.38.5.A05.1.454.CMB.2.raw
  modified_base (220)..(220): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctctgcactggaaccngcagtgacgttggtgttataattgtctctggtacaacagcaccggcaatcgacccccaaaatcaatgtatttatgagtcactcatcggcctcgtagggtttctaatcgtccttctctgcatcccaagtctggacaacaccggcctcctgacccatctctgggctcgaggctggaggacgagacttaattatttacgtggtactagttcaattactaaccaaaccagaccaaactacttctgtcttaacgttccgggcggtaacgggacccaaaggtccttacggttacccgttaccgtaaacgtcccaacggccccgaaacgggttccctaaccggccccccgttccgg

SEQ ID NO: 407773 - DNA, 553 bp, Homo sapiens
  misc_feature: GZ8MTXP01CSOGT.38.5.A05.1.454.CMB.2.raw
  modified_base (221)..(221): a, c, t, g, unknown or other
  modified_base (291)..(291): a, c, t, g, unknown or other
  modified_base (434)..(434): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtagttataattgtctctgtacacagcaccggcaatcgaccccaaatcatgtatttangagtcactcatcggcctcgtacgggtttactaatcgtccttctctgctactaccaagttcgtaggaccaaacgtaccggccctccctgaccctatctcgtcgggctccgaggcgtaggacggacgaggtacttaattatttcnggtctagttcaatactaacaactagacaactctctgcttaagtcgggacggacgggacctaaacggcttacgccgttacgtaacgtaccaacgacccgaggccctccgcccccgttcgg

SEQ ID NO: 407774 - DNA, 557 bp, Homo sapiens
  misc_feature: GZ8MTXP01APLKR.38.5.A05.1.454.CMB.2.raw
  modified_base (282)..(282): a, c, t, g, unknown or other
  modified_base (291)..(291): a, c, t, g, unknown or other
  modified_base (419)..(419): a, c, t, g, unknown or other
  modified_base (545)..(545): a, c, t, g, unknown or other
  modified_base (554)..(557): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtnacaaaagtnttttgagtttagagtagtaagggtctactactacggtatggacgtcgtggggccccaagggacacggtcacccgtctcctcacgccctccaccgaagggccccatccgggtccttcccccgtggcccnccctgcctacccgaggacgccaccctccgagacgccacgacggccggcccctggggcctcgcccgtggtacaaggtacctacttccacggtgaacgctggacggtcggggcttgggcaaggggccncgaatggcnnnn

SEQ ID NO: 407775 - DNA, 481 bp, Homo sapiens
  misc_feature: GZ8MTXP01C403C.38.5.A05.1.454.CMB.2.raw
  modified_base (217)..(217): a, c, t, g, unknown or other
  modified_base (288)..(288): a, c, t, g, unknown or other
  modified_base (397)..(397): a, c, t, g, unknown or other
  modified_base (426)..(426): a, c, t, g, unknown or other
  modified_base (461)..(461): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcacatctctgcactggaaccngcagtgacgttggtgttataaattgtctctgtacaacagcaccggcaatcgaccccaaaatcatgatttangagtcactcatcggcctcagggtttctaagtcgccttctctgcatccaagtctggcaaacacggcctccctgaccatctctggctcagctgagacgagctaattattcnggctagttcatatacacagacaacactcngctaatcggcggaggaccaagcttgaccttctaancaagccaggctcgcccgtcg

SEQ ID NO: 407776 - DNA, 578 bp, Homo sapiens
  misc_feature: GZ8MTXP01EENWE.38.5.A05.1.454.CMB.2.raw
  modified_base (226)..(226): a, c, t, g, unknown or other
  modified_base (337)..(337): a, c, t, g, unknown or other
  modified_base (368)..(368): a, c, t, g, unknown or other
  modified_base (374)..(374): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcaggcacagggtcctggggcccaggtcctaggccctggctcagcctgcctccgtgtctgggtctcctggacagtcgatcaccatctcctgcactggaaccngcagtgacgttggtgtataattgtctctgacacagcaccggcaatcgaccccaaaatcatgatttatgagtcactcatcggcctcgtaggggtttctaatccgcttctctncaactccaagtctggacaacacggcctcctnaccctntctcgtcggcctcgacgcgtaggacggacgagtacttaatttactttcgtcgtctaattactaattaactaaccaaacgaacacctaactactcgtcgtaacgttacgttcggggacggaacggttaaccgaacggttccgttacggttacccgttaaccgtaacgtaaccgaccgacccgttacggtcccgttcccgtccccg

SEQ ID NO: 407777 - DNA, 572 bp, Homo sapiens
  misc_feature: GZ8MTXP01EU556.38.5.A05.1.454.CMB.2.raw
  modified_base (293)..(293): a, c, t, g, unknown or other
  modified_base (430)..(430): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaattgtctctgacaacagcaccggcaatcgacccccaaaatcatgatttangagtcactcatcggccctcgtaggggtttctaatccgtcttctctgctaactccaagtctgggaccaacgaccggccctcctacgacccatctcgtgggccttccgaggctaggacgggacgaggtacttaaatttntttcgtgtactagttacaataactaaccaaacacgacaaactactctgtcttaacgttcgggacgggaacgggaaccaaggttccgttcggacccgtaaccgtaagtccacggacccgaacggtcccgttcccggtcccccg

SEQ ID NO: 407778 - DNA, 517 bp, Homo sapiens
  misc_feature: GZ8MTXP01B7CV7.38.5.A05.1.454.CMB.2.raw
  modified_base (220)..(220): a, c, t, g, unknown or other
  modified_base (260)..(260): a, c, t, g, unknown or other
  modified_base (295)..(295): a, c, t, g, unknown or other
  modified_base (381)..(381): a, c, t, g, unknown or other
  modified_base (419)..(419): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtatctgggtctcctggacagtcgatcaccatctcctgcactggaaccngcagtgacgttggtgttaataatttgtctctggtaccaanagcaccggcaatcgacccccaaaatcatgatttangagtcactcatcgcctcgagggtttcaatcgtccttctctgcataccaagtctggaccaacaccggccctccctgacccatctcgngggctccgaggctggaggacgaggtcttaattatttcnggtctagttcatactaacaacagacaactactctgctaagtcgggcggacggacaagcttcgccttctaagcaacgccgagcctccgccccgttccgg

SEQ ID NO: 407779 - DNA, 553 bp, Homo sapiens
  misc_feature: GZ8MTXP01EY69U.38.5.A05.1.454.CMB.2.raw
  modified_base (291)..(291): a, c, t, g, unknown or other
  modified_base (413)..(413): a, c, t, g, unknown or other
  modified_base (437)..(437): a, c, t, g, unknown or other
  modified_base (544)..(544): a, c, t, g, unknown or other
  modified_base (550)..(553): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggatctgtgaagggccgattcagcatctccagagacaacgccaaagaattccctgtatctacaaatgaacagtctgagagctgaggacacggccttgtattactgtgacaaaagtnttttgagtttagagtagtaaggtctactatacggtatggacgtcgtggggaccccaagggaccacggtccaccgtctccctcacgccctccaccgaacgggccccatccggtccttcccccnggccgccctgctcccgagggaccnccaccgcgagacgcacgcggccggcccgtgggcctcgccgtggacgaacgtcctactccgagtcgacttcgacgttggacggcgggcgttcgggacgaaggcgtaanagtagnnnn

SEQ ID NO: 407780 - DNA, 505 bp, Homo sapiens
  misc_feature: GZ8MTXP01ANYQ6.38.5.A05.1.454.CMB.2.raw
  modified_base (410)..(410): a, c, t, g, unknown or other
  modified_base (412)..(412): a, c, t, g, unknown or other
  modified_base (418)..(418): a, c, t, g, unknown or other
  modified_base (422)..(422): a, c, t, g, unknown or other
  modified_base (430)..(430): a, c, t, g, unknown or other
tcagtcgatcacgtcacgaccggtgctcgatttagatagatagacaggggtcgtcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataattgtctctggtacaacagcacccgggcaatgcccccaaaatcatgatttatgaggcactcatcggcctcagggggtttctaatcgccttctctgcatcccaagtctggcaaacacggcctccctgaccatctctgggctccaggctgaggacgaggcttaaatatttcgngntagttnatanaccaacanacactctctgctaagtcggcggaacgggaccaagcttgacccgttcctaagtcaacgcccaggcctcgccccgtg

SEQ ID NO: 407781 - DNA, 502 bp, Homo sapiens
  misc_feature: GZ8MTXP01BPDDA.38.5.A05.1.454.CMB.2.raw
  modified_base (222)..(222): a, c, t, g, unknown or other
  modified_base (300)..(300): a, c, t, g, unknown or other
  modified_base (373)..(373): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtggttataaatttgtctcctggtaccaacagcacccgggcaatcgcccccaaaatcatgatttangaggtcactcatcggccctcgaggggtttctaatccgcttctctgcaatccaagtctggcacacggcctcctnaccatctctggctccaggctgaggacgagctaattactttcgtgctagttcatatacaacagcaacactctgctattcggcggaggaccaagcgttcgaccgtctaagtcagcccaggcttcgtccccg

SEQ ID NO: 407782 - DNA, 560 bp, Homo sapiens
  misc_feature: GZ8MTXP01B52IA.38.5.A05.1.454.CMB.2.raw
  modified_base (294)..(294): a, c, t, g, unknown or other
  modified_base (441)..(441): a, c, t, g, unknown or other
  modified_base (540)..(540): a, c, t, g, unknown or other
  modified_base (554)..(554): a, c, t, g, unknown or other
  modified_base (556)..(560): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaaggccgattcagcatctcagagacaacgccaaagaattccctgtatctaacaaatgaaacagtctgagagctgaggacacggtccttgtattactgtagacaaaagtntttgagtttagagtagtaggtctatacgtaggtatggacgtgtggggacccaagggacacggtcaccgtctcctcacgccctacccaaccgaacgggcccctagtcccggtcccttccccgtggcccgccctgcctacccgaggacnccacctcgagacgacctaacggcgccggcccgtgggccttcgcccgttggtaccaacggtcctaccttccacgtgacttcgacgttgacggcggttcgnggacaagggtcaanannnnn

SEQ ID NO: 407783 - DNA, 524 bp, Homo sapiens
  misc_feature: GZ8MTXP01EORN8.38.5.A05.1.454.CMB.2.raw
  modified_base (223)..(223): a, c, t, g, unknown or other
  modified_base (229)..(229): a, c, t, g, unknown or other
  modified_base (260)..(260): a, c, t, g, unknown or other
  modified_base (296)..(296): a, c, t, g, unknown or other
  modified_base (426)..(426): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccaggtctgccctggctcagcctgcctccgtgtctgggtctcctggacagtcgatcaccatctcctgcactggaaccngcagtnacgttggtgttataattgtctctgaccaacngcacccgggcaatcgacccccaaaatcatgatttangagtcactcatcggcctcgtaggggtttctaatccgtcttctctgctaactccaagtctcgggaccaacgaccggccctaccctcgaccatctcgtgggctccgaggctgacggacgaggtactaaattnttcgtgctagttcaatatacaacagtacaacactctgcttagttcgggcgagggacaagcgttgccgtaacaagtccagccacggtccttcgtccccg

SEQ ID NO: 407784 - DNA, 669 bp, Homo sapiens
  misc_feature: GZ8MTXP01D65CK.38.5.A05.1.454.CMB.2.raw
  modified_base (219)..(219): a, c, t, g, unknown or other
  modified_base (256)..(256): a, c, t, g, unknown or other
  modified_base (264)..(264): a, c, t, g, unknown or other
  modified_base (290)..(290): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtatgggtctcctggacagtcgatcaccatctctgcactggaaccngcagtgtacgttggtagttataattgtctctgtacangcaccggnaactcgaccccaaatcatgtatttangagtcactcacgtcgcctagtacggttactatcgtccttctctcgactactaaccgttaacgtcgtacgaaccaaaccgtccggtacccctccgtacgtaaccctactccgttccggtcgggccttaccggacggtacgtaggacgggtaacgtaggttaactttaatttacgtttcgtacggtacttaacgtttactaaacttaaccaaaccgaaaccgaacgtaaaccctaaactactttccgtacggttacggttaacggttaccggggacggggtaaaccggaaccgtaaacggtccgttaccggttacccgttaccgtaacgtacccgtaaccgacccggtaacggttcccgttccccggttccccgtttccgg

SEQ ID NO: 407785 - DNA, 509 bp, Homo sapiens
  misc_feature: GZ8MTXP01B7PS5.38.5.A05.1.454.CMB.2.raw
  modified_base (193)..(193): a, c, t, g, unknown or other
  modified_base (267)..(267): a, c, t, g, unknown or other
  modified_base (424)..(424): a, c, t, g, unknown or other
  modified_base (443)..(443): a, c, t, g, unknown or other
  modified_base (500)..(500): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacngtcgatcaccatctcctgcactggaaccagcagtgacgttggtgttataattgtctctgtacaacagcaccggnaatgccccaaaatcatgatttatgagtcactcatcggccctctaggggtttctaatccgtcttctctgcaatccaagtctggcaacacggcctcctgaccatctctgggcctccgaggcctggaggacgaggacttaattatttctgctagttcatntaacaaccagcaacactcngctagttcggcggttagggaccaagttcttgacccgtctaagtcacgcccaaggtcncgtcccccg

SEQ ID NO: 407786 - DNA, 532 bp, Homo sapiens
  misc_feature: GZ8MTXP01A1QW2.38.5.A05.1.454.CMB.2.raw
  modified_base (291)..(291): a, c, t, g, unknown or other
  modified_base (439)..(439): a, c, t, g, unknown or other
  modified_base (512)..(512): a, c, t, g, unknown or other
  modified_base (523)..(523): a, c, t, g, unknown or other
  modified_base (529)..(532): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtaagggtctactactacggtatggacgtcgtggggccccaagggacacggtcacccgtctcctcagcctccaccaagggcccatcggtcctccccctggccgccctgctcccgaggacgccacctccgagngccacgacgccggcccctggggctggccctgggtcaaggtcctacttccagtgattcgacttgacggcgggcngggcaagggcncatagnnnn

SEQ ID NO: 407787 - DNA, 600 bp, Homo sapiens
  misc_feature: GZ8MTXP01C8S8V.38.5.A05.1.454.CMB.2.raw
  modified_base (221)..(221): a, c, t, g, unknown or other
  modified_base (258)..(258): a, c, t, g, unknown or other
  modified_base (291)..(291): a, c, t, g, unknown or other
  modified_base (429)..(429): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataattgtctctgtacaacngcaccggcaatcgaccccaaatcatgtatttangagtcactcactccggcctgtacggggtttctaatcgtccttctctgcataccaagtcgtacggacaaccgaccgccctccctcgaccctattctcgtcgggctcgaggctaggacggacgagtacttaattatttcnggtctagttacaatactaacaacacacaaactctctacgtcttaacggtcgggacgggtaaacgggaccgtaaacggtccgttaccggttaccccgttaaccgtttaaacgggtacccaaccgggtaccccgaaacgggttccccttccccggttccccccgtttcccggg

SEQ ID NO: 407788 - DNA, 610 bp, Homo sapiens
  misc_feature: GZ8MTXP01DB6KT.38.5.A05.1.454.CMB.2.raw
  modified_base (291)..(291): a, c, t, g, unknown or other
  modified_base (605)..(606): a, c, t, g, unknown or other
  modified_base (608)..(608): a, c, t, g, unknown or other
  modified_base (610)..(610): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtaggtctactacacggtatggacgtcgtggggccccaaggggaccacggtccacccgtcctcctcacgtccctccaccgaacgggccccagtcccggtcccttcccccgtggccgcccctgccctccgacggacgccaccctccgaagacgccacggacggcccggtcccctgggggccttacggccccgttgggtaccaaacgggtacccttaacctttccccgaacggttcgaacgttccggaaccttgggaacggtcccgggggcttcggggaccgaaacgggcgaacgatagnngngn

SEQ ID NO: 407789 - DNA, 498 bp, Homo sapiens
  misc_feature: GZ8MTXP01BWODE.38.5.A05.1.454.CMB.2.raw
  modified_base (220)..(220): a, c, t, g, unknown or other
  modified_base (291)..(291): a, c, t, g, unknown or other
  modified_base (408)..(408): a, c, t, g, unknown or other
  modified_base (422)..(422): a, c, t, g, unknown or other
  modified_base (429)..(429): a, c, t, g, unknown or other
  modified_base (440)..(440): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataattgtctctgtacaacagcaccggcaatcgacccccaaaatcatgatttangagtcactcatcgcctcgagggtttcaatcgcttctctgcataccaagtctggacaacaccggcctccctgaccatctcgtgggctccgagctagaggacgaggactaattatttcnggctagttcattanacaaccngacaactactntgctaagtcggcggaggacaagcttgccttctaagcaacgccaggctccgccccgtcg

SEQ ID NO: 407790 - DNA, 551 bp, Homo sapiens
  misc_feature: GZ8MTXP01DU5IE.38.5.A05.1.454.CMB.2.raw
  modified_base (290)..(290): a, c, t, g, unknown or other
  modified_base (416)..(416): a, c, t, g, unknown or other
  modified_base (434)..(434): a, c, t, g, unknown or other
  modified_base (440)..(440): a, c, t, g, unknown or other
  modified_base (545)..(545): a, c, t, g, unknown or other
  modified_base (547)..(548): a, c, t, g, unknown or other
  modified_base (550)..(551): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtagggtctactactacggtatggacgtcgtggggcccaagggaccacggtcacccgtctcctcacgccctaccaccgaacgggcccagtccggtccttccccgtggccnccctgcctccgagggacnccaccncgagacgcacgcggccggtccgtgggctcgccgtggtacaacggtcctacctcgacgtgtcgttcgacgttggacggcgggcgttgggacgaagggccaagtagngnngnn

SEQ ID NO: 407791 - DNA, 600 bp, Homo sapiens
  misc_feature: GZ8MTXP01B02QO.38.5.A05.1.454.CMB.2.raw
  modified_base (294)..(294): a, c, t, g, unknown or other
  modified_base (596)..(600): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaaacagtctgagagctgaggacacggtcttgtattactgtgacaaaagtntttgagtttagagtagtaaggtctactactacggtatggacgtcgtggggaccccaagggacacggtccaccgtctccctcacgccctacccaccgaacggggccccagttcccggtcccttcccccgtggcccgcccctggccctcccgagggacgcccaacccgtccgaagacgcccaacggacggcccggccccgtgggggcctcggcccgttgggtaccaaagggtacccttaccgttcccgaacggttcggaaccgttacgtcggacggccggggcttgggcaagggcgacaagtgnnnnn

SEQ ID NO: 407792 - DNA, 530 bp, Homo sapiens
  misc_feature: GZ8MTXP01B40Z6.38.5.A05.1.454.CMB.2.raw
  modified_base (221)..(221): a, c, t, g, unknown or other
  modified_base (414)..(414): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataatttgctctggtacaacagcaccggcaatcgacccccaaaatcatgtatttatgagtcactcatcggcctgtacgggtttctaatcgtccttctctgcatccaagtctggcaacgacggccctcctgaccatctcgtgggctccgagctgacggacgaggtctaattatttcngctagttcatactaacaacagtaccaactactctgctaagttcggacggacgggaccaaagtcttacgcccgttactaagtccaacgcccgaaggcctaaccggcccccgttaacg

SEQ ID NO: 407793 - DNA, 570 bp, Homo sapiens
  misc_feature: GZ8MTXP01BHZ1P.38.5.A05.1.454.CMB.2.raw
  modified_base (279)..(279): a, c, t, g, unknown or other
  modified_base (290)..(290): a, c, t, g, unknown or other
  modified_base (566)..(567): a, c, t, g, unknown or other
  modified_base (569)..(570): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattacngtgacaaagtntttgagtttagagtagtagggtctactactacggtatggacgtcgtggggccccaagggaccacggtcaccgtctcctcacgccctccaccgaagggccccatcccggtccttcccccgtgggcccgcccctgccctccgagggacgccaccgtcccgagacgccacgacggccgggccccgtggggcctggccccttgggtaccaaacgggtaccttaccttccaacggtgaattccggacttggacggcgggcttcgggacaagggcgcagagnngnn

SEQ ID NO: 407794 - DNA, 570 bp, Homo sapiens
  misc_feature: GZ8MTXP01DOYND.38.5.A05.1.454.CMB.2.raw
  modified_base (221)..(221): a, c, t, g, unknown or other
  modified_base (375)..(375): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtgttataaatttgtctcctggtaccaacagcacccgggcaatcgaccccaaaatcatgatttatgagtcactcactcgcctcgtaggggtttctaatccgtcttctctgcaactccaagtctgacaacgaccggcctcccncgacctatctcgtggctccgaggctgacgggacgagtactaatttactttcgtgtcctagttacatataacaaacacgactaactactctgaacttagttcgggacggttaacggaaccgaagttccgttacgacccgtttaaccgtaaacgtccgaaccgacccgaaacgggtcccttaaccggtcccccccgg

SEQ ID NO: 407795 - DNA, 569 bp, Homo sapiens
  misc_feature: GZ8MTXP01BYBIA.38.5.A05.1.454.CMB.2.raw
  modified_base (447)..(447): a, c, t, g, unknown or other
  modified_base (560)..(560): a, c, t, g, unknown or other
  modified_base (563)..(563): a, c, t, g, unknown or other
  modified_base (566)..(569): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctacaaatgaacagtctgagagctgaggacacggccttgtattactgtgacaaaagtttttgagtttagagtagtaaggtctactactacggtatggacgtcgtgggggcccaaggggaccacggtccacccgtctccctcacgccctaccacccgaaggggccccaattcccgggttcccttcccccgtgggccgcccctgctcccagggcnccacctccgagacgccacgacggcccggccctggggcctcgcccgtggtacaaacggtcctaccttcccgaacgttgaacttcgacttggacggcgggcgttggcaagggtcncanagnnnn

SEQ ID NO: 407796 - DNA, 581 bp, Homo sapiens
  misc_feature: GZ8MTXP01CYXFH.38.5.A05.1.454.CMB.2.raw
  modified_base (290)..(290): a, c, t, g, unknown or other
  modified_base (578)..(581): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaaggccgattcagcatctcagagacaacgccaagaattccctgtatctaacaaatgaacagtctgagagctgaggacacggtcttgtattactgtgacaaaagtnttttagagtttagagtagtaagggtctactactacggtatggacgtcgtggggccccaaggggaccacggtcacccgtctccctcacgccctaccaccgaacgggccccagtcccggtcccttccccgtggcccgccctgcctccgaggtacgccacccgtcgaagacgccaacgacggccggccccgttggggcctcggacccgtggtaccgaaacggtacctaccttccgacggttcgaacttcgtacttgggacgcggggaccgttgggacgaaggcgcagtagnnnn

SEQ ID NO: 407797 - DNA, 590 bp, Homo sapiens
  misc_feature: GZ8MTXP01DWRMX.38.5.A05.1.454.CMB.2.raw
  modified_base (282)..(282): a, c, t, g, unknown or other
  modified_base (291)..(291): a, c, t, g, unknown or other
  modified_base (430)..(430): a, c, t, g, unknown or other
  modified_base (451)..(451): a, c, t, g, unknown or other
  modified_base (585)..(586): a, c, t, g, unknown or other
  modified_base (588)..(588): a, c, t, g, unknown or other
  modified_base (590)..(590): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaacagtctgagagctgaggacacggcttgtattactgtnacaaaagtnttttgagtttagagtagtaggtctactactacggtatggacgtcgtggggaccccaaggggaccacggtccacccggtctccctcacgccctaccaaccgaacggggccccagttcccggtcccttcccccgtggcccnccctgccctcccgagggaccnccaccgtccgagacgccacggacggcccggtcccgtcgggcctcggccgttaggtaccaaacggtacccttaccttcccgacgtgacgttcgacgttggacggcgggcgttcgggacgaaggccgaacgagtgnngngn

SEQ ID NO: 407798 - DNA, 528 bp, Homo sapiens
  misc_feature: GZ8MTXP01C4PYW.38.5.A05.1.454.CMB.2.raw
  modified_base (219)..(219): a, c, t, g, unknown or other
  modified_base (291)..(291): a, c, t, g, unknown or other
  modified_base (440)..(440): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctctgcactggaaccngcagtgacgttggtgttataattgtctctggtacaacagcacccggcaatcgacccccaaatcatgatttangagtcactcatcggcctgtagggtttctatcgcttctctgcactaccaagtctggacaaacgacggccctcctgaccctatctcgtgggctcgaggctggaggacgaggtactaagtttacttctggctagttacattacaccaaccanaccaaactactctcgtctaagttcgggacgggacggaccaaaggcttacgaccgttcctaagcaacgcccaggcctccgccccgttcg

SEQ ID NO: 407799 - DNA, 593 bp, Homo sapiens
  misc_feature: GZ8MTXP01DLB1X.38.5.A05.1.454.CMB.2.raw
  modified_base (291)..(291): a, c, t, g, unknown or other
  modified_base (425)..(425): a, c, t, g, unknown or other
  modified_base (443)..(443): a, c, t, g, unknown or other
  modified_base (586)..(586): a, c, t, g, unknown or other
  modified_base (588)..(588): a, c, t, g, unknown or other
  modified_base (590)..(593): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtggaagggccgattcagcatctcagagacaacgccaaagaattccctgtatctaacaaatgaacagtctgagagctgaggacacggcttgtatactgtgacaaaagtntttgagtttagagtagtaaggtctactactacggtatggacgtcgtcggggacccaagggaccacggtcacccgtctcctcacgccctacccaaccgaacgggccctagtcccggtcccttcccccgtggcccnccctgccctccagggacnccacccgtccgagacgccaacggacggtcccggcccgtgggcctcgccccgttgggtacccaaacgggtaacccttaccgttacccgacggttcgaacgttcggaacttggaacggcggggccttggggaccaaggggccaanangnnnn

SEQ ID NO: 407800 - DNA, 516 bp, Homo sapiens
  misc_feature: GZ8MTXP01BRW34.38.5.A05.1.454.CMB.2.raw
  modified_base (222)..(222): a, c, t, g, unknown or other
  modified_base (265)..(265): a, c, t, g, unknown or other
  modified_base (289)..(289): a, c, t, g, unknown or other
  modified_base (359)..(359): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgtataaattgtctctgacacagcaccggnaatcgccccaaaatcatgatttangaggtcactcatccggccctcgtagggggtttctaatcccgtcttctctgcaactccaagtctggcaacnccgggccctcccgaccatctctgggctccgaggctggaggcgaggctaattattctggctagttcatatacaaccagacaactctctgctaattcgggcggacgggacaagcttcgccgttacgtaagtcaacgcccgaggcctccgccccgtccgg

SEQ ID NO: 407801 - DNA, 589 bp, Homo sapiens
  misc_feature: GZ8MTXP01BK2DY.38.5.A05.1.454.CMB.2.raw
  modified_base (291)..(291): a, c, t, g, unknown or other
  modified_base (372)..(372): a, c, t, g, unknown or other
  modified_base (423)..(423): a, c, t, g, unknown or other
  modified_base (438)..(438): a, c, t, g, unknown or other
  modified_base (582)..(582): a, c, t, g, unknown or other
  modified_base (585)..(589): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtaaggtctactactacggtatggacgtcgtggggccccaaggggaccacgggtccacccgtccncctcaacgtccctaccaccgaacggcctacgtccgtcccttcccgcggccncctcgctccgaggcncccaccgcgaagcgtaccacgggacgggtcccgggtcccgtggggtctacccggtcccggttaggtaaccggaacggtaccccttacgtttcccgaggtaagtcgttcgaccgttgggacggtcgggccttgggacgaacggcnagnnnnn

SEQ ID NO: 407802 - DNA, 518 bp, Homo sapiens
  misc_feature: GZ8MTXP01CTQKW.38.5.A05.1.454.CMB.2.raw
  modified_base (252)..(252): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttatactatgtctcnggtacaacaacacccaggcaaacgccccaaactcatcatttatgacgtcactcatcggccctcaggggtttctactcccgcttctctggctaccaagtttggcaacacggcctccctgaccattctgggctcagctgaggacgagctgtatttatgctctctatatacaggcacgcacgcctaccccttatcgtcttcggaacttgggaaccacggtccaccgttccgttcgttcaacgacccaaggcccaacccactcgctaacc

SEQ ID NO: 407803 - DNA, 543 bp, Homo sapiens
  misc_feature: GZ8MTXP01EJ3QU.38.5.A05.1.454.CMB.2.raw
  modified_base (223)..(223): a, c, t, g, unknown or other
  modified_base (460)..(460): a, c, t, g, unknown or other
  modified_base (473)..(473): a, c, t, g, unknown or other
tcagtcgatcacgtcacgaccggtgctcgatttagatagatagacagggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctctggtaccaacagcacccggcaactcgacccccaaaatcatgatttatgaggtcactcatccggcctacgtaggggtttctaatccgcttctctgctaatccaagtctaggacaacacggccctcctacgacctatctcgtgggccttcgaggctggacggacgaggtacttaaatttatttctggtctagttacatagtacaaccanactaacactcctncttagttcgggacggttaggaacctaagcgttcgaccgtctaggcacgaccgacggtccttcgtcccccg

SEQ ID NO: 407804 - DNA, 561 bp, Homo sapiens
  misc_feature: GZ8MTXP01EHQAS.38.5.A05.1.454.CMB.2.raw
  modified_base (221)..(221): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctggtctcctggacagtcgatcaccatctcctgcactggaaccngcagtgacgttggtagttataaattgtctcctggtaccaacagcaccggcaatcgacccccaaaatcatgatttatgaggtcactcatccggccctcgaggggtttctaatccgcttctctgcaactccaagtctggacaaccgaccggcctccctcgaccctatcctcgtcgggcctccgaggcctggacggacgagtacttaaatttatttcgtgtctagttacaatataaccaaaccaacgacaaactaccttctcgtcttagttccgggacggacgggaccaaagcgttcgacccgtaacctaagccacgacccgaacgccgttaaccgtcccccg

SEQ ID NO: 407805 - DNA, 574 bp, Homo sapiens
  misc_feature: GZ8MTXP01AIIJL.38.5.A05.1.454.CMB.2.raw
  modified_base (294)..(294): a, c, t, g, unknown or other
  modified_base (513)..(513): a, c, t, g, unknown or other
  modified_base (570)..(571): a, c, t, g, unknown or other
  modified_base (573)..(574): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaacagtctgagagctggaggacacggccttgtattactgtgacaaaagtnttttgagtttagagtagtaaggtctatactacggtatggacgtcgtggggccccaagggaccacggtccaccgtctccctcacgccctccaccgaagggcccatcggtccttcccctggccgcccttcgctccgaggacgccacctccgagacgcacggacggccgggcccctggggcctgcccgtgggtaccaaacggtccttacctcccgaccggtnaacgttcgaccgttggacggcccggggttcgcgggaccgaagggcgaaccgagtagnngnn

SEQ ID NO: 407806 - DNA, 568 bp, Homo sapiens
  misc_feature: GZ8MTXP01ESHR9.38.5.A05.1.454.CMB.2.raw
  modified_base (292)..(292): a, c, t, g, unknown or other
  modified_base (552)..(552): a, c, t, g, unknown or other
  modified_base (562)..(562): a, c, t, g, unknown or other
  modified_base (564)..(568): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaacagtctgagagctgaggacacggcttgtattactgtgacaaaagtnttttgagtttagagtagtaaggtcactactacggtatggacgtcgtgggggccccaaaggggaccacgggtcacccggtaaactccctcacgccctcccaacccgaacggggccccagtcccggttccttcccccgtgggccgcccctggcccttacccgagggacgccaccgtcccgagacgcaacgacgccgggccctgggctcggcctcggtacaaggtcctacgttcccaacgtgacttcggacttggagccgggngcgcgaagcnannnnn

SEQ ID NO: 407807 - DNA, 599 bp, Homo sapiens
  misc_feature: GZ8MTXP01CHXQM.38.5.A05.1.454.CMB.2.raw
  modified_base (219)..(219): a, c, t, g, unknown or other
  modified_base (256)..(256): a, c, t, g, unknown or other
  modified_base (289)..(289): a, c, t, g, unknown or other
  modified_base (329)..(329): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcacatctcctgcactggaaccngcagtgacgttggtagttataatttgctctgtacaangcaccggcaatcgaccccaaatcatgtatttangagtcactcatccgcctgtagggtttacatcgtccttctntgactataccctaagtcgtgaccaaaccgtccggcctccctgaccctattcgtcgtgggtcctaccgaggtcgtaggaacgacgtagtacttaaatttcgttctacggtacgttaacgtttaccaattaactaaccaaaccgtacgtaacaactactcgtacgtcgttaaacggtcgggaccggtaggaaacccgtaaggtccttacgttaccggttacctaaggtccaaccggtacccgacggttccttaacccggccccgtttaaccg

SEQ ID NO: 407808 - DNA, 623 bp, Homo sapiens
  misc_feature: GZ8MTXP01DBVHY.38.5.A05.1.454.CMB.2.raw
  modified_base (217)..(217): a, c, t, g, unknown or other
  modified_base (358)..(358): a, c, t, g, unknown or other
  modified_base (368)..(368): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcatcacatctctgtactggaacngcagtgacgttggtagttataattgtctctgtacaacagcacccggcaatcgacccccaaaatcatgtatttatgagtcactcatcggccctcgtagggtttactaatcgtcttcctctgctatccaaagtctggcaaacncggccctccncgacactctcgtcggctccgaggctaggacggacgtaggtcttaaagtttattcgtagtactagtttacaataactaaccaaacccgagacctaaaactaccttaccgtagtccttaaggttccggggacggggaacgggaaacccgttaaacggtcccgtaacggttaccccgttaaccgttaaacggttcccgaacccggaaccccgttaaaccgggcccgttacccggtccccccgttcgggttaacccccg

SEQ ID NO: 407809 - DNA, 573 bp, Homo sapiens
  misc_feature: GZ8MTXP01CN6TF.38.5.A05.1.454.CMB.2.raw
  modified_base (261)..(261): a, c, t, g, unknown or other
  modified_base (271)..(271): a, c, t, g, unknown or other
  modified_base (297)..(297): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtagttataattgtctcctggtaccaanagcaccgggnaactcgaccccaaatcatgtatttangagtcactcactcggcctagtagggtttctatcgtccttctctgcagtacccaagtcgtgacctaaccgacggccctcctcgaccctattcctcgtgggcctccgaggctaggaacggacggaggtaccttaaattctttacgtggtacctagtttacaactataaccaacagaacaactactctgtactgttacggggcggtaacggaccgtaaagtccttacgcccgttaccgtaagtccaacggcccgtaaggccctccgttcccccgttcgg

SEQ ID NO: 407810 - DNA, 527 bp, Homo sapiens
  misc_feature: GZ8MTXP01AZ5TS.38.5.A05.1.454.CMB.2.raw
  modified_base (221)..(221): a, c, t, g, unknown or other
  modified_base (296)..(296): a, c, t, g, unknown or other
  modified_base (422)..(422): a, c, t, g, unknown or other
  modified_base (442)..(442): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaattgtctctggtaccaacagcacccggcaatcgacccccaaaatcatgatttangaggtcactcatcggccctcgtaggggtttctaatcgcctttctctgcatccaagtctggcaacgacgcctccctgacccatctcgtgggctccgaggcctggaggacgaggtcttaattatttcnggctagttcatatacaacanacaactctctgctaagttcggacggacgggaccaaggcttcgccgttacctaagtccaacgtcccgaggcctccgcccccgtcgg

SEQ ID NO: 407811 - DNA, 506 bp, Homo sapiens
  misc_feature: GZ8MTXP01A63XX.38.5.A05.1.454.CMB.2.raw
  modified_base (221)..(221): a, c, t, g, unknown or other
  modified_base (261)..(261): a, c, t, g, unknown or other
  modified_base (271)..(271): a, c, t, g, unknown or other
  modified_base (405)..(405): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctctggtacaacngcacccgggnaatcgacccccaaaatcatgatttatgaggtcactcatcggcctcgaggggtttctaatcgtccttctctgcataccaagtctggcaacacggcctcctgacccatctcgtcgggctcaggctggacgacgagntaattattctgctagttcatactacaacagacaactactctgctaagtcggacggacggacgagcttagccgttctaagcaacgccaggctcgccccgtcg

SEQ ID NO: 407812 - DNA, 599 bp, Homo sapiens
  misc_feature: GZ8MTXP01CBHSP.38.5.A05.1.454.CMB.2.raw
  modified_base (252)..(252): a, c, t, g, unknown or other
  modified_base (261)..(261): a, c, t, g, unknown or other
  modified_base (286)..(286): a, c, t, g, unknown or other
  modified_base (427)..(427): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctggtctcctggacagtcgatcaccatctctgcactggaaccagcagtgagttggtgttataattgtctctgtacanagcaccggnaatcgacccccaaatcatgatttangagtcactcatcggcctgtacgggtttctatcgtccttctctgcatccaagtctgaccaacgaccggccctccctcgacctactcctcgttcgggccttccgaaggtcctaggacgggtaaccgaggttacttaaagtttntttcgtggtactaagtttcaaacttaactaaccaaaccgtagacccaaactaccttctacgtaccgttaacgttcgggacgggaaacggttaaccgaaggtccgttacggcccgttaccgtaaacgtccgaacgtccccgaacggttccgttccccgaacccccgtttcccg

SEQ ID NO: 407813 - DNA, 571 bp, Homo sapiens
  misc_feature: GZ8MTXP01D83KA.38.5.A05.1.454.CMB.2.raw
  modified_base (218)..(218): a, c, t, g, unknown or other
  modified_base (263)..(263): a, c, t, g, unknown or other
  modified_base (413)..(413): a, c, t, g, unknown or other
  modified_base (450)..(450): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcacatctctgcactggaaccngcagtgacgttggtgttaataattgtctctgtacacagcaccggnaatcgaccccaaaatcatgtatttatgagtcactcatcggcctcgtagggtttctaatcgtccttctctgcactaccaagtctggaccaaacaccggcctcctgacctatctcgtcgggctcgaggctgacggacgaggtacttaaattntttcctaggtctagtttacaattaactaccaaaccanaccaaactacttactcgtcgtaacgttcgggacgggtaacgggaaccaacggtccgttacggacccgttacctaacggtaccaacgtccccgaagggcccttcccggcccccgtttcccgg

SEQ ID NO: 407814 - DNA, 537 bp, Homo sapiens
  misc_feature: GZ8MTXP01C6KBD.38.5.A05.1.454.CMB.2.raw
  modified_base (218)..(218): a, c, t, g, unknown or other
  modified_base (291)..(291): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctggtctcctggacagtcgatcacatctctgcactggaaccngcagtgacgttggtgttaataattgtctctgtaccaacagcaccggcaatcgacccccaaatcatgtatttangaggtcactcatcggcctgtagggtttctatcgccttctctgcataccaagtctggcaacgacggccctcctgacccatctcgtgggctccgaggctagaggacgaggtctaattattctgggtactagttacataactaaccaacagaccaactactctcgtctaagttcgggacggtacgggaccgaaagtcgttacgaccgttaccgtaagtccaacgcccaggcctccgcccccgttaacgg

SEQ ID NO: 407815 - DNA, 516 bp, Homo sapiens
  misc_feature: GZ8MTXP01BIYG5.38.5.A05.1.454.CMB.2.raw
  modified_base (449)..(449): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctctggtaccaacagcacccgggcaatcgcccccaaaatcatgatttatgaggtcactcatcggccctcgtaggggtttctaatccgcttctctgcaatccaagtctggcacaccggcctcctcgaccatctcgtgggctccgaggctgaggacgagcttaattacttcgtgctagttcatatacaacagcaacactctncttagttcgggcggaggaccaagccgttgacccgtctaagtccacgcccgaggtccttcgtcccccg

SEQ ID NO: 407816 - DNA, 607 bp, Homo sapiens
  misc_feature: GZ8MTXP01B0502.38.5.A05.1.454.CMB.2.raw
  modified_base (293)..(293): a, c, t, g, unknown or other
  modified_base (447)..(447): a, c, t, g, unknown or other
  modified_base (603)..(603): a, c, t, g, unknown or other
  modified_base (605)..(605): a, c, t, g, unknown or other
  modified_base (607)..(607): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtgggtctcaggtattagttggaacagtggtaggataggctatgcggactctgtgaagggccgattcagcatctccagagacaacgccaaagaattccctgtatctaacaaatgaacagtctgagagctgaggacacggccttagtattactgtgacaaaagtnttttgagtttagagtagtaaggtctactactacggtatggacgtcgtggggaccccaaggggaccacggtcaccgtctccctcacgccctaccaccgaacgggccccagtcccggtccttcccccgtggcccgccctagcctacccgagggacnccacccgtccgagacgccaacgacggcccggccccgtggggccttcggcccgttgggtaccaaacgggtcccttaaccgtttcccgaaggttcgtacgttccggtaaccttgggaaccgggcggggaccttggggaccaaggggcccaagagtgcngngn

SEQ ID NO: 407817 - DNA, 669 bp, Homo sapiens
  misc_feature: GZ8MTXP01D7M0K.38.5.A05.1.454.CMB.2.raw
  modified_base (218)..(218): a, c, t, g, unknown or other
  modified_base (294)..(294): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcaggcacagggtcctgggcccagtctgccctggctcagcctgcctcgtgtctgggtctcctggacagtcgatcaccatctctgcactggaaccngcagtgacgttggtgttaataaatttgtctctggtaccaacagcaccggcaatcgaccccaaaatcatgtatttangagtcactcatcgcctgtagggtttcaatcgtccttctctgcactaccaagtcgtaggaccaaaccgaccggcccttacccctagtaaccctacttccttcgtcggggtccttacccgagggtacgttacgggaacggaaccgaagggttaaaccttaaattttacgtttcccgtaggggtcttaacgtttacaatttaactaaaccaaacgacgaaccctaaacctaaccttcgttacgacgtttaacggttccggggacgggtaaacggaacccgaaaagtcccgttacggttaccccgttaaccccttaaagggtcctaaccgggaaccccgtaaacgggttcccttaaccccgccccccgtttaacccggg

SEQ ID NO: 407818 - DNA, 551 bp, Homo sapiens
  misc_feature: GZ8MTXP01C83XA.38.5.A05.1.454.CMB.2.raw
  modified_base (292)..(292): a, c, t, g, unknown or other
  modified_base (424)..(424): a, c, t, g, unknown or other
  modified_base (446)..(446): a, c, t, g, unknown or other
  modified_base (468)..(468): a, c, t, g, unknown or other
  modified_base (513)..(513): a, c, t, g, unknown or other
  modified_base (531)..(531): a, c, t, g, unknown or other
  modified_base (543)..(543): a, c, t, g, unknown or other
  modified_base (547)..(551): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctcagagacaacgccaagaattccctgtatctaacaaatgaacagtctgagagctgaggacacggtccttgtattactgtgacaaaagtnttttgagtttagagtagtaaggtctactactacggtatggacgtcgtcgggggaccccaaggggaccacggtccacccgtcctcctcgacgccctaccaccgaacgggccccagtccggtcccttcccccgnggccgccctgccctccgaggcnccaccgtccgagacgccacggnggccggccctggggcctcgcctggtacaaggtcctactccgagtnattcgacttgagcggcgnggacaagggccntagnnnnn

SEQ ID NO: 407819 - DNA, 561 bp, Homo sapiens
  misc_feature: GZ8MTXP01CT38J.38.5.A05.1.454.CMB.2.raw
  modified_base (217)..(217): a, c, t, g, unknown or other
  modified_base (250)..(250): a, c, t, g, unknown or other
  modified_base (299)..(299): a, c, t, g, unknown or other
  modified_base (382)..(382): a, c, t, g, unknown or other
  modified_base (413)..(413): a, c, t, g, unknown or other
tcagtcgatcacgtcacgaccggtgctcgatttagatagatagacgaggggggtctcaggaggcagcgctctcaggacatctccaccatggcctgggctctgctgctcctcaccctctcactcagggcacagggtcctgggcccagtctgccctggctcagcctgcctcgtgtctgggtctcctggacagtcgatcaccatctctgcactggaaccngcagtgacgttggcaattataactctgtctcgnggtaccaaacaacacccaggaccaacgacccccaaaatcatcatttatnacgtcactcatcggcctcagggtttcactccgcttctctggctccaaagtttcggcaaacacggcctaccctgacctatttcnggctccagctggagacgaggctataattttntctctctactatataacgagacgacgacgacgacctacccttacgtacgtcgttaacgtaacgttacggtaaccgaacgtaccgtaccgttaccgttccgttaccgaaccgacccgaaccgaacccaacccttacctcgttcgtaacc

SEQ ID NO: 407820 - DNA, 519 bp, Homo sapiens
  misc_feature: GZ8MTXP01A1BMY.38.5.A05.1.454.CMB.2.raw
  modified_base (221)..(221): a, c, t, g, unknown or other
  modified_base (411)..(411): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtgttataaatttgtctctgacaacagcaccggcaatcgacccccaaaatcatgatttatgagtcactcatcggcctgaggggtttctaatccgcttctctgcaatccaagtctgggacaacacggtcctccctcgaccctatctctcgggctccgaggctgaggacgagctaaattnttcgtgctattacattacaacaacacgcaaactctctgctaagttcgggacggagggaccaagcgcgaccgtcctaaggccacggcccaagggtcccgcccgtccccg

SEQ ID NO: 407821 - DNA, 567 bp, Homo sapiens
  misc_feature: GZ8MTXP01CVCC2.38.5.A05.1.454.CMB.2.raw
  modified_base (291)..(291): a, c, t, g, unknown or other
  modified_base (526)..(526): a, c, t, g, unknown or other
  modified_base (564)..(567): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtaaggtctactacgtacggtatggacgtgtgggggccccaaggggaccacggtccaccgtcctccctcacgccctcccaccgaacggggcccctatcccgggtccttcccccgtgggccctcccctgccctcccgaggacgccacccgtccgagacgccacgacggccggcccctggggctcggcctgggtaccaaggtcctaccgttccaggtgtanccggacttggacggcgggcttggaccaaggcgcagtgnnnn

SEQ ID NO: 407822 - DNA, 518 bp, Homo sapiens
  misc_feature: GZ8MTXP01EJF6U.38.5.A05.1.454.CMB.2.raw
  modified_base (220)..(220): a, c, t, g, unknown or other
  modified_base (268)..(268): a, c, t, g, unknown or other
  modified_base (396)..(396): a, c, t, g, unknown or other
  modified_base (466)..(466): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtgttaataatttgtctctggtacaacagcaccggnaatcgacccccaaaatcaatgtatttatgagtcactcatcggcctcgtagggtttctaatcgccttctctggctcaaagtctggcaacacgcctccctgaccatctctggactccgagctgaggacgngctgaattactactggctagttcatatacagcactactcctcttctgttaattcggcgggtacggaccgngggtacgaccgttcgttaacgtcacgccaaggccttcgcccccgttggtccc

SEQ ID NO: 407823 - DNA, 588 bp, Homo sapiens
  misc_feature: GZ8MTXP01CNO73.38.5.A05.1.454.CMB.2.raw
  modified_base (222)..(222): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtggttataatttgtctctgacaacagcaccggcaatcgaccccaaaatcatgtatttatgaggtcactcatccggtccctcgtaggggtttctaactccgtcttctctcgctaactccaagtctacggtacaacaccggccctccctagaccctatcctcgtcggggtcctccgaggtcgtcggaggacgaggtacttaatttactttcgtggtcctagttacaatactaaccaacctacgcaacactctcgtctaacgttccgggacgggaacgggtacccaaggttccgttcggacccgtaaccgtaacgtccgaccggaccccgaacggtcccgttaaccggtccccccg

SEQ ID NO: 407824 - DNA, 554 bp, Homo sapiens
  misc_feature: GZ8MTXP01CUVQA.38.5.A05.1.454.CMB.2.raw
  modified_base (284)..(284): a, c, t, g, unknown or other
  modified_base (293)..(293): a, c, t, g, unknown or other
  modified_base (415)..(415): a, c, t, g, unknown or other
  modified_base (436)..(436): a, c, t, g, unknown or other
  modified_base (455)..(455): a, c, t, g, unknown or other
  modified_base (544)..(544): a, c, t, g, unknown or other
  modified_base (549)..(549): a, c, t, g, unknown or other
  modified_base (551)..(554): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaacttccctgtatctaacaaatgaacagtctgagagctgaggacacggccttgtattactgtnacaaaagtnttttgagtttagagtagtaagggtctactactacggtatggacgtcgtggggccccaaggggaccaggtccaccgtctcctcacgccctccacgaacgggccccagtccggtccttccccgnggccgccctgcctcgaggacnccaccgtcgagcgccacgngccggtccctgggcctgccgtggtaccaaggtaccttaccttccgacgtgaacttccgacgttggacggcgggttcgttggcaagggcnctagngnnnn

SEQ ID NO: 407825 - DNA, 567 bp, Homo sapiens
  misc_feature: GZ8MTXP01D3XQ0.38.5.A05.1.454.CMB.2.raw
  modified_base (229)..(229): a, c, t, g, unknown or other
  modified_base (257)..(257): a, c, t, g, unknown or other
  modified_base (294)..(294): a, c, t, g, unknown or other
  modified_base (382)..(382): a, c, t, g, unknown or other
  modified_base (442)..(442): a, c, t, g, unknown or other
  modified_base (556)..(556): a, c, t, g, unknown or other
  modified_base (560)..(560): a, c, t, g, unknown or other
  modified_base (563)..(565): a, c, t, g, unknown or other
  modified_base (567)..(567): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaaggccgattcagcatctccagagacaacgccaaagaattcccngtatctaacaaatagaacagtctgaganctgaggacacggccttgtattactgtagacaaaagtnttttgagtttagagtagtaggtctactagtacgtatgacgtcgtggggccccgaagggcaacggtcacccgtctcctcacgcctaccnccgaaacgggccccagttccggtcccttcccccgtggcccgccctcgcctaccagggacnccaccctccgagacgctaccggcggtccggccccgtgggcctcgccttggtaccaaggtccttaacgtccgacgtgacttcgacgttgacggccgggcgttgggccgaagggcncganagnnngn

SEQ ID NO: 407826 - DNA, 538 bp, Homo sapiens
  misc_feature: GZ8MTXP01D2VAJ.38.5.A05.1.454.CMB.2.raw
  modified_base (295)..(295): a, c, t, g, unknown or other
  modified_base (436)..(436): a, c, t, g, unknown or other
  modified_base (449)..(449): a, c, t, g, unknown or other
  modified_base (495)..(495): a, c, t, g, unknown or other
  modified_base (498)..(498): a, c, t, g, unknown or other
  modified_base (507)..(507): a, c, t, g, unknown or other
  modified_base (532)..(532): a, c, t, g, unknown or other
  modified_base (534)..(535): a, c, t, g, unknown or other
  modified_base (537)..(538): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaacagtctgagagctgaggacacggtccttgtattactgtgactaaaaagtnttttgtagtttagagttaagtaagggtctacttacgtaggtatggactcgtcgggcccaagggacacggtcaccgtctcctcacgccctccaccgacgggcccatccgtccttccccgtgccgcctgcctaccgaggaccnccaccgcgagacncacgggcggccgtccgtggcctcgtccgtggacacgtctacctcgngtncgttcgcgnggcggcggcgcggacgaagcaagangnngnn

SEQ ID NO: 407827 - DNA, 579 bp, Homo sapiens
  misc_feature: GZ8MTXP01CYRO3.38.5.A05.1.454.CMB.2.raw
  modified_base (239)..(239): a, c, t, g, unknown or other
  modified_base (398)..(398): a, c, t, g, unknown or other
  modified_base (570)..(570): a, c, t, g, unknown or other
  modified_base (573)..(573): a, c, t, g, unknown or other
  modified_base (575)..(576): a, c, t, g, unknown or other
  modified_base (578)..(579): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtgggtctcaggtattagttggaacagtggtagataggctatgcggactcgtgtgaagggccgattcagcatctcagagacaacgccaaagaattccctgtatactaaanaaatacgaactagtcagagagctagagacgacgtcttagtattactgtagaataaagtatttagtaagttagagtaaggtaaggtactaacgtacgtagtagtcggacgtcgacggggaacccgaacggacgtacggtacctaccgtacctcctcgacnccctaccgaacgacggcctacgtcccgtccctcccgcgccgtcctcgcacgagacgccaccgcgagacgacacggacgccggtccgtcggcgtcgtccgtacgtaacgaacgtacctaccgtccgacgtaagtacgttacgacgttggacggcggcgttggacgaaggcaanagngnngnn

SEQ ID NO: 407828 - DNA, 505 bp, Homo sapiens
  misc_feature: GZ8MTXP01CDRRX.38.5.A05.1.454.CMB.2.raw
  modified_base (219)..(219): a, c, t, g, unknown or other
  modified_base (294)..(294): a, c, t, g, unknown or other
  modified_base (407)..(407): a, c, t, g, unknown or other
  modified_base (432)..(432): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataatttgtctctggtaccaacagcaccgggcaatcgacccccaaaatcatgatttangagtcactcatcggcctgagggtttctaatcgtccttctctgcatccaagtctggccaacacggcctcctgacccatctctgggctccgaggctgaggtacgaggctaaattnttctggctagttcatatacaaccanacactctctgctaacgtcggacggacggacagtcttacgaccttctaagcaacgccagttcctccgccccgtg

SEQ ID NO: 407829 - DNA, 614 bp, Homo sapiens
  misc_feature: GZ8MTXP01D0VDP.38.5.A05.1.454.CMB.2.raw
  modified_base (209)..(209): a, c, t, g, unknown or other
  modified_base (280)..(280): a, c, t, g, unknown or other
  modified_base (293)..(293): a, c, t, g, unknown or other
  modified_base (461)..(461): a, c, t, g, unknown or other
  modified_base (607)..(607): a, c, t, g, unknown or other
  modified_base (609)..(610): a, c, t, g, unknown or other
  modified_base (612)..(612): a, c, t, g, unknown or other
  modified_base (614)..(614): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccattcagcatctccaganacaacgccaaagaattccctgtatctaacaaatgaacagtctgagagctgaggacacggccttgtattacngtagacaaaagtnttttgaagtttagaagttagtaagggtctaactactaacggtatggacgtcgtggggaccccaaggggaccacggtcacccgtctcctcacgcctccaaccgaaggggccccaagttcccggtcccttccccccgtgggcccgcccctggccctaccccgagggaccncccgaacccgtccgaagacgaccaaccgggacggtcccgggcccgtcggggcctcggcccgttagggtaaccaaacggtaccttaccgttccgacgtcgtacgttccggacttgggacggcgggcgttgggacgaaggctaacagngnngngn

SEQ ID NO: 407830 - DNA, 589 bp, Homo sapiens
  misc_feature: GZ8MTXP01DS0MY.38.5.A05.1.454.CMB.2.raw
  modified_base (218)..(218): a, c, t, g, unknown or other
  modified_base (255)..(255): a, c, t, g, unknown or other
  modified_base (284)..(284): a, c, t, g, unknown or other
  modified_base (286)..(286): a, c, t, g, unknown or other
  modified_base (291)..(291): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcatcaccatctcctgcatggaaccngcagtgacgttggtagttaataattgtctctgtacangcaccggcaatcaccccaaatcatgattnanagtanctacatcgccgtcgtggttacgtatacgtcctctctctcactaactactcgtcgtacgaaccacgcccgtcctcgtacactctctcggtcgtccacggacgtcggaggacggacgtacgttaactttaactttcgttagtacgtacgttactactaattaaccaaccaacaactaacccatacctgacgttaacgttcgggttaccgggacggaaacggaaccgtcgttacggttaccgttaccgttaacggtaacgtccgacccgacggttaccgtcccgttccccggttaaccccg

SEQ ID NO: 407831 - DNA, 544 bp, Homo sapiens
  misc_feature: GZ8MTXP01DIUEQ.38.5.A05.1.454.CMB.2.raw
  modified_base (221)..(221): a, c, t, g, unknown or other
  modified_base (374)..(374): a, c, t, g, unknown or other
  modified_base (440)..(440): a, c, t, g, unknown or other
  modified_base (446)..(446): a, c, t, g, unknown or other
tcagtcgatcacgtcacgaccggtgctcgatttagatagatagacaggggggggtctcaggaggcagcgctctcgggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctctggtacaacagcacccgggcaatgacccccaaaatcatgatttatgaggtcactcatccggccctcgtagggggtttctaatcgtcttcctctgcatccaaagtctggcaacacggcctcccngaccatctctgggctccaggctggaggacgaggcttaattatttctgctagttcatatacaaccancaaacnctctgctaagttcgggacggttacgggaccaaaggcctcgaacccgttccttaaacgtcgaacgcccgaagggccttacgtcccccgttggttaaccc

SEQ ID NO: 407832 - DNA, 562 bp, Homo sapiens
  misc_feature: GZ8MTXP01AZXVO.38.5.A05.1.454.CMB.2.raw
  modified_base (220)..(220): a, c, t, g, unknown or other
  modified_base (341)..(341): a, c, t, g, unknown or other
  modified_base (375)..(375): a, c, t, g, unknown or other
  modified_base (380)..(380): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtgttaataatttgtctctggtaccaacagccaccggcaatcgacccccaaaatcatgtatttatgagtcactcatccggcctgtacgggtttctaactcgtccttctntgcactaccaagtcgtggacaacgaccgcctccngaccntctcgtgggctcgagcgtggacggacgagtacttaattatttcctggtactagtttacaattaactaccaaaccagtacaacctactctcgcttaagttcgggacgggaacggaccgaaagtccgttacgcccgttacctaacgcgaacgacccgtaaggccctaaccgttcccccgttccg

SEQ ID NO: 407833 - DNA, 488 bp, Homo sapiens
  misc_feature: GZ8MTXP01ETR9P.38.5.A05.1.454.CMB.2.raw
  modified_base (403)..(403): a, c, t, g, unknown or other
  modified_base (414)..(414): a, c, t, g, unknown or other
  modified_base (420)..(420): a, c, t, g, unknown or other
  modified_base (426)..(426): a, c, t, g, unknown or other
  modified_base (428)..(428): a, c, t, g, unknown or other
  modified_base (430)..(431): a, c, t, g, unknown or other
  modified_base (433)..(433): a, c, t, g, unknown or other
  modified_base (437)..(437): a, c, t, g, unknown or other
  modified_base (451)..(451): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctctggtacaacagcaccgggcaatgacccccaaaatcatgatttatgaggtcactcatcggcctcagggttctaaatcgccttctctgcataccaaagtctggcaacacggcctcctgaccatctctggctcaggctgagacgagctaatattcnggcattcatanacacanacactntntnntntcgnggacggacgacgcncgcttactaagtacaacgcgacgcgtccgcccgtccg

SEQ ID NO: 407834 - DNA, 506 bp, Homo sapiens
  misc_feature: GZ8MTXP01DQUKW.38.5.A05.1.454.CMB.2.raw
  modified_base (215)..(215): a, c, t, g, unknown or other
  modified_base (310)..(310): a, c, t, g, unknown or other
  modified_base (431)..(431): a, c, t, g, unknown or other
  modified_base (443)..(443): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcatcacatctctgcactgaaccngcagtgacgttggtgttataaattgtctctggtaccaacagcaccggcaatcgaccccaaaatcatgtatttatgaggtcactcactcggccctntaggggtttctaatccgtcttcctctgcatcccaagtctggcaaacgaccgcctcctgaccatctctgggctcgagctgaggacgaggactaatttattctggctagttcatatacaacanacactactctgnttaacgtcggcggacgggacagcttacgccgttactaagtcaacgccaggcctcgccccgtcg

SEQ ID NO: 407835 - DNA, 853 bp, Homo sapiens
  misc_feature: GZ8MTXP01B46GA.38.5.A05.1.454.CMB.2.raw
  modified_base (222)..(222): a, c, t, g, unknown or other
  modified_base (253)..(253): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataactatgtctcngtaccaacaacaccagacaaacgccccaactcatcatttatgacgtcactcatccggccctcgtaggggtttctacgtccgtctttctcgtcggtccttacccgtaaggttttcgggacctaaaccgtacccgggtccccttaccccgttacggtacccttacgtttttccgtcgggggtccctttaccccggaacggggtccgttacggggaaacgggggtaaccgggtaacggggttacccgtttaagggtttaaaactttttttaacgtttacgggttcccctttacccgtttaccgttaaactttaaaccgtttaacccgtaaacgggggtaccccaaacgggttacccgaaaccgggtacccccgttaaaccccccccttttaaaggtttcccggtttaacccggtttaaccccgggggtaaaacccggtttaccggggggtaaaaccccttaaacgggggttacccccgtaaacccccggggtttaccccgttaacccgggttacccgtaaacccgggtaaccccccgtaaaaccgggggaccccccctaaaacccccggttaccttaaccgggtttaaccccgttaacccccg

SEQ ID NO: 407836 - DNA, 513 bp, Homo sapiens
  misc_feature: GZ8MTXP01DLO25.38.5.A05.1.454.CMB.2.raw
  modified_base (217)..(217): a, c, t, g, unknown or other
  modified_base (294)..(294): a, c, t, g, unknown or other
  modified_base (335)..(335): a, c, t, g, unknown or other
  modified_base (413)..(413): a, c, t, g, unknown or other
  modified_base (435)..(435): a, c, t, g, unknown or other
  modified_base (441)..(441): a, c, t, g, unknown or other
  modified_base (445)..(445): a, c, t, g, unknown or other
  modified_base (456)..(456): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctggtctcctggacagtcatcacatctcctgcactggaaccngcagtgacgttggtagttaataatttgtctctggtaccaacagccaccggcaatcgacccccaaatcatgtatttangagtcactcatcggcctgtacgggttctaatcgtccttctntgcactaccaagtctgacacacgccctcctcgaccatctcgtcgggcctcgagctgaggacgagtactaattatttcnggtctagttcaatatacaacanacactntctncttaagtcggnggaacgggacaagcttacgaccttactaaggcaacgccacggctcccgccccgttcg

SEQ ID NO: 407837 - DNA, 571 bp, Homo sapiens
  misc_feature: GZ8MTXP01DUUQB.38.5.A05.1.454.CMB.2.raw
  modified_base (217)..(217): a, c, t, g, unknown or other
  modified_base (288)..(288): a, c, t, g, unknown or other
  modified_base (355)..(355): a, c, t, g, unknown or other
  modified_base (455)..(455): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctggtctcctggacagtcgatcacatctctgcactggaaccngcagtgacgttggtagttataattgtctctgtacaacagcaccggcaatcgaccccaaatcatgtatttangagtcactcatcggcctcgtagggtttactaatcgtccttctctgctataccaagtcgtgacaaacnccggccctccctcgaccctattctcgtcgggctccgaggctaggaggacgagtacttaaattatttctggtactagttactaataactaaccaaaccganaacctaaactcgttctagtcttaagttccgggacgggtacgggaaccaaacgtcgttaccgttaccgttacgtaacgtcaaccgtcccgaaggttccctccgttcccccgttccgg

SEQ ID NO: 407838 - DNA, 568 bp, Homo sapiens
  misc_feature: GZ8MTXP01EFQ3E.38.5.A05.1.454.CMB.2.raw
  modified_base (221)..(221): a, c, t, g, unknown or other
  modified_base (295)..(295): a, c, t, g, unknown or other
  modified_base (470)..(470): a, c, t, g, unknown or other
  modified_base (480)..(480): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcatcaccatctcctgcactggaaccngcagtgacgttggtgttataatttgtctctggtacaacagcaccgggcaatcgacccccaaaatcatgatttangagtcactcatccggcctcgtaggggtttactaattccgcttctctgctaaactcccaagtctacgggaccaaacctccgggtacctcccgtagacccattcctcgtcgggccttccgaaggtctaggaggacgaggtcttaaagttctttcgtgctagttacatactacaacancaaactctcngtcttagttcggggacggaacgggaccaaagccgttcggacccggttctaaacgttcgacgtacccgaagggtcccttccgtcccccg

SEQ ID NO: 407839 - DNA, 574 bp, Homo sapiens
  misc_feature: GZ8MTXP01BHO64.38.5.A05.1.454.CMB.2.raw
  modified_base (220)..(220): a, c, t, g, unknown or other
  modified_base (272)..(272): a, c, t, g, unknown or other
  modified_base (367)..(367): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtagttataaatttgtctctggtaccaacagcacccgggnaatcgacccccaaaatcatgtatttatgagtcactcatcggcctgtacgggtttctaatccgtccttctctgctactaccaagtctggaccaacnccggtccctccctcgacctactctcgtcgggcctccgaggctaggaggacgaggtacttaagtttatttccgtggtctagttaccaattaactaacaaccagaccaaactacttctagtcttaaggttccgggacggtacgggttaccgaaagcttacggcccttaccgtaacgtcaacgacccgaggcctccgttaaccccgtccg

SEQ ID NO: 407840 - DNA, 517 bp, Homo sapiens
  misc_feature: GZ8MTXP01EPZ96.38.5.A05.1.454.CMB.2.raw
  modified_base (217)..(217): a, c, t, g, unknown or other
  modified_base (253)..(253): a, c, t, g, unknown or other
  modified_base (261)..(261): a, c, t, g, unknown or other
  modified_base (391)..(391): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctggtctcctggacagtcatcaccatctcctgcactggaaccngcagtgacgttggtagttataattgtctctgtacangcaccggnaatcgaccccaaatcatgatttatgagtcactcatccggcctgtagggtttctaatcgtccttctctgcactaccaagtctggacaacaccggcctcctgacccatctcgtggctccgagctgaggacgngacttaattattcaggctagttcaattacaacaaccatacaactacgtctggcttaagtcggacggacgggttacaacgtcttacgaccgttacttaagcaacgtccccaggcctcgccccgttcg

SEQ ID NO: 407841 - DNA, 579 bp, Homo sapiens
  misc_feature: GZ8MTXP01BRTW3.38.5.A05.1.454.CMB.2.raw
  modified_base (295)..(295): a, c, t, g, unknown or other
  modified_base (370)..(370): a, c, t, g, unknown or other
  modified_base (434)..(434): a, c, t, g, unknown or other
  modified_base (574)..(575): a, c, t, g, unknown or other
  modified_base (577)..(577): a, c, t, g, unknown or other
  modified_base (579)..(579): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaacttccctgtatctaacaaatgaacagtctgagagctgaggacacggtccttgtattactgtgacaaaagtnttttgagtttagagtagtaggtctactatacgtatggacgtcgtgggacccaagggaccacggtcaccgtctccncacgccctccacacgggcccagtcccgtccttcccctcggccgtccctgccctaccgagggacnccacctccgagacgccacggacggccgggccctggggacctcggcccgttggacaacgggtccttaccgttcccgaacggttgaacgttccggacgttggacgggccggggttcgttgggccgaacgggcggcaagtggnngngn

SEQ ID NO: 407842 - DNA, 743 bp, Homo sapiens
  misc_feature: GZ8MTXP01EBHYW.38.5.A05.1.454.CMB.2.raw
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctctggacagtcatcaccatctcctgcactggaaccagcagtgtacgttggtagttaataattgtctctaggtacaacagccaccggacaactcgacccccaaaatcatcgtatttatgagtcactcactcgtcctgtagggtttactaatcgtccttctctgactactaacctaagtcgtacgggacctaaacgacccgggtccccttacccgtacgtaaccctactttcccgttaccggttccggggcccttaacccggaacggggtccggttaacgggaacggggaacccggtaagggttaaccctttaaaacgttttaattttcgttaacggggtacccttaagggttttaaaccaaactttaaaaccgtaaaccaaaaccctaacggaaaccctaaacctaaccttccgtacgtaaccgttaacgggtttacccgggacggggtaaacgggaccccaaaggtcccgttaacgggttacccgttacccgttaaacggtaccgtaacccggaaccccgaaacgggttccccttaaccccgggttccccccctttccggg

SEQ ID NO: 407843 - DNA, 562 bp, Homo sapiens
  misc_feature: GZ8MTXP01BO3DK.38.5.A05.1.454.CMB.2.raw
  modified_base (219)..(219): a, c, t, g, unknown or other
  modified_base (437)..(437): a, c, t, g, unknown or other
  modified_base (462)..(462): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcatcaccatctcctgcactggaaccngcagtgacgttggtagttataaattgtctctggtaccaacagcacccgggcaatcgacccccaaaatcatgtatttatgagtcactcatcgcctcgtagggtttctaatcgtccttctctgcatacccaagtctggaccaaaccaccggcccctccctcgaaccctatcctcgtcgggcctccgaggccgtaggacggacgaggtactaattatttcnggctagtttcattactaaccaacanaccaactcctactcgtctaagttcgggacgggaacggacgaagcttacggcccgttctaacgtccaacgcccgaagggttccctccggcccccgttccgg

SEQ ID NO: 407844 - DNA, 571 bp, Homo sapiens
  misc_feature: GZ8MTXP01AOLL3.38.5.A05.1.454.CMB.2.raw
  modified_base (222)..(222): a, c, t, g, unknown or other
  modified_base (300)..(300): a, c, t, g, unknown or other
  modified_base (366)..(366): a, c, t, g, unknown or other
  modified_base (393)..(393): a, c, t, g, unknown or other
  modified_base (479)..(479): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatccaccatctcctgcactggaaccngcagtgacgttggtagttaataaatttgtctctggtaccaacagcaccgggcaatcgacccccaaaatcatgatttangagtcactcatcggccctgtagggtttctaatccgtccttctctgctatccaagtctggacaaacnccggccctccctacgacccatcctcgngggtcctccgaggccgtggacggacgaggtccttaaagttctttcgtgggtctagttacataactaacaacctagaccaactcctntcgacttcgtcgggcgggtacggacgtaacgtcttacggacccgttacgtaagtccgaacgtcccgaacggttccctccgcccccgttccgg

SEQ ID NO: 407845 - DNA, 752 bp, Homo sapiens
  misc_feature: GZ8MTXP01BV1K3.38.5.A05.1.454.CMB.2.raw
  modified_base (221)..(221): a, c, t, g, unknown or other
  modified_base (293)..(293): a, c, t, g, unknown or other
tcagtcgatcacgtcacgaccggtgctcgatttagatagatagacaggggggggtcgtcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtgttaataattgtctctggtacaacagcaccggcaatcgaccccaaatcatgtatttangtagtcactcactcggcctcgtagggtttctaactcgtccttctctgactactaccaacgtcgtacgggaccaaaccgtacccgggtaccccttccccgtacgtaacccctacgttccgttcccgttggggcccttacccggaagggtcccgttagggtaacgggaaccggtaagggttaccctttaaagtttaactttcccgttaggggtaccctttaaggtttaccctaaagtttaaaccttaaaccccgaaaccctaacggaacccctaaaaccgttaacccttccgttacggttaaccgtttaacgggtttaccccgggggaacggggttaaaccgggggttaaacccaaacgggtccgttaacccggttaccccggttaacccgtaaacggttacccgaaccggttaccccggaaggggttccccttcccgggttaacccccccgtttccgggg

SEQ ID NO: 407846 - DNA, 599 bp, Homo sapiens
  misc_feature: GZ8MTXP01B0MPC.38.5.A05.1.454.CMB.2.raw
  modified_base (218)..(218): a, c, t, g, unknown or other
  modified_base (305)..(305): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcaggcacagggtcctgggcccagtctgccctggctcagcctgcctcgtgtctgggtctcctggacagtcgatcaccatctctgcactggaaccngcagtgacgttggtagttaataatttgtctcctggtaaccaacgagccgacccggacaactacgaacccccaaaatcatgtatttangagtacactcatccgcctagtacggtttcaatcgtccttctctcgctactaaccaagttcgacggacaaaccgaccgccctccagacctatctcgtcgggctccgagtccgtaggaacggacgaagtacttaagtttactttcgaggtacttattactaactaactaaccaaaccgaacaacctaactactcgtcgtacgttaacggtcggacggtaacggaacgaacgtcgttacgttacccgttacgtaacgtaccgaaccgacccgacggttccctccccgttccccgtcg

SEQ ID NO: 407847 - DNA, 648 bp, Homo sapiens
  misc_feature: GZ8MTXP01EGU15.38.5.A05.1.454.CMB.2.raw
  modified_base (265)..(265): a, c, t, g, unknown or other
  modified_base (304)..(304): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtagtttaataatttgtctctaggtaccaacngccaccggcaatccgaaccccaaaatcaatgtatttagngagtcactcacgtccggcctgtagggtttactaactcgtccttctctgctactaccaagttcgtacggacccaaaccgaccggtccctacccgtacgtaccctacgttccgttccggttcgggccttacccggaagggtccgtacgggaacgggaacggtagttacttaaacgttttactttcgttcggaacgtttacttactaaactttacaaaccaaaccgactaaccaaactacttcgtacgtactaaggttccgggacgggaaaccgggaccaaggtccttacggttacccgttaccaacggtacaaccgacccgagttcccgtccgttccccgttaacg

SEQ ID NO: 407848 - DNA, 753 bp, Homo sapiens
  misc_feature: GZ8MTXP01AD4S1.38.5.A05.1.454.CMB.2.raw
  modified_base (221)..(221): a, c, t, g, unknown or other
  modified_base (294)..(294): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtagttataattgtctctggtaccacagcaccggcaactcgaccccaaatcatgtatttangagtcactcagtccggccctgtacgggtttactaagtccgtccttctctcgaccactaccctaacgttccgtacgggaccctaaaccgacccgggtccccttccccgtacgaaccctacttcccttccggtcggggtacccttcccggagggtacccgttggggaacgggtaaccgggtaagggttaccctttaaaagttttacgtttttccgtacggggttaccttaacggttttaccaaactttaaaccgttaaacccaaaccccgtaacgacccctaaaacctcccgttcctaccggttaccgttaacggtttacccgggggaccggggtaaaccgggaaacccgtaaacggtccgttacccgggttaacccggtttaccccgtaaacggttcccgaacccggttaccccggaaacgggttccccgttaaccccggttcccccccggtttcccggg

SEQ ID NO: 407849 - DNA, 572 bp, Homo sapiens
  misc_feature: GZ8MTXP01EXVY1.38.5.A05.1.454.CMB.2.raw
  modified_base (221)..(221): a, c, t, g, unknown or other
  modified_base (259)..(259): a, c, t, g, unknown or other
  modified_base (294)..(294): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcatggaaccngcagtgacggttggtagttataaattgtctctgacaanacgcaccggcaatcgacccccaaatcatgatttangagtcactcatccgcctcgtaggggtttctaactccgtcttctctgcaactccaagtctacgggacaacgaccggccctcccgtacgaccctattcctcgtcgggcctccgaaggtcctagggaaggaccgaggtactttaaatttacgtttcgtggtactagtttacaattactaacaaccagacctaactactctgtaacgttagttccggggcggaacgggacgaagccgttgttacccgtctagtccacgcccgaagtccttcccggtcccccg

SEQ ID NO: 407850 - DNA, 637 bp, Homo sapiens
  misc_feature: GZ8MTXP01EL1GT.38.5.A05.1.454.CMB.2.raw
  modified_base (299)..(299): a, c, t, g, unknown or other
  modified_base (471)..(471): a, c, t, g, unknown or other
  modified_base (480)..(480): a, c, t, g, unknown or other
  modified_base (632)..(632): a, c, t, g, unknown or other
  modified_base (635)..(635): a, c, t, g, unknown or other
  modified_base (637)..(637): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaacttccctgtatactaacaaatgaaacagtctgagagctggagacacggtccttagtattactgtagacaaaagtnttttagaagtttagagttaagtaagggtactactaacgtacggtatggacgtcgtcggggacccaagggacacggtcacccgtctccctcacgccctacccaaccgaacgggcccctacgttcccgggttcccttccccccgtggcccgacccctcgcctacccgaagggcncccaacccncccgaagacgccaacggacggcccgggccctggggcctcggtcccgtggtaaccgaaacggtaccttaccgtcccgtaaggtcgaacgttcggacttgggaccggccgggggttcgttcggggaccgtaaacgggggcccaacgtaagtcgntgngn

SEQ ID NO: 407851 - DNA, 550 bp, Homo sapiens
  misc_feature: GZ8MTXP01COVXE.38.5.A05.1.454.CMB.2.raw
  modified_base (294)..(294): a, c, t, g, unknown or other
  modified_base (417)..(417): a, c, t, g, unknown or other
  modified_base (434)..(434): a, c, t, g, unknown or other
  modified_base (460)..(460): a, c, t, g, unknown or other
  modified_base (465)..(465): a, c, t, g, unknown or other
  modified_base (493)..(493): a, c, t, g, unknown or other
  modified_base (496)..(496): a, c, t, g, unknown or other
  modified_base (544)..(544): a, c, t, g, unknown or other
  modified_base (546)..(548): a, c, t, g, unknown or other
  modified_base (550)..(550): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtgggtctcaggtattagttggaacagtggtaggataggctatgcggactctgtgaaggccgattcagcatctccagagacaacgccaaagtaacttcctgtactctaacaaatgaacagtctgagagctgaggacacggtccttgtattactgtgacaaaagtntttgagttagagtaagtaggtactactacgtacggtatggacgtcgtggggaccccaagggaccacggtccaccgtctcctcacgccctaccaccgacgggcccagtccggtcccttccccgngcccgcctgctcgagcncacctcgagcgcacgacggcgcccgnggccncgccgtggtacaacggtcttaccgtccngtnaacttcggacttggaagggcccgggttagttggacccgaaggcgcagngnnngn

SEQ ID NO: 407852 - DNA, 598 bp, Homo sapiens
  misc_feature: GZ8MTXP01A3ND2.38.5.A05.1.454.CMB.2.raw
  modified_base (397)..(397): a, c, t, g, unknown or other
  modified_base (593)..(594): a, c, t, g, unknown or other
  modified_base (596)..(596): a, c, t, g, unknown or other
  modified_base (598)..(598): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgcaaaagtattttagagtttagagtagtaagggtctactactacggtatggacgtcgtggggcccaagggaccgacgtcacccgtactccctcacgccctccacccaagggccccnctaccgggttcccttccccccgtgggcccgccccgtgacctcccacgggacgccgacccttcccgaacggagaccgacgaacggcccgggccccgtgggggtcctcggcccgtcgggtacgaacggtaccttaccttccgaccgttggaacttcgaccgttgaccggcggggcttgggccaaagggcgcgaatggnngngn

SEQ ID NO: 407853 - DNA, 699 bp, Homo sapiens
  misc_feature: GZ8MTXP01ACX9S.38.5.A05.1.454.CMB.2.raw
  modified_base (218)..(218): a, c, t, g, unknown or other
  modified_base (262)..(262): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctggtctcctggacagtcgatcacatctcctgcactggaaccngcagtgacgttggtgttataattgtctctgtacacagcaccggnaatcgaccccaaatcatgtatttatgagtcactcactccggtcctacgtaggggtttactaagtcgtccttctctgcataaccaagtctggaccaacgaccggccctcctacgaacctctctcgttcgggccttaccgacggtccgtagggaacggacggtaacggttacctttaaatttacgtttacgtcggggtacttaacggtttacaacttaaacttaaccgtaaaccctaacggaaccctaaacctaaccttaccgttcggtaccgttaacgggtttacccgggggaccggggtaaaccggggttaaacccgaaaacgggtcccgttaaccgggttaccccggtttaaccgttaaaccgggtacccgtaacccgggtaccccggaaaaccggggttcccttaaccccgggttcccccccgtttaacccgggg

SEQ ID NO: 407854 - DNA, 559 bp, Homo sapiens
  misc_feature: GZ8MTXP01AY7E5.38.5.A05.1.454.CMB.2.raw
  modified_base (428)..(428): a, c, t, g, unknown or other
  modified_base (540)..(540): a, c, t, g, unknown or other
  modified_base (551)..(551): a, c, t, g, unknown or other
  modified_base (555)..(559): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaacttccctgtatactacaaatgaacagtctgagagctggaggacacggtccttgtattactgtgacaaaagtattttgagtttagagtagtaaggtctactactacggtatggacgtgtcggggacccccaaagggtaccacggtccacccgtctcccgtcacgccctaccacccgaagggccccagtcccggtcccttccccgnggccgccctgcctccgagcgccacctccgagacgcaacggcggccggcccgtggggccttcggccgttggaccaaaggtccttaacgttccacgtgacttgcttgaggcggncggacaaggcntagnnnnn

SEQ ID NO: 407855 - DNA, 638 bp, Homo sapiens
  misc_feature: GZ8MTXP01ADEYU.38.5.A05.1.454.CMB.2.raw
  modified_base (220)..(220): a, c, t, g, unknown or other
  modified_base (264)..(264): a, c, t, g, unknown or other
  modified_base (290)..(290): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctctgcactggaaccngcagtgacgttggtgttataattgtctctgtacacagcaccggnaatcgaccccaaaatcatgtatttangagtcactcatccggcctcgtagggtttctaatcgtccttctctgcataccaagtctggacaacgaccggtccctaccctcgaccctacttccgtcgtcggggccttaccgaggccgtgggaacgggaccggtaagggtacctttaaatttacttttccgtggggtactaggtttacaaacttaactaaacccaaaccacgtaccaaactaccttctacgtccttaacgttccggggaccgggtaaacggacccgtaaacggccgttacggttaaccccgttaccgttaaacggttaccgaaccgaccccggaacggttcccgtaacccggttccccccgtttccggg

SEQ ID NO: 407856 - DNA, 551 bp, Homo sapiens
  misc_feature: GZ8MTXP01AZ6AF.38.5.A05.1.454.CMB.2.raw
  modified_base (252)..(252): a, c, t, g, unknown or other
  modified_base (302)..(302): a, c, t, g, unknown or other
  modified_base (394)..(394): a, c, t, g, unknown or other
  modified_base (409)..(409): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacattggtacattataactctgtcncgtgtaccaacaaccacccaggacccaacgcccccaaactctattattangaggtccgatcggccctcaggtatttcaatcgtcttctctggcctcaaagtctggaccaacgcggaccctccctgaccatctctggactccnggtctggacggacgnggtctagtattactactggctagttcatatacaagctactacctccttcttctgttcgtcgggcggacggaccgtaagggtcgacccgttccgttaagtccacgtccccgtaaggcttcccgggtaacccccttcggttccc

SEQ ID NO: 407857 - DNA, 559 bp, Homo sapiens
  misc_feature: GZ8MTXP01D9813.38.5.A05.1.454.CMB.2.raw
  modified_base (219)..(219): a, c, t, g, unknown or other
  modified_base (254)..(254): a, c, t, g, unknown or other
  modified_base (263)..(263): a, c, t, g, unknown or other
  modified_base (460)..(460): a, c, t, g, unknown or other
  modified_base (475)..(475): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtgttataattgtctctgtacanagcaccggnaatcgaccccaaatcatgtatttatgagtcactcatcgcctgtagggtttctaatcgtccttctctcgctactaccaagttctggaccaaaccgaccggtccctccctgaccctatctcgtcgggctccgaggctggacggacgaggtacttaagtttatttcgtgggtactagtttacaattactaaccaaccganaactaactacttctntcttaagttccgggacggtaacgggaccaaacgtcttacgacccgttactaacgtcaacgcccaaggcctccgttccccgttcg

SEQ ID NO: 407858 - DNA, 548 bp, Homo sapiens
  misc_feature: GZ8MTXP01EIK8A.38.5.A05.1.454.CMB.2.raw
  modified_base (283)..(283): a, c, t, g, unknown or other
  modified_base (291)..(291): a, c, t, g, unknown or other
  modified_base (449)..(449): a, c, t, g, unknown or other
  modified_base (455)..(455): a, c, t, g, unknown or other
  modified_base (480)..(480): a, c, t, g, unknown or other
  modified_base (499)..(499): a, c, t, g, unknown or other
  modified_base (539)..(539): a, c, t, g, unknown or other
  modified_base (542)..(542): a, c, t, g, unknown or other
  modified_base (544)..(545): a, c, t, g, unknown or other
  modified_base (547)..(548): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtgggtctcaggtattagttggaacagtggtaggataggctatgcggactctgtgaagggccgattcagcatctccagagacaacgccaagaattccctgtatctaacaaatgaacagtctgagagctgaggacacggccttgtattactgtancaaaagtntttgagtttagagtagtaaggtctactactacggtatggacgtcgtcgggggaccccaaggggaccacggtccacccggttcctccctcgacgccctacccaccgaacgggccccagttcccggtccttccccctggccgccctgcctccagggaccnccaccncgagacgcacggcgccgccgtggcngccgtgacacgtctactcngtgacttcgcttggacggcgggcgttcggacgaaggcaanagngnngnn

SEQ ID NO: 407859 - DNA, 589 bp, Homo sapiens
  misc_feature: GZ8MTXP01EMX2C.38.5.A05.1.454.CMB.2.raw
  modified_base (286)..(286): a, c, t, g, unknown or other
  modified_base (293)..(293): a, c, t, g, unknown or other
  modified_base (432)..(432): a, c, t, g, unknown or other
  modified_base (457)..(457): a, c, t, g, unknown or other
  modified_base (479)..(479): a, c, t, g, unknown or other
  modified_base (528)..(528): a, c, t, g, unknown or other
  modified_base (573)..(573): a, c, t, g, unknown or other
  modified_base (583)..(583): a, c, t, g, unknown or other
  modified_base (585)..(586): a, c, t, g, unknown or other
  modified_base (588)..(589): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaacagtctgagagctgaggacacggtcttgtattactgtganaaaagtnttttgagtttagagtagtaagggtctaactacgtacggtatggacgtgtcggggaccccaaggggaccaggtccacccgtctccctcgacgtcccgtacccacccgaacgggccccattcccgggttccccttccccgnggccgcccctggcctccgaagggcnccaccgtccgagacgccaacgnggcgtaccccgtgggcctcgccgttggaccgaaaggtccttaccttccncgttgcttcggacttggaacggtccggggcttcgggacaacgggnaaccttaggngnngnn

SEQ ID NO: 407860 - DNA, 629 bp, Homo sapiens
  misc_feature: GZ8MTXP01DB5RF.38.5.A05.1.454.CMB.2.raw
  modified_base (220)..(220): a, c, t, g, unknown or other
  modified_base (292)..(292): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcacatctcctgcactggaaccngcagtgacgttggtgttataaattgtctctggtacaacagcaccgggcaatcgaccccaaatcatgatttangaggtcactcatcggcctcgtagggtttctaatcgtccttctctgctactaaccaagtctcggaccaaacgaccggtccctccctacgacccattccgtcgtcgggcctcccgaaggcgtcggaagggaccgtaggtaccttaatttatttccgtaggtacctagtttaccaatttaactaaccgaaccaacgacctaaacctacttactcgtaactttaacgggttcggacggggtaacgggaaaccaacggtccttacggttaccccggttacctttaaaacgggccaaccggacccgtaaacgggcccttaacccggccccccgtttaacccgg

SEQ ID NO: 407861 - DNA, 605 bp, Homo sapiens
  misc_feature: GZ8MTXP01EKXRZ.38.5.A05.1.454.CMB.2.raw
  modified_base (283)..(283): a, c, t, g, unknown or other
  modified_base (292)..(292): a, c, t, g, unknown or other
  modified_base (434)..(434): a, c, t, g, unknown or other
  modified_base (461)..(461): a, c, t, g, unknown or other
  modified_base (596)..(596): a, c, t, g, unknown or other
  modified_base (601)..(602): a, c, t, g, unknown or other
  modified_base (604)..(605): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctacaaatgaacagtctgagagctgaggacacggccttgtattactgtnacaaaagtnttttgagtttagagtagtaggtctactatacggtatggacgtcgtggggccccaagggaccacgggtcacccgtctccctcacgccctacccaacccgaacggggccccagtttcccgggtcctttccccccgtgggccccncccgttggcccttacccgaggggaccncccgacccgtccgagacgccaccggcggtcccggcccgtcggggcctcggccgttggtaaccaacggtaccttacgtcccgaaggtcgtacgttcgacgttggacggccgggttcgttcgggacgaacgggcaanagtgnngnn

SEQ ID NO: 407862 - DNA, 545 bp, Homo sapiens
  misc_feature: GZ8MTXP01A0YLT.38.5.A05.1.454.CMB.2.raw
  modified_base (429)..(429): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtagttataattgtctctggtacaacagcaccggcaactcgacccccaaaatcatgtatttatgagtcactcatcggcctcgtagggtttctaatcgtccttctctgcactaccaagtctgggaccaacaccggcctccctgacccatcctcgtgggctccgaggctggacggacgaggtacttaaatttatttcngggtctagttacaattaactaaccaaaccagaccaactactctacgctaagttcgggacggacggaccaagcttcgaccgttctaagtcaacgacccaggcctccgcccccgtcgg

SEQ ID NO: 407863 - DNA, 796 bp, Homo sapiens
  misc_feature: GZ8MTXP01BRXQZ.38.5.A05.1.454.CMB.2.raw
  modified_base (217)..(217): a, c, t, g, unknown or other
  modified_base (255)..(255): a, c, t, g, unknown or other
  modified_base (289)..(289): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctggtctcctggacagtcatcaccatctctgcactggaaccngcagtgacgttggtagttataattgtctctgtaccaanagcaccggcaatcgaccccaaatcatgtatttangagtcactcactcgcctcgtacgggtttactaactcgtccttctactgactactaacctaagtcgtacgggaccaaacccgtaccggtccccttacccctacggtaaccctaacttcccgttccggttccgggggtcccttacccggaggggtaccgttacggggaaacgggtaaccgggtaaacgggttaacctttaaaagttttacgttttaccgttacgggggtaactttaacggttttaaccaaactttaaaaccgtaaacccgttaaaaccccaacggtaaaccctaaaacccgtaaccctttaccgtaaccggttaccgtttaaacgggtttacccgggggaaccgggggaaaccggggttaaaccccgtaaaacgggttcccgttaaacccgggttaccccggtttaacccggtttaaaaccgggttcccgtaaacccggacccccggtaaaccgggttccccgtttaaccccgggttaaccccccccgttttcccgggg

SEQ ID NO: 407864 - DNA, 609 bp, Homo sapiens
  misc_feature: GZ8MTXP01B78X5.38.5.A05.1.454.CMB.2.raw
  modified_base (286)..(286): a, c, t, g, unknown or other
  modified_base (295)..(295): a, c, t, g, unknown or other
  modified_base (601)..(601): a, c, t, g, unknown or other
  modified_base (606)..(609): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaacttccctgtatctaacaaatgaacagtctgagagctgaggacacggtccttgtattactgtnacaaaagtnttttgagtttagagtagtaagggtctactactacggtatgggacgtcgtcgggggaccccaagggggaccacgggtccacccggttcctccctcgaacgtcccctacccaaccgaacggggtccccaagttccccgggttcccttccccccgtcgggcccgtccccttcggccctacccgagggacgcccaccgtccgagacgccacgcggccgggcccctggggcctcggccgtggtaccaacgggtccttaccttcccgagtcgacgttcggacttggacggccgggcttgggcaagggccaanagtgnnnn

SEQ ID NO: 407865 - DNA, 612 bp, Homo sapiens
  misc_feature: GZ8MTXP01DFEA1.38.5.A05.1.454.CMB.2.raw
  modified_base (191)..(191): a, c, t, g, unknown or other
  modified_base (292)..(292): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacngtcgatcaccatcctcctgcactggaaccagcagtgacgttggtgttaataattgtctctgtacacagcaccggcaatcgacccccaaatcatgtatttangagtcactcatccggcctcgtagggtttactaatcgtccttctctgcataaccagtcgtggaccaacgaccggtccctaccctcgaccctatcctcgtcgggcctcgagggcctagggaggacggaggtaccttaatttacgtttcgtaggtacgtatttacaaacttaactaaaccaaaccgacgaaacctaaacctacctactacgtacttaacgggtaccgggacgggaaaccgggaccgtaaacggcgttaccgttcccgttaacgtaacgtccgaacgacccgaacggttcccgtcccgttccccgttaacccgg

SEQ ID NO: 407866 - DNA, 603 bp, Homo sapiens
  misc_feature: GZ8MTXP01EHYJN.38.5.A05.1.454.CMB.2.raw
  modified_base (227)..(227): a, c, t, g, unknown or other
  modified_base (267)..(267): a, c, t, g, unknown or other
  modified_base (276)..(276): a, c, t, g, unknown or other
  modified_base (279)..(279): a, c, t, g, unknown or other
  modified_base (289)..(289): a, c, t, g, unknown or other
  modified_base (299)..(299): a, c, t, g, unknown or other
  modified_base (339)..(339): a, c, t, g, unknown or other
  modified_base (390)..(390): a, c, t, g, unknown or other
tcagtcgatcacgtcacgaccggtgctcgatttagatagatagacagggggtggggtctcaggaggcagcgctctcaggacatctccaccatggcctgggctctgctgctcctcaccctcctcactcagggcacgagggtcctgggcccagtctgccctggctcagcctgcctccgtgtctgggtctccgtggacagtcatcaccattcctcctgcacgtggaaccngctagtgtacggttggtagttaataattgtctctggacangcgaccggnaancaccccaaancatgtattangagtcactcacgtccgccttgaggtttactatccgcttcnctgcaacttacaagtctacggacaaccgacccggtccctcctacgaacccncttcgtcggtcgggtccctacgtacggcgtaggaacgggtacgacgtaatttaaactttctttcgtaggtaccttagtaactactaacgaaaccaaccataaccaaactccttgcgtaattacgggccgggaagggaaccgaacgtaacgcccgttacgaacccgttcgtaaacggccaaacggccgaacgtcccgttaacccgggttccccg

SEQ ID NO: 407867 - DNA, 678 bp, Homo sapiens
  misc_feature: GZ8MTXP01EH0GO.38.5.A05.1.454.CMB.2.raw
  modified_base (217)..(217): a, c, t, g, unknown or other
  modified_base (296)..(296): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctggtctcctggacagtcatcacatctcctgcactggaaccngcagtgtacgttggtgttaataattgtctctagtaccaacagcgaccggacaactcgaccccaaaatcatgtatttagngagtcactcatccgcctgtacgggtttcaacgtcgtccttctctcgtctactacctaagtcgtcggaccaaaccgaccggccccttaccgtcgaaccctcttctcgtcgggtcctaccgaggtaccgtaggaacgggaccgtaggttaacttaaagtttactttccgtaggggtactaacggtttactaattaaacgtaaaccgaaacccgagtaaaccaaactcccttattaccgtaccgttaacgggttccgggaaccggggtaaacggaaaccgtaaacggtcccgttaccggttaaccccgttaaccgttaacgggtacccgtaaaccggtaccccggaaacgggttccccgttccccggttcccccgtttaacccgg

SEQ ID NO: 407868 - DNA, 636 bp, Homo sapiens
  misc_feature: GZ8MTXP01BXPC7.38.5.A05.1.454.CMB.2.raw
  modified_base (290)..(290): a, c, t, g, unknown or other
  modified_base (628)..(628): a, c, t, g, unknown or other
  modified_base (633)..(633): a, c, t, g, unknown or other
  modified_base (635)..(635): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaaggccgattcagcatctccagagacaacgccaagaattccctgtatctacaaatgaacagtctgagagctgaggacacggccttgtattactgtgacaaaagtnttttgagtttagagttagtaaggtctactactacggtatggacgtgtggggccccaagggaccaggtcaccgtctcctcacgtccctaccaccgtaacgggccccagtcccgggtcccttcccccgtggcccgtcccgtgcccttacccgacgggacgtccaacccgttcccgaaggacgacccgaacgacgggtcccggccccgttgggggccctcggccccgttagggtaccaaacggggtacccttaacgtttccccgaacggttcgaagttcccggaaccgttggaacggtcggggccgttcggggaccaaacgggggccgaacctaaggtcgngtcgngng

SEQ ID NO: 407869 - DNA, 537 bp, Homo sapiens
  misc_feature: GZ8MTXP01CGK0H.38.5.A05.1.454.CMB.2.raw
  modified_base (204)..(204): a, c, t, g, unknown or other
  modified_base (292)..(292): a, c, t, g, unknown or other
  modified_base (419)..(419): a, c, t, g, unknown or other
  modified_base (423)..(423): a, c, t, g, unknown or other
  modified_base (438)..(438): a, c, t, g, unknown or other
  modified_base (452)..(452): a, c, t, g, unknown or other
  modified_base (494)..(494): a, c, t, g, unknown or other
  modified_base (497)..(498): a, c, t, g, unknown or other
  modified_base (503)..(504): a, c, t, g, unknown or other
  modified_base (529)..(529): a, c, t, g, unknown or other
  modified_base (533)..(537): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatcncagagacaacgccaagattccctgtatctaacaaatgaacagtctgagagctggaggacacggtcttgtattactgtagataaaagtnttttagaagtttagagtaagtaggtctaactacgtacggtatggacgtgtcggggaccccaacgggaccacggtcacccgtcctcctcacgccctaccgaccgacggccctagtccgtcctccccgngccncctgcctacgaggcnccaccgtccgagcncacggcggtccgcccgtgggctcgccgtgacaacgtctctcngtnnttcgnnggacggcggcgttggaccaagggcncagnnnnn

SEQ ID NO: 407870 - DNA, 613 bp, Homo sapiens
  misc_feature: GZ8MTXP01AQBGM.38.5.A05.1.454.CMB.2.raw
  modified_base (222)..(222): a, c, t, g, unknown or other
  modified_base (260)..(260): a, c, t, g, unknown or other
  modified_base (268)..(268): a, c, t, g, unknown or other
  modified_base (294)..(294): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtagttataatttgtctctgaccaangcaccggnaactcgaccccaaatcatgtatttangacgtcactcacgtccggcctacgtaggggtttactaactcccgtcttctctgctaactacctaagtctacggaccaaccgaccggtccctcccgtacgaccctagtccgtcgtcgggcctaccggacggtcgtggaacgggacgacggtacttaaatttactttcgcgtcttaagttactaataacctaaccaaaccgacgaacctaaacctaccttacgtcgtaacgttaacggttccgggacggggacggaaaccgtagccgttacgttacccggtaactacggtccgacgacccgacggtccgttcccgtccccg

SEQ ID NO: 407871 - DNA, 569 bp, Homo sapiens
  misc_feature: GZ8MTXP01AOTHE.38.5.A05.1.454.CMB.2.raw
  modified_base (282)..(282): a, c, t, g, unknown or other
  modified_base (291)..(291): a, c, t, g, unknown or other
  modified_base (423)..(423): a, c, t, g, unknown or other
  modified_base (444)..(444): a, c, t, g, unknown or other
  modified_base (565)..(569): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatcaacaaatgaacagtctgagagctgaggacacggtcttgtattactgtnactaaagtntttgagtttagagtagtaggtctactacgtacgtatgacgtcgtcggggaccccaagggccacggtcaccgtctccctcacgccctaccaccgaacgggtccctagtcccggttcccttcccccgtggcccncccctgcctacccgagggacnccgacccgtcgacgacgcgaccggacggccggccctggggctcgccgtggtaccgaaggtaccttaccgtccgagtcgacgttccgacttgggacgccgggcgttcgggcaaggcaacagnnnnn

SEQ ID NO: 407872 - DNA, 686 bp, Homo sapiens
  misc_feature: GZ8MTXP01EYYM9.38.5.A05.1.454.CMB.2.raw
  modified_base (259)..(259): a, c, t, g, unknown or other
  modified_base (292)..(292): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtcgtgggtctcctggacagtcgatcaccatctcctgcactggaaccagcagtgacgttggtagttataattgtctctgtacacngcaccggcaactcaccccaaatcatgtatttangagtcactcactccggtcctacgtagggtttctaatcgtccttctctgctactaaccaagtcgtacgggaccaaacccgccggtcccctcccgtacgaccctacttccgtccgtcggggccctaccggaggtcgtacgggaacgggaacggtaggtactttaaagtttactttccgtagggtacttaacggtttacaacttaaacctaacccgaaacctacgtaaccctaaaccgtaccttaccgtacggttaccgttaacgggttaccgggggaccggggaaaccgggttaaccgtaaacgtccgttaccggttaaccccgttaacccgttaacggtcccgaaccggtaccccggaacggttccccgttaaccccggttccccccggttccgg

SEQ ID NO: 407873 - DNA, 633 bp, Homo sapiens
  misc_feature: GZ8MTXP01DTIO0.38.5.A05.1.454.CMB.2.raw
  modified_base (220)..(220): a, c, t, g, unknown or other
  modified_base (292)..(292): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctggtctcctggacagtcgatcaccatctcctgcactggaaccngcagtgacgttggtagttaataatttgtctctgtacaacagcaccggcaatcgaccccaaatcatgatttangagtcactcatcggcctgtacgggtttctaatccgtcctttcgtctcgctactaacctaagtctagaccaaccaccggtccctaccctgaccctatctcgtcgggctcgaggcgttaggaacgacgaggtaccttaaatttactttacgtgggtactacggtttacaacttaactaacccaaaccgtaacaacctaaaccttacgtactcgtccttaaggtttccgggaaccgggtaacgggttaaacccgtaaacggttccgttacgttaaccccgggttaacctaacggttaccgaacgaccccggaacgttccgttcccgttaacccccgttcccggg

SEQ ID NO: 407874 - DNA, 689 bp, Homo sapiens
  misc_feature: GZ8MTXP01D83CS.38.5.A05.1.454.CMB.2.raw
  modified_base (307)..(307): a, c, t, g, unknown or other
  modified_base (683)..(683): a, c, t, g, unknown or other
  modified_base (685)..(686): a, c, t, g, unknown or other
  modified_base (688)..(689): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactcgtgtgaagggccgattcagcatctccagagacaacgccaaagtaacttcctgtatctaacaaatgaaccagtctagagagctggaggacacggtccttaggttattacgtgtagactaaaaagttnttttagtaaggttttagaagttaggttaaagggtctaacgttacgtacggttagtcggacgtcgtacggggaccccgaaggggaccgtacggtcctaacccggtcccttccctcgacgtaccccttacccgaaccccgaacggggcccctaacgttcccggttccccgtttcccccgttgggccccgcccccgttggcccgttacccggagggacgacccgtacccgtaccgaagacgaccgaacgacgggcccgggtccccgtgggccgttcgcccgttacggaaccgtaacgggtacccttaaccgttcccgaacggtcgtaacgttcggaccgttaggacggtccgggcgttcgggacaacggcgtctaaggngnngnn

SEQ ID NO: 407875 - DNA, 687 bp, Homo sapiens
  misc_feature: GZ8MTXP01CLLTY.38.5.A05.1.454.CMB.2.raw
  modified_base (242)..(242): a, c, t, g, unknown or other
tcagtcgatcacgtcacgaccggtgctcgatttagatagatagacaggggtgggtctcaggaggcagcgctctcaggacatctccaccatggcctgggctctgctgctcctcaccctctcactcagggcacagggtcctgggcccagtctgccctggctcagcctgcctcgtgtctggtctcctggacagtcatcacatctcctgcactggaaacctgcagtgacgttggtagttataattntctctggaacaacacgcaaccggacaactcgaacccctaaaagtcaatagtaactttagtgagtcaactcaacgtcggactacgtcgtaagggtttctaaacgtccgtacttctcttcgaacctacgtaaccgtaaagtttcgtaacgggtacccaaacgtaaccccggtccttaccccgtagaccctaatccgtcgtacgggtccttacggacggtcgttaggaacggtaaccggtaaggtacctttaaaagtttcggttttacgacgtacgttacgttaactaactaactaaccgaaaccctagaacctaaaactcctacgtaacgttaccgttaggttaccggacgggttaaacggaacccttaagttccgaaccggttaacccgtacgtttaaacggtcccgtaaaccggaaccccgtaacggccccgtttaacccccggg

SEQ ID NO: 407876 - DNA, 569 bp, Homo sapiens
  misc_feature: GZ8MTXP01EPQIS.38.5.A05.1.454.CMB.2.raw
  modified_base (220)..(220): a, c, t, g, unknown or other
  modified_base (258)..(258): a, c, t, g, unknown or other
  modified_base (267)..(267): a, c, t, g, unknown or other
  modified_base (445)..(445): a, c, t, g, unknown or other
  modified_base (474)..(474): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtagttaataattgtctctgtacacngcgaccggnaatcaccccaaatcatgtatttatgagtcactcacgtccgcctgtacgggtttctaatcgtccttctactgctactacccaagtcgtcggacaaccgacccgtccctacccgtagaccctattccgtcgtcgggctccgaggtcctagggacggacgtagtacttaagtttactttcngggtactagttacaataactaacaaccanacctaactctcgtacgctaacgttcgggacggacgaccgaagtccgttacgaccgttctaacgtcaaccggccaggccctcccgttccccgtcgg

SEQ ID NO: 407877 - DNA, 592 bp, Homo sapiens
  misc_feature: GZ8MTXP01A3BFY.38.5.A05.1.454.CMB.2.raw
  modified_base (294)..(294): a, c, t, g, unknown or other
  modified_base (375)..(375): a, c, t, g, unknown or other
  modified_base (589)..(592): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaacagtctgagagctgaggacacggtcttgtattactgtgactaaaagtnttttagagtttagagtagtaaggtctactacgtaggtatggacgtgtcggggacccaagggacacggtccaccgtctcctnacgccctaccaccgaagggccccagtccggttcccttcccccgggcccgccctgacctcccgagggacgccacccgtccgagacgcctacggacggcccgggtcccgtgggggccttcggaccccgtggtaccaaaggtcccttaacgttccccaaggtgtacttccggacgttggaacgggcgggccgttggacgaaggggcctaacgagagnnnn

SEQ ID NO: 407878 - DNA, 602 bp, Homo sapiens
  misc_feature: GZ8MTXP01DBQFL.38.5.A05.1.454.CMB.2.raw
  modified_base (219)..(219): a, c, t, g, unknown or other
  modified_base (257)..(257): a, c, t, g, unknown or other
  modified_base (266)..(266): a, c, t, g, unknown or other
  modified_base (409)..(409): a, c, t, g, unknown or other
  modified_base (571)..(571): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctggtctcctggacagtcgatcacatcctctgcactggaaccngcagtgacgttggtagttaataattgtctctgtacaanagcaccggnaatcgacccccaaaatccaatgtatttactagtagtacgtactactactacgcccgtcgtacggttacggttactacgtccttcttctcgtcactaacctactcgtcgtaccgaacctaaccgcccgtccctcgtaccacctntccgtcggcgtccgacgacgtcgtaggacgtagacgtactttaatttcgtcgtacgtacgttactactaataaccaacaacgtaacacctaacctactcgtcgttaacgttcggacgggacggacggaaacgtcgttaacgttccgttaaccttaacgaacnccgaccgaccggctccgccccgttaaccccg

SEQ ID NO: 407879 - DNA, 521 bp, Homo sapiens
  misc_feature: GZ8MTXP01AD70H.38.5.A05.1.454.CMB.2.raw
  modified_base (293)..(293): a, c, t, g, unknown or other
  modified_base (427)..(427): a, c, t, g, unknown or other
  modified_base (444)..(444): a, c, t, g, unknown or other
  modified_base (485)..(486): a, c, t, g, unknown or other
  modified_base (514)..(516): a, c, t, g, unknown or other
  modified_base (518)..(521): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaacagtctgagagctgaggacacggtccttgtattactgtgacaaaagtnttttgagtttagagtagtaggtctactactacggtatggacgtcgtggggccccaagggaccacggtcaccgtctccctcacgccctcaccgaacgggcccatcccggtcctcccctgccgccctgctcgagcncacctcgagacgcacgngccggcctgggctcgcctggtacaaggtcctactccacgtnnttcgattgagcgggcttgggcaagggcnnngnnnn

SEQ ID NO: 407880 - DNA, 593 bp, Homo sapiens
  misc_feature: GZ8MTXP01BK4EN.38.5.A05.1.454.CMB.2.raw
  modified_base (296)..(296): a, c, t, g, unknown or other
  modified_base (383)..(383): a, c, t, g, unknown or other
  modified_base (423)..(423): a, c, t, g, unknown or other
  modified_base (444)..(444): a, c, t, g, unknown or other
  modified_base (587)..(587): a, c, t, g, unknown or other
  modified_base (591)..(591): a, c, t, g, unknown or other
  modified_base (593)..(593): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgcaagaacttcctgtatctaacaaatgaacagtctagagagctgacggacgacggtccttgtattactgtagacaaaagtnttttagagtttagagttaagtagggtctactacgtacggtatggacgtcgtggggaccccaagggaccgacggtccacccgtctccncacgccctccaccgacggcccacgtccggtcccttcccgnggccgccctgcctccgaggcnccacctccgagacgcacgacggccggcccgtgggctcggcccgtggtaccgaacggtccttaacctccgacggtcgaacttccggacgttcgggacggcggggttacgttcggggaaccgaaggggtccgaacgtagtacggngcgngn

SEQ ID NO: 407881 - DNA, 571 bp, Homo sapiens
  misc_feature: GZ8MTXP01ASCJJ.38.5.A05.1.454.CMB.2.raw
  modified_base (278)..(278): a, c, t, g, unknown or other
  modified_base (281)..(281): a, c, t, g, unknown or other
  modified_base (289)..(289): a, c, t, g, unknown or other
  modified_base (444)..(444): a, c, t, g, unknown or other
  modified_base (556)..(556): a, c, t, g, unknown or other
  modified_base (565)..(565): a, c, t, g, unknown or other
  modified_base (567)..(567): a, c, t, g, unknown or other
  modified_base (569)..(569): a, c, t, g, unknown or other
  modified_base (571)..(571): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaatgaacagtctgagagctgacgacacggcttgtattacngtnacaaagtntttgagttagagtaagtaggtctactactacggtatggacgtcgtggggacccaacgggcacgtcacccgttctcctcagccctccaccgaacgggcccatcccggtccttccccgtggcccgccctgcctccaggtacgccacccgtcgagacnccacggacgccggccctgggcctacgcctggtaccaacggtcctaccttccgaaggttcgacttccggaaccttggggaaccggccggggcgttcgggacctaaggggcccncggaatcgngngngn

SEQ ID NO: 407882 - DNA, 605 bp, Homo sapiens
  misc_feature: GZ8MTXP01BZXK4.38.5.A05.1.454.CMB.2.raw
  modified_base (294)..(294): a, c, t, g, unknown or other
tcagtcgatcacgtcacgaccggtgctcgatttagatagatagacgaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcacatctctgcactaggaaccagcagtgacgttggtagttataattgtctctgtacaacagcaccggacaactcgaccccaaaatcatgtatttangagtcactcagtccggtcctacgtagggtttctaactcgtccttcgtctcgctactacctaacgtcgtacggaccaaccgaccggtccctcctacgaccctatcgtcgtacggtctccgaggccgtaggacggtacgacggtacttaattatttcgtacgggtctacgtttacaacttaacaaccgaacctacaaccaactactctacgcgttcgtacggacggggaacgaccgaaagtccgttacgttacccgttaccgtaacgtccgaacgtaccccgacgggttaccctcccgggttccccttccggg

SEQ ID NO: 407883 - DNA, 675 bp, Homo sapiens
  misc_feature: GZ8MTXP01DW7VB.38.5.A05.1.454.CMB.2.raw
  modified_base (224)..(224): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacgagggtcctgggcccagtctgccctggctcagcctgcctcgtgtctgggtctccgtggacagtcatcaccatcctctgcacgtggaaaccngcagtgtacgttggtagttactaatttcgtctccgtaggtaaccaacgacgccacccgggacaactccgaaccccctaaaatccattagtatttagtcgtacggtacctactacacgtccggtacccgttcggtacggggtttactaacgtcccgtctttctactcgactaactacctaacgtcgtacggaccaccgtacccggtacccttccctacgacccttacgttccgtcggtcgggtcctaccggaacgggtcgtacggacgggtacgaacggttactttaaagtttctttacgtcgtacttacgttactaactaactaaccaaaccgtacgacctaaactcgttctacgtcgttaacggttccgggacgggttaacggaaccgtaacgttcgttacgttacccgtaacttacgcgtaccgaccgacgtccgttcccgtaaccccg

SEQ ID NO: 407884 - DNA, 631 bp, Homo sapiens
  misc_feature: GZ8MTXP01EHIBH.38.5.A05.1.454.CMB.2.raw
  modified_base (221)..(221): a, c, t, g, unknown or other
  modified_base (282)..(282): a, c, t, g, unknown or other
  modified_base (315)..(315): a, c, t, g, unknown or other
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtagttaataatttgtctccgtaggtaccaacgacgaccgacccggganaacgtaccgaacccccaaaatcaatgtatttangagtcactcactcggtcctgtagggtttctaatcgtccttctctgctataaccaagtcgtggaccaacgaccggtccctcctacgaccctattcctcggtcggcctaccgaggtcctagggaaggaccgagtactttaaatttactttcgaggttactagtttacaacttaacgaaccaaaccagaaccaaacctcgtacgtcgacgttaagttaccgggacgggtaaacggaaccctaagggccttacggttaccgttaacgttaacgaccaaccggacccgaacggttcccttaacccgttccccgttaaccgg

SEQ ID NO: 407885 - DNA, 571 bp, Homo sapiens
  misc_feature: GZ8MTXP01AR9HT.38.5.A05.1.454.CMB.2.raw
  modified_base (261)..(261): a, c, t, g, unknown or other
  modified_base (293)..(293): a, c, t, g, unknown or other
  modified_base (363)..(363): a, c, t, g, unknown or other
  modified_base (410)..(410): a, c, t, g, unknown or other
  modified_base (458)..(458): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgtacgttggtgttaataattgtctctggtacaacngcaccggcaatcgaccccaaatcatgatttangagtcactcatccggcctgtacgggtttctaagtcgtccttctctgctactaaccagtctaggccaaacnccggcctcctcgaccatctcgtcgggctccgaggcctggacggacgnggtactaattactttcaggtctagtttaccattaaactacgaaaccanacaaactcttcacgtcctaagttcggacgggacggaccgaaacgtcttaggttaccccgttacgtaacgtaccgaacgacccgtaacgggcctaacccgcccccgttaaccgg

SEQ ID NO: 407886 - DNA, 665 bp, Homo sapiens
  misc_feature: GZ8MTXP01BHP2K.38.5.A05.1.454.CMB.2.raw
  modified_base (220)..(220): a, c, t, g, unknown or other
  modified_base (265)..(265): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgacgttggtgttataattgtctctgtacaacagcaccggnaactcgaccccaaatcatgtatttatgagtcactcactccggcctgtagggtttctaactcgtccttctctgctactaccaagtctagaccaacgaccggccctcccgtcgaccctatcgtcgtcgggcctccgagggccgtaggacgggaacgtagggtacctttaaattttactttccgtagggtactttaagtttacctaaacgttaaccttaaacccgaaacccaagaaccctaaacctaccgttacgtacgtaccgtttaacggtttccgggggaaccgggaaacgggggaaaccccaaagggtcccttaccgggttaccccgttaccgttaaacggtccgaaccgtaccccggaacggggttcccttaacccgggttcccccccgttaaccggg

SEQ ID NO: 407887 - DNA, 669 bp, Homo sapiens
  misc_feature: GZ8MTXP01C03ZV.38.5.A05.1.454.CMB.2.raw
  modified_base (224)..(224): a, c, t, g, unknown or other
  modified_base (311)..(311): a, c, t, g, unknown or other
  modified_base (495)..(495): a, c, t, g, unknown or other
tcagtcgatcacgtcacgaccggtgctcgatttagatagatagacgaggggggggtctcaggaggcagcgctctcaggacatctccaccatggcctgggctctgctgctcctccaccctcctcactcagggcacgagggtcctgggcccagtctgccctggctcagcctgcctcgtgtctgggtctccgtggacagtcatcaccatctctgcacgtaggaaccngctagtgacgttggtagttaataatttgtctcctaggtaccaacagaccgaccggacaactcgaaccccctaaatcatgtatttagngtagtcactcgacgtccgcctgttacggttactagtcgtaccttctctgactactaaccgtaacgtcgtacggacctaaaccgtaccggcccctacccgtacgaaccctcgttccgtcggtcggccgtacccgagggtacgttacgggaacggtaacggagttaccttaaatttacgtttccgngtaacggtatttaaccaattaaactaacccgaaactacgtaaccaactaccttacgtcgtacgttaacggttacggggacgggtaaaccggaaccgtaaacgtccgttaaaccggcccgttaacgtaacgtacgaaccgtacccgacggttccctaaccgttccccgttaaccg

SEQ ID NO: 407888 - DNA, 629 bp, Homo sapiens
  misc_feature: GZ8MTXP01D2B4V.38.5.A05.1.454.CMB.2.raw
  modified_base (301)..(301): a, c, t, g, unknown or other
  modified_base (622)..(622): a, c, t, g, unknown or other
  modified_base (624)..(625): a, c, t, g, unknown or other
  modified_base (627)..(627): a, c, t, g, unknown or other
  modified_base (629)..(629): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtgggtctcaggtattagttggaacagtggtaggataggctatgcggactctgtgaagggccgattcagcatctccagagacaacgccaaagtaacttccctgtaatctaacaaatgaaacagtctgagagctgaggacacggtcttagtattactgtagaactaaaaagtnttttgaagtttagtaagtaaggttaaggtcttaacgttaacgtacggtatacggacgtcgtcggggtaccccaaacgggaccgtacggtccacccggttcctcccgtccacgtcccctacccgaaccgtaaaccgggcccctaagttcccggttcccttccccgtggtcccgcccttgcccgttacccgaggacgcctacccgaccgagaacggccacggacggccggcccgtgggtaccctaccgtgtaccgaaacgtcctaccttccgagtgaactcgagtcggacggtcgggcgttcggcgaagggccagtaagtagngnngngn

SEQ ID NO: 407889 - DNA, 684 bp, Homo sapiens
  misc_feature: GZ8MTXP01AKVRM.38.5.A05.1.454.CMB.2.raw
  modified_base (221)..(221): a, c, t, g, unknown or other
  modified_base (266)..(266): a, c, t, g, unknown or other
  modified_base (290)..(290): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtagttataattgtctctgtacacagcaccggnaatcgaccccaaatcatgatttangagtcactcacgtccggcctcgtagggtttactaactcgtcctttctctgctataacccaagttctacggaccaaaccgaccgtccctccctcgaccctacgtcctcgtcgggacccttcccgagggtccgtagggacgggaaccggtaacggttacctttaaaagttttcgttttaccgtacggggtactttaacggtttacctaaacgtttaacctaaaccgaaaccacggtaaccctaaactccttacgtaccggtcttaacgggttccggggaacggggaccggggttaaacccaaacggtccgttaaccgggttaccccgttacctaaacgggtcccgaaccggaaccccggtaacggttccccgttaaccgcccccccgtttaaccgg

SEQ ID NO: 407890 - DNA, 605 bp, Homo sapiens
  misc_feature: GZ8MTXP01BIEPF.38.5.A05.1.454.CMB.2.raw
  modified_base (132)..(132): a, c, t, g, unknown or other
  modified_base (218)..(218): a, c, t, g, unknown or other
  modified_base (297)..(297): a, c, t, g, unknown or other
  modified_base (462)..(462): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcaggcacngggtcctgggcccagtctgccctggctcagcctgcctcgtgtctgggtctctggacagtcgatcaccatctctgcacgtggaaccngcagtgtagttggtagttaataattgtctcgtgtaaccaagacgcaccggacaactcgaccccaaatcatgtatttagngagtctactcacgtccggtccgtcgttagggtttactaacgtcgtccttctactgctactacaacgtcgtacgaccaactccggtccctaccgtacgaccctagttccgcgttcgggccctccgaggtccgtagggacggaacgtagtactttaattactttcgngggtacttagtttacaaagttaactaaccgaacacgacctaactacttcgtctactaacgggttcggacggtaacgggacctaaggcgttacgaccgttaaccgtaacgtcaaccgaccgacggttccctccgttccccgtcg

SEQ ID NO: 407891 - DNA, 665 bp, Homo sapiens
  misc_feature: GZ8MTXP01CBWT3.38.5.A05.1.454.CMB.2.raw
  modified_base (296)..(296): a, c, t, g, unknown or other
  modified_base (395)..(395): a, c, t, g, unknown or other
  modified_base (471)..(471): a, c, t, g, unknown or other
  modified_base (655)..(655): a, c, t, g, unknown or other
  modified_base (662)..(662): a, c, t, g, unknown or other
  modified_base (664)..(664): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaaaagtggtaggataggctatgcggactctggtgaagggccgattcagcatctccagagacaacgccaaagaacttccctgtatctaacaaatgaacagtctgacgagctgagacacggccttgtattactgtgactaaaagtnttttggaagttttagagttaggtaagggtctaacgtacgttaacggtatcggacgttcgtgggggaccaaacggggaccacggtcacccggtctcctcngccctccgaaccgacgggcccctagttccgggtcccttcccccgtgggccctccccgtggccctccgaagggaccncctacccgtccgaacgacgcaaccgtacgggggcccggtcccggtggggtcctcgggccccgttgggtaccgaaaacggggttacccttaccttaccccgacggttcggaaacttcccgggaacggttcgggaacggcccgggggtccttaagggggcccaaagggggtccacttaagtagggngcgtcgngng

SEQ ID NO: 407892 - DNA, 493 bp, Homo sapiens
  misc_feature: GZ8MTXP01BM323.38.5.A05.1.454.CMB.2.raw
  modified_base (219)..(219): a, c, t, g, unknown or other
  modified_base (258)..(258): a, c, t, g, unknown or other
  modified_base (267)..(267): a, c, t, g, unknown or other
  modified_base (300)..(300): a, c, t, g, unknown or other
  modified_base (410)..(410): a, c, t, g, unknown or other
  modified_base (429)..(429): a, c, t, g, unknown or other
  modified_base (437)..(437): a, c, t, g, unknown or other
  modified_base (439)..(439): a, c, t, g, unknown or other
  modified_base (446)..(446): a, c, t, g, unknown or other
  modified_base (469)..(469): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcacatctcctgcactggaaccngcagtgacgttggtgttaataatttgtctctggtacaanagcaccggnaatcgaccccaaatcatgatttatgagtcactnactcgcctgtagggtttctaatcgtccttctctgctactaccaagtctggacaacaccggcctccctgacccatctctggctccaggctagagacgagactaattattcnggctagtcatatacaacanacactctncntgtcggngacgacgagcacgacttactaancaacgaccacgcctccgcccgtcg

SEQ ID NO: 407893 - DNA, 652 bp, Homo sapiens
  misc_feature: GZ8MTXP01AT47N.38.5.A05.1.454.CMB.2.raw
  modified_base (305)..(305): a, c, t, g, unknown or other
  modified_base (542)..(542): a, c, t, g, unknown or other
tcagtcgatcacgtcacgaccggtgctcgatttagatagatagacagggggggggtctcaggaggcagcgctctcaggacatctccaccatggcctgggctctgctgctcctcaccctcctcactcagggcacagggtcctgggcccagtctgccctggctcagcctgcctcgtgtctgggtctccgtggacagtcgatcaccatctctgcactggaaccagcaagtgtacgttggtagttaataaatttgtctctaggtaccaagacgcgaccggacaatcgacccccaaaatcatgatttagngagttcactcacgtcggtcctgtacgggtttacaatccgtcctttactctgacctaatacccgaaacgtcgtacgggaccaaaccgacccgggtcccctacccggtacaaccctaattccgtcgtcggggtacctacccggaggccttaagggaacggtaccggtaaggttaaccttaaagtttactttaccgtgggtaccttaagttacaaacgtttaacaaaccaaacccgtaanaacaactacgtactacgtactcggtacgggacgggtaaacgaccgtaagtccgttacgttaaccgttactaacgcgaacggaccgtacgttcccgtcccgttcccgtccg

SEQ ID NO: 407894 - DNA, 535 bp, Homo sapiens
  misc_feature: GZ8MTXP02G0C8R.38.5.A05.1.454.CMB.2.raw
  modified_base (526)..(526): a, c, t, g, unknown or other
  modified_base (532)..(535): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtattttgagtttagagtagtaaggtctactactacggtatggacgtctggggccccaaggggaccacggtcaccgtctcctcagccctccaccaacggggcccatccggtccttccccctggccgcccctgcctcccaggacgccaccctccgagacgccaacagccggcccctggggcctgccctgggtcaaggctacttccacgtgatcgactgacgcgggctgggcaagggccncatagnnnn

SEQ ID NO: 407895 - DNA, 513 bp, Homo sapiens
  misc_feature: GZ8MTXP02HJO47.38.5.A05.1.454.CMB.2.raw
  modified_base (289)..(289): a, c, t, g, unknown or other
  modified_base (510)..(513): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgcaaaagnttttgagtttagagtagtaagggtctactactacggtatggacgtctggggccccaagggaccacggtcaccgtctcctcagcctccaccaagggcccatcggtccttcccctggccgccctgctccaggacgcacctccgagagcacagccggccctggggctgcctggtcaaggctactccacgtgactcgactgacgcgggctggcaaggcgcatagnnnn

SEQ ID NO: 407896 - DNA, 498 bp, Homo sapiens
  misc_feature: GZ8MTXP02HAD17.38.5.A05.1.454.CMB.2.raw
  modified_base (448)..(448): a, c, t, g, unknown or other
tcagtcgatcacgtcacgaccggtgctcgatttagatagatagacagggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctctggtaccaacagcacccggcaatcgccccaaaatcatgatttatgaggtcactcatcggcctcaggggtttctaatcgccttctctgcatccaagtctggcaacacggcctcctgacccatctctggctccaggctggaggacgaggctaagttatttctgctagttcatatacaacagcaacactctagctattcggngacgggaccaagctcgacgtccaagtcagcccaaggcctcgccccctcgg

SEQ ID NO: 407897 - DNA, 681 bp, Homo sapiens
  misc_feature: GZ8MTXP02JF4IU.38.5.A05.1.454.CMB.2.raw
  modified_base (291)..(291): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtggtctcaggtattagttggaacagtggtaggataggctatgcggactctgtgaagggccgattcagcatctccagagacaacgccaaagaattccctgtatctacaaatgaacagtctgagagctgaggacacggccttgtaattactgtgacaaaagtnttttgagtttagagtagtaagggtctaactactacggtatggacgtcgtggggaccccaaaggggacccacggtccaccggtctcctcgacgtccctacccgaaccgaaacggggcccccaagttcccgggttccctttcccccccgtggggccccgtcccccttacggccctacccgaacggggacgacccaacccgtcccgaagacgccaacgacggtccggccccgttgggggccttcggccccttggggtaccaaaacggggtacccttaacccgtttccgaaaccggtttgaacgttccggaaaccttgggaacggtcccgggggccttagggggaaccccaaaagggggcccggaaacccgtttaaacgtacggcgacgacgcg

SEQ ID NO: 407898 - DNA, 579 bp, Homo sapiens
  misc_feature: GZ8MTXP02HEM9V.38.5.A05.1.454.CMB.2.raw
  modified_base (279)..(279): a, c, t, g, unknown or other
  modified_base (445)..(445): a, c, t, g, unknown or other
  modified_base (450)..(450): a, c, t, g, unknown or other
  modified_base (457)..(457): a, c, t, g, unknown or other
  modified_base (576)..(576): a, c, t, g, unknown or other
  modified_base (578)..(579): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaacagtctgagagctgagacacggcctgtattacngtgacaaaagattttgagtttagagtagtaaagggtctaactactaaggtatggacgtcgtggggccccaaagggaccacggtcaccgtctcctcacgcctacccaaccgaaaggggcccctaatccgggtccttcccccctggcccgcccctgcctccagggacncaccncgagacncacgacgccgtcccgtgggactcgcccgtaggtacgaaacggtaccttaccgttccgaacgtcgacgttccgaactcggacggacgggcggtacggacgaacggacgacgacgtagacncnn

SEQ ID NO: 407899 - DNA, 501 bp, Homo sapiens
  misc_feature: GZ8MTXP02G544Q.38.5.A05.1.454.CMB.2.raw
  modified_base (292)..(292): a, c, t, g, unknown or other
  modified_base (421)..(421): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctctggtaccaacagcaccggcaatgccccaaaatcatgatttangagtcactcatcggcctcaggggtttctaatcgccttctctgcatccaagtctggcaacacggcctcctgacccatctctggctcagctgagacgaggactaattattctgctagttcatatacaacanacaacactctgctattcggacggaggaacccaaagctacgacccgtactaagtcaacgcccaaggcctcgccccttccgg

SEQ ID NO: 407900 - DNA, 565 bp, Homo sapiens
  misc_feature: GZ8MTXP02HNZ39.38.5.A05.1.454.CMB.2.raw
  modified_base (559)..(559): a, c, t, g, unknown or other
  modified_base (562)..(565): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctacaaatgaacagtctgagagctgaggacacggccttgtattactgtgacaaaagtattttgagtttagagtagtaaggtctactactacggtatggacgtcgtggggcccaagggaccacggtcaccgtctctcacgcctccaccaagggcccatccggtccttcccccgtggccgtcccctggccctccgaggacgccaccgtcccgagacgccacgacggtccggcccctgggggcctcggcccgtgggtaccaaagggtccttaccgttcccaacggttgaactcgaactggacgccggggctgggccaagggcctacanagnnnn

SEQ ID NO: 407901 - DNA, 546 bp, Homo sapiens
  misc_feature: GZ8MTXP02I0EVB.38.5.A05.1.454.CMB.2.raw
tcagtcgatcacgtcacgaccggtgctcgatttagatagatagacaggggggtctcaggaggcagcgctctcaggacatctccaccatggcctcgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctctggtaccaacagcacccggcaatcgacccccaaaatcatgtatttatgaggtcactcatcggccctcgaggggtttctaatcgccttctctgcatccaagtctggacaacgaccgccctccctgacccatctcgtcgggctcccgaggcctggacggacgaggacttaagtttatttctgactagtttacattactaacaaccagacaaacactctgcttacgttcgggcggtaacggaccaaagtccgtacgacccgtactaaagtccacgacccaaggccttccgccccctcgg

SEQ ID NO: 407902 - DNA, 499 bp, Homo sapiens
  misc_feature: GZ8MTXP02ILVTH.38.5.A05.1.454.CMB.2.raw
  modified_base (220)..(220): a, c, t, g, unknown or other
  modified_base (260)..(260): a, c, t, g, unknown or other
  modified_base (292)..(292): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctctggtaccaangcaccggcaatgcccccaaaatcatgatttangaggtcactcatcggcctcaggggttctaatcgcttctctgctcaagtctggcaacacggccctccctgaccatctctggactccgaggcctgaggacgaggctagattactactgctagttcatatacagcactactctactctgttacttcggcggaggaccagggtcgaccgtctaagtcacgccaaggcctcgcccctgtacc

SEQ ID NO: 407903 - DNA, 554 bp, Homo sapiens
  misc_feature: GZ8MTXP02GJOF1.38.5.A05.1.454.CMB.2.raw
  modified_base (293)..(293): a, c, t, g, unknown or other
  modified_base (535)..(535): a, c, t, g, unknown or other
  modified_base (547)..(547): a, c, t, g, unknown or other
  modified_base (549)..(549): a, c, t, g, unknown or other
  modified_base (551)..(554): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtgggtctcaggtattagttggaacagtggtaggataggctatgcggactctgtgaagggccgattcagcatctccagagacaacgccaaagaattccctgtatctaacaaatgaaacagtctgagagctgaggacacggccttgtattactgtgacaaaagtnttttgagtttagagtagtaaggtctactactacggtatggacgtctggggaccccaagggaccacggtcaccgtctcctcagcctccaccgaagggccccatccggtccttcccccgtggccgacccctgcctcccgagggacgcccacccgtccgagacgccaacgacggtccggcccgtggggcctcgccgttggacgaaacgccttaccttccgagtgacgtcgactggacggcggcgnggacaaggctanangnnnn

SEQ ID NO: 407904 - DNA, 508 bp, Homo sapiens
  misc_feature: GZ8MTXP02HJ5NX.38.5.A05.1.454.CMB.2.raw
  modified_base (293)..(293): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctctggtaccaacagcacccggcaatcgccccaaaatcatgatttangaggtcactcatcggcctcaggggtttctaatcgccttctctgcatccaagtctggcaacacgcctccctgaccatctctgggctcagctgaggacgaggctaattattctgctagtcatatacaacagacaacactctgctattcggcggaacggaccaaacgctacggaccgtacctaacgtcaacgcccgaaggcctccgcccccgttccgg

SEQ ID NO: 407905 - DNA, 513 bp, Homo sapiens
  misc_feature: GZ8MTXP02GLMVI.38.5.A05.1.454.CMB.2.raw
  modified_base (290)..(290): a, c, t, g, unknown or other
  modified_base (409)..(409): a, c, t, g, unknown or other
  modified_base (423)..(423): a, c, t, g, unknown or other
  modified_base (510)..(513): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagnttttgagtttagagtagtaaggtctactactacggtatggacgtctggggccccaaggggaccacggtcaccgtctcctcagcctccaccaagggcccatcggtccttccccctggccnccctgctccagganccacctccgagagcacagccgccctgggctcgcctggtcaaggctactccacgtgatcgactgacgcgggctggcaaggcgcatagnnnn

SEQ ID NO: 407906 - DNA, 580 bp, Homo sapiens
  misc_feature: GZ8MTXP02IW7J3.38.5.A05.1.454.CMB.2.raw
  modified_base (291)..(291): a, c, t, g, unknown or other
  modified_base (420)..(420): a, c, t, g, unknown or other
  modified_base (437)..(437): a, c, t, g, unknown or other
  modified_base (578)..(580): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtaaggtctactactacgtatggacgtcgtggggacccaagggaccacggtccaccgtctcctcacgccctccaccaacggggcccagttccggtcccttcccccgtggcccnccctgccctccaggacnccaccctccgagacgccaacgacgcccggcccctggggccctcgcccgtgggtaccaaaacgggtccttaaccgttcccgaacggttcgacttccggaacgttggacggccggggctcgggaccaagggccgacaagtgcnnn

SEQ ID NO: 407907 - DNA, 531 bp, Homo sapiens
  misc_feature: GZ8MTXP02I8KJB.38.5.A05.1.454.CMB.2.raw
  modified_base (222)..(222): a, c, t, g, unknown or other
  modified_base (299)..(299): a, c, t, g, unknown or other
  modified_base (463)..(463): a, c, t, g, unknown or other
tcagtcgatcacgtcacgaccggtgctcgatttagatagatagacaggggtggggtctcaggaggcagtgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtggttataaatttgtctctggtaccaacagcacccggcaatcgacccccaaaatcatgatttangagtcactcatcggccctcgaggggtttctaatccgctttcgtctgcatccagtctggaccaacgaccgccctccctgaccctatctcgtgggcctccgaggctggaacggacgaggacttaagtttatttcgtgctagttcatatacaaccagacaacactcngtacttacgtcggacggaggaccaagctagaccgtcgtaagtacacgacccaacggcctacgcccccg

SEQ ID NO: 407908 - DNA, 612 bp, Homo sapiens
  misc_feature: GZ8MTXP02HT3I1.38.5.A05.1.454.CMB.2.raw
  modified_base (291)..(291): a, c, t, g, unknown or other
  modified_base (611)..(611): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaaggccgattcagcatctccagagacaacgccaagaattccctgtatctaacaaatgaacagtctgagagctgaggacacggccttgtattactgtgacaaaagtnttttgagtttagagtagtaaggtctactactacggtatggacgtcgtggggaccccaagggaccacggtcaccgtctcctcagccctccaccgaagggccccatcccggtcccttcccccgtggcccgcccctgccctcccgaggacgccaaccctcgagacgccacgaggccgccccgtggggccttggccctagggtaccaaaacgggtacccttaaccgttccccgaacggttcgaacgtttcccggaaccttgggaacggtcccgggggaccgttcggggaccgaaaacgggggcccgaccgacgtacggcgcgcng

SEQ ID NO: 407909 - DNA, 514 bp, Homo sapiens
  misc_feature: GZ8MTXP02HQVJ7.38.5.A05.1.454.CMB.2.raw
  modified_base (219)..(219): a, c, t, g, unknown or other
  modified_base (292)..(292): a, c, t, g, unknown or other
  modified_base (389)..(389): a, c, t, g, unknown or other
  modified_base (429)..(429): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctctggtaccaacagcacccggcaatgccccaaaatcatgatttangaggtcactcatcggcctcaggggtttctaatcgcttctctgcatccaagtctggcaacaccgcctccctgacccatctctggctcagctgagacgngactaattatttctgctagttcatataacaacagacaacnctactgcttaagttcggacggagggaccaaagcgtacgaaccggtctaaaacggtcaacgacccgaaggcctcgcccccttccgg

SEQ ID NO: 407910 - DNA, 528 bp, Homo sapiens
  misc_feature: GZ8MTXP02JUHMV.38.5.A05.1.454.CMB.2.raw
  modified_base (289)..(289): a, c, t, g, unknown or other
  modified_base (520)..(520): a, c, t, g, unknown or other
  modified_base (525)..(528): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgcaaaagnttttgagtttagagtagtaaggtctactactacggtatggacgtcgtggggccccaaggggaccacggtcaccgtctcctcacgcctccaccaaggggccccatccggtccttcccccgtggcccgccctgcctcccaggacgccacctccgagacgcacgagccggccctggggctgaccctggtcaaggactactccacgtgactcgactgacgcgggctggcaaggcncatgnnnn

SEQ ID NO: 407911 - DNA, 554 bp, Homo sapiens
  misc_feature: GZ8MTXP02FUJQ3.38.5.A05.1.454.CMB.2.raw
  modified_base (291)..(291): a, c, t, g, unknown or other
  modified_base (549)..(549): a, c, t, g, unknown or other
  modified_base (551)..(554): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtaagggtctactactacggtatggacgtcgtggggccccaaaggggaccacggtcaccgtctcctcacgccctaccaacccgaacgggccccatccggtcccttcccccgtggcccgcccctgcctccgaggacgccaccctccgagacgccaacgacggccggcccctggggcctcggcctggtacaaaggcctacttccacgtgactcgacgtgacggcgggctggacaaggcgacagngnnnn

SEQ ID NO: 407912 - DNA, 573 bp, Homo sapiens
  misc_feature: GZ8MTXP02JYEPC.38.5.A05.1.454.CMB.2.raw
  modified_base (292)..(292): a, c, t, g, unknown or other
  modified_base (436)..(436): a, c, t, g, unknown or other
  modified_base (570)..(570): a, c, t, g, unknown or other
  modified_base (572)..(573): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctacaaatgaacagtctgagagctgaggacacggccttgtattactgtgacaaaagtnttttgagtttagagtagtaaggtctactactacggtatggacgtcgtggggaccccaagggaccacggtcaccgtctcctcacgccctccaccaaggggccccatccggtccttcccccgtggcccgccctgccctccaggacnccaccctccgagacgccacacggccggccctggggctcgcccgtggtaccaaacgggcttaccttccaacggttcgaacgttccggacgttggacggccggggctacggggacaaagggggcccacgagtaggncnn

SEQ ID NO: 407913 - DNA, 597 bp, Homo sapiens
  misc_feature: GZ8MTXP02HNFM5.38.5.A05.1.454.CMB.2.raw
  modified_base (293)..(293): a, c, t, g, unknown or other
  modified_base (591)..(591): a, c, t, g, unknown or other
  modified_base (595)..(597): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaacagtctgagagctgaggacacggccttgtattactgtgacaaaagtnttttgaagtttagagtagtaaggtctaactagtacggtatggacgtcgtggggaccccaaaggggaccacggtccaccgttctccctcacgccctaccaccgaaacgggccccaattcccgggtccctttccccccgtggcccgcccccttggcccttccgaacggacgcccaacccgtacccggagaaacgccaacacggtcccggccccgttggggcctcggcccttgggaccaaggaccttaccttccgaacgttgactcgactggacgccggggctcggacgaaggcgtacganagcnnn

SEQ ID NO: 407914 - DNA, 520 bp, Homo sapiens
  misc_feature: GZ8MTXP02GQXUK.38.5.A05.1.454.CMB.2.raw
  modified_base (291)..(291): a, c, t, g, unknown or other
  modified_base (404)..(404): a, c, t, g, unknown or other
  modified_base (417)..(417): a, c, t, g, unknown or other
  modified_base (517)..(520): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaacagtctgagagctgaggacacggccttgtattactgtgacaaaagnttttgagtttagagtagtaagggtctactactacggtatggacgtctggggcccaaaggggccaggtcaccgtctctcagccctccaccagggcccatcgtcctcccctggcnccctgctccagcnccacctccgagacgcacacgccggccctggggctcgccctggtcaacggactacttccacgtgactccgactgacgcgggctggcaaacggcgacatagnnnn

SEQ ID NO: 407915 - DNA, 554 bp, Homo sapiens
  misc_feature: GZ8MTXP02HA8CA.38.5.A05.1.454.CMB.2.raw
  modified_base (222)..(222): a, c, t, g, unknown or other
  modified_base (431)..(431): a, c, t, g, unknown or other
tcagtcgatcacgtcacgaccggtgctcgatttagatagatagacaggggtggggtctcaggaggcagcgctctcaagacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtggttataattgtctctgtacacagcaccggcaatcgaccccaaatcatgtattatgagtcactcactccggcctcgtaggggtttctaatccgtcttctctgcactccagtctaggactaaccgaccgccctcctcgaccatcctcgtcgggcctccgaggcgtaggacggacgaggtactaaatttatttacgngtactacgttacaatactaacaaccagaccaactactctagtactacgttcgggacggaacggaccacgctacgaccgtaaccgtaaacgtccgaacgcccgaacggtcctacccgtcccccg

SEQ ID NO: 407916 - DNA, 571 bp, Homo sapiens
  misc_feature: GZ8MTXP02JDK7O.38.5.A05.1.454.CMB.2.raw
  modified_base (290)..(290): a, c, t, g, unknown or other
  modified_base (408)..(408): a, c, t, g, unknown or other
  modified_base (415)..(415): a, c, t, g, unknown or other
  modified_base (569)..(571): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagnttttgagtttagagtagtaaggtctactactacggtatggacgtcgtggggcccaagggaccacggtcaccgtctcctcacgcctccaccgaacgggcccagtccggtccttcccccngggcccncccgtgccctccacggacgccacccgtccgagacgccaacgacggccggcccctggggccttcggcccgtgggtaccaaacggccttaaccttccgaaccggttgacttcgaaccgtggaacggcgggtacgcggacgaagggccgcaagtgcnnn

SEQ ID NO: 407917 - DNA, 546 bp, Homo sapiens
  misc_feature: GZ8MTXP02HBJ64.38.5.A05.1.454.CMB.2.raw
  modified_base (293)..(293): a, c, t, g, unknown or other
  modified_base (419)..(419): a, c, t, g, unknown or other
  modified_base (504)..(504): a, c, t, g, unknown or other
  modified_base (540)..(540): a, c, t, g, unknown or other
  modified_base (543)..(546): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaacagtctgagagctgaggacacggccttgtattactgtgacaaaagtnttttgagtttagagtagtaaggtctactactacggtatggacgtcgtggggaccccaaggggaccacggtcaccgtctcctcagccctccacgaacgggcccagtccggtcctcccccgtggcccnccctgcctcccaggacgccacctccgagagcacgagtccggccctggggcctgcccgtggtacaaaggcctaccttccgaacgtnacgtcgacgtgacggcggctagggcaagggccacanagnnnn

SEQ ID NO: 407918 - DNA, 508 bp, Homo sapiens
  misc_feature: GZ8MTXP02J1DSC.38.5.A05.1.454.CMB.2.raw
  modified_base (289)..(289): a, c, t, g, unknown or other
  modified_base (402)..(402): a, c, t, g, unknown or other
  modified_base (499)..(499): a, c, t, g, unknown or other
  modified_base (505)..(508): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgcaaaagntttgagtttagagtagtaagggtctactactacggtatggacgtctggggccccaaggggaccacggtcacgtctcctcagccctccacaacgggcccatcggtccttccccnggccgccctgctccaggcgccacctccgagacgcacagcgccctgggctgcctggcaagctactccagtcatcgactgacgcgggctggccaaggcngatagnnnn

SEQ ID NO: 407919 - DNA, 503 bp, Homo sapiens
  misc_feature: GZ8MTXP02JR5IQ.38.5.A05.1.454.CMB.2.raw
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatgcccccaaaatcatgatttatgaggtcactcatcggccctcaggggtttctaaatcgccttctctgcatccaagtctggcaacacggcctccctgacccatctctgggctccaggctgaggacgaggctaattatttctgcagttcatatacaaccagcaacactctgctattcggcggaggaccaagctagaccgtctaagtcacgacccaaggctcgccccctcgg

SEQ ID NO: 407920 - DNA, 502 bp, Homo sapiens
  misc_feature: GZ8MTXP02IRTAR.38.5.A05.1.454.CMB.2.raw
  modified_base (266)..(266): a, c, t, g, unknown or other
  modified_base (291)..(291): a, c, t, g, unknown or other
  modified_base (373)..(373): a, c, t, g, unknown or other
  modified_base (433)..(433): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataattgtctcctgtaccaacagcaccggnaatcgaccccaaaatcatgatttangagtcactcatcgcctcagggttctaatcgccttctctgctatccaagtctggacaaaccacgccctcccgtgaccatctcngggctccagctgagacgagctaattattctgctagttcataatacaacagacaacactcngctagttcggacggaggaccaaagctacgaccgtactaacgtcaacggcccaaggcctcgtccccctcg

SEQ ID NO: 407921 - DNA, 516 bp, Homo sapiens
  misc_feature: GZ8MTXP02IZ4LA.38.5.A05.1.454.CMB.2.raw
  modified_base (258)..(258): a, c, t, g, unknown or other
  modified_base (293)..(293): a, c, t, g, unknown or other
  modified_base (439)..(439): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaattgtctctggtacaacngcaccggcaatcgacccccaaaatcatgtatttangaggtcactcatcggccctcgaggggtttctaatcgcttctctgcatccaagtctggcaacgaccgccctcctgaccatctcgtgggctcaggctggaggacgaggactaagtttattctgctagttcatactacaacagcaaacnctactgcttagttcgggacggacgggaccaaacgctacgacccgttacaagtcacgacccaagctccgccccttcgg

SEQ ID NO: 407922 - DNA, 583 bp, Homo sapiens
  misc_feature: GZ8MTXP02INLY4.38.5.A05.1.454.CMB.2.raw
  modified_base (428)..(428): a, c, t, g, unknown or other
  modified_base (433)..(433): a, c, t, g, unknown or other
  modified_base (450)..(450): a, c, t, g, unknown or other
  modified_base (580)..(583): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaaacagtctgagagctgaggacacggccttgtattactgtgacaaaagtattttgagtttagagtaagtaaggtctataactacggtatggacgtcgtggggcccaaaggggaccacgggtcaaccgtctcctcacgccctacccaaccgaaacgggcccaaagttccgggtcccttcccccgnggccncccctgcctccaggacnccaccgtccgagacgcaacgacgccgccctaggggcctgcccgttagggtaccaaaacgggtacctaaccttcccaacgttcgaattccgaaacttggaacggcggggactggcgaaggacgacgacagnnnn

SEQ ID NO: 407923 - DNA, 590 bp, Homo sapiens
  misc_feature: GZ8MTXP02GSSMH.38.5.A05.1.454.CMB.2.raw
  modified_base (294)..(294): a, c, t, g, unknown or other
  modified_base (586)..(590): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaaacagtctgagagctgaggacacggccttgtattactgtgacaaaagtnttttgagtttagagtagtaaggtctactactacggtatggacgtcgtggggacccaagggaccacggtcaccgtctcctcagccctccaccgaacgggccccatcccggtccttcccccgtggcccgccctgcctcccgaggacgccaaccctccgagacgccacacggccggccctggggctcggcccgtaggggtccaaaacgggtccttaaccgttcccgaacggttacggaacccggaaccttgggaacgggccggggcctaggggccaaaggggcgtacaagtacgnnnnn

SEQ ID NO: 407924 - DNA, 526 bp, Homo sapiens
  misc_feature: GZ8MTXP02FIWYR.38.5.A05.1.454.CMB.2.raw
  modified_base (291)..(291): a, c, t, g, unknown or other
  modified_base (521)..(521): a, c, t, g, unknown or other
  modified_base (524)..(526): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctacaaatgaacagtctgagagctgaggacacggccttgtattactgtgacaaaagnttttgagtttagagtagtaagggtctactactacggtatggacgtctggggccccaaggggaccacggtcaccgtctcctcagcctccaccaagggcccatccggtccttccccctggccgccctgcctcccaggacgccaccctccgagacgccacacggcggcccctggggctcgcctggtcaaggctacttccacgtgatcgactgagcgggctggcaaggcgctanagnnn

SEQ ID NO: 407925 - DNA, 551 bp, Homo sapiens
  misc_feature: GZ8MTXP02IP151.38.5.A05.1.454.CMB.2.raw
  modified_base (293)..(293): a, c, t, g, unknown or other
  modified_base (411)..(411): a, c, t, g, unknown or other
  modified_base (417)..(417): a, c, t, g, unknown or other
  modified_base (545)..(545): a, c, t, g, unknown or other
  modified_base (548)..(551): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtgggtctcaggtattagttggaacagtggtaggataggctatgcggactctgtgaagggccgattcagcatctccagagacaacgccaagaacttccctgtatctaacaaatgaaacagtctgagagctgaggacacggccttgtattactgtgacaaaagtnttttgagtttagagtagtaaggtctactactacggtatggacgtgtgggcccaagggaccacggtcaccgtctcctcacgcctaccaccgaacgggcccagtccggtccttcccccgnggcccncccctgccctccgacggacgcccaaccgtccgaagacgaccacgacgtccgggccctggggcctggccctggtacaacggaccttactccacgtgactcgactggacgcgggctcggagaacgcgcanagnnnn

SEQ ID NO: 407926 - DNA, 520 bp, Homo sapiens
  misc_feature: GZ8MTXP02I111J.38.5.A05.1.454.CMB.2.raw
  modified_base (404)..(404): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggcattataactctgtctcgtggtaccaacacacccaggccaagcccccaaactcatcatttatgacgtcactcatcgccctcagggtttctactcgcttctctgctcagttgcacacgcctcctgacctattctggctcaggctgagcgagctgatttatgctcctcatatanagcagcagccacccttatcgtctttacggaacttcgggacctaaagggtccaccggttacctaccggtaccaacggaccccaaacggccccaaaccccgtactcggtacctaaccg

SEQ ID NO: 407927 - DNA, 512 bp, Homo sapiens
  misc_feature: GZ8MTXP02JAG31.38.5.A05.1.454.CMB.2.raw
  modified_base (219)..(219): a, c, t, g, unknown or other
  modified_base (233)..(233): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgtactggaaccngcagtgacgttggngttataaattgtctctggtaccaacagcacccgggcaatcgacccccaaaatcaatgatttatgagtcactcatcgcctcaggggtttctaatcgtcttcctctgcatccaagtctggcaacacggcctccctgaccatctctggctccaggctgaggacgaggctaattatttctgctagttcatataccaacagacaacactctgctatcggacggtagggaccaaagctacgaccgtcctaaagtcacgacccaaggcctcgtccccctggtaccc

SEQ ID NO: 407928 - DNA, 538 bp, Homo sapiens
  misc_feature: GZ8MTXP02HC9EK.38.5.A05.1.454.CMB.2.raw
  modified_base (289)..(289): a, c, t, g, unknown or other
  modified_base (533)..(533): a, c, t, g, unknown or other
  modified_base (535)..(538): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgagacacggccttgtattactgtgacaaaagnttttgagtttagagtagtaagggtctactactacggtatggacgtcgtggggaccccaaggggaccacggtcaccgtctcctcacgccctccaccgaacggggcccccagttcccgggtccttccccccgtggcccgccccgtgccctccaggcgccaccctccgagacgccacaggccgcccgtgggcctgccctggtcaaggctactccacgtgatcgatgacgcggctggcaaggcgacangnnnn

SEQ ID NO: 407929 - DNA, 515 bp, Homo sapiens
  misc_feature: GZ8MTXP02IZ0HW.38.5.A05.1.454.CMB.2.raw
  modified_base (222)..(222): a, c, t, g, unknown or other
  modified_base (261)..(261): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataatttgtctctggtacaacngcaccggcaatgacccccaaaatcatgatttatgaggtcactcatcggccctctaggggttctaatcccgcttctctgcatccagtctggcaacaccggcctccctgacccatctctgggctccgaggttgaggacgaggctgacttattatgcgcctcacatggaatcgagggtgggtttcggcggagggaccaaagttcgaaccgtcgtacggtcacgccaagcgtcgcccctcggcactcgtcgttacccc

SEQ ID NO: 407930 - DNA, 516 bp, Homo sapiens
  misc_feature: GZ8MTXP02JL194.38.5.A05.1.454.CMB.2.raw
  modified_base (291)..(291): a, c, t, g, unknown or other
  modified_base (408)..(408): a, c, t, g, unknown or other
  modified_base (423)..(423): a, c, t, g, unknown or other
  modified_base (513)..(516): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcaaagcatctccagagacaacgccaagaattccctgtatctacaaatgaacagtctgagagctgaggacacggccttgtattactgtgcaaaagnttttgagtttagagtagtaagggtctactactacggtatggactcgtggggccccaaggggacaacggtcaccgtctcctcagcctccaccaagggcccatcggtctcccctggccnccctgcctccagganccacctccgagacgcacagcggccctggggctgcctggtcaaggctactccacgtgatcgactgacgcgggctggccaaggcgacatagnnnn

SEQ ID NO: 407931 - DNA, 527 bp, Homo sapiens
  misc_feature: GZ8MTXP02IV8CQ.38.5.A05.1.454.CMB.2.raw
  modified_base (410)..(410): a, c, t, g, unknown or other
  modified_base (432)..(432): a, c, t, g, unknown or other
  modified_base (524)..(527): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagattttgagtttagagtagtaagggtctactactacggtatggacgtcgtggggcccaagggaccacggtcaccgtctcctcacgccctccaccgaaggggcccagtccggtccttcccccnggccgccctgcctccgaggacnccacctcgagagcacacgcggcccctgggcctgccgtggtacaaggctactcacgtgactcgactgacgcgggctgggacaaggcacatagnnnn

SEQ ID NO: 407932 - DNA, 529 bp, Homo sapiens
  misc_feature: GZ8MTXP02H9O75.38.5.A05.1.454.CMB.2.raw
  modified_base (217)..(217): a, c, t, g, unknown or other
  modified_base (251)..(251): a, c, t, g, unknown or other
  modified_base (282)..(282): a, c, t, g, unknown or other
  modified_base (324)..(324): a, c, t, g, unknown or other
  modified_base (378)..(378): a, c, t, g, unknown or other
  modified_base (445)..(445): a, c, t, g, unknown or other
  modified_base (451)..(451): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctcgtgtctgggtctctggacagtcgatcaccatctcctgcactggaaccngcagtgacgttgtgttataattgtctctgtacangcaccggcatcgaccccaaatcatgatttangagtcactcatcggcctcgaggggtttctaatcgccttttcncttcgcactaccaagttctcgggacaaccgaccggtccctccctagacccatcncgtcgggctcccgagctgacggtacgagtcttaaattatttctgctagttcaattactaacaaccanacaacnctctagtactagtacggacggacggacacgtcgtacgtaccgtactaacgacgacgaccgacgtcctccgccccgtcg

SEQ ID NO: 407933 - DNA, 534 bp, Homo sapiens
  misc_feature: GZ8MTXP02ICTLC.38.5.A05.1.454.CMB.2.raw
  modified_base (229)..(229): a, c, t, g, unknown or other
  modified_base (293)..(293): a, c, t, g, unknown or other
  modified_base (423)..(423): a, c, t, g, unknown or other
  modified_base (457)..(457): a, c, t, g, unknown or other
  modified_base (500)..(500): a, c, t, g, unknown or other
  modified_base (526)..(526): a, c, t, g, unknown or other
  modified_base (528)..(528): a, c, t, g, unknown or other
  modified_base (531)..(534): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattcccngtatctaacaaatgaaacagtctgagagctgaggacacggccttgtattactgtgacaaaagtnttttgagtttagagtagtaaggtctactactacggtatggacgtcgtggggcccaaaggggaccacggtcacggtcctcctcacgccctacccaaccgaaggggcccccagtccggtccctttcccccgnggcccgccctgccctccgaggacgcacctccganacgcacgagcgccctgggctgcctgtcaggactactccacgtnactcgactgagcggctggcaaggcananagnnnn

SEQ ID NO: 407934 - DNA, 531 bp, Homo sapiens
  misc_feature: GZ8MTXP02HYFMV.38.5.A05.1.454.CMB.2.raw
  modified_base (217)..(217): a, c, t, g, unknown or other
  modified_base (366)..(366): a, c, t, g, unknown or other
  modified_base (446)..(446): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcatcacatctcctgcactggaaccngcagtgacgttggtagttataaattgtctctgtaccacagcaccggcatcgaccccaaaatcatgtatttatgaggtcactcatcggcctcgtagggtttcaatcgtccttctctgctataccaagtctgactaacgaccgtccctccngaccctatctctcgggctccgagctgaggacgaggacttaattatttctagcttagttacattacaacaacagacaaacnctactgacttacgtcggacggaacggacaaacggctacgtacccgtacgtaagtcacgtacccgaagtcctccgtaccccctcgg

SEQ ID NO: 407935 - DNA, 600 bp, Homo sapiens
  misc_feature: GZ8MTXP02GD3DL.38.5.A05.1.454.CMB.2.raw
  modified_base (292)..(292): a, c, t, g, unknown or other
  modified_base (598)..(599): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaacagtctgagagctgaggacacggccttgtattactgtgacaaaagtnttttgagtttagagtagtaaggtctactactacggtatggacgtcgtggggccccaaggggccacggtcaccgtctcctcacgcctccaccgaagggccccatccggtccttccccgtcggccgccctgcctccaggacgccacctccgaagacgcacgacggccggtccccgtggggcctcggcccgttgggtaccgaaaacgggtaccttaaccgtttcccgaacggttcggaacgttccggaaccgttgggaacggccgggggacctggggacccgaaaggggtccgacctaacgtaggcgcnng

SEQ ID NO: 407936 - DNA, 501 bp, Homo sapiens
  misc_feature: GZ8MTXP02F4ETR.38.5.A05.1.454.CMB.2.raw
  modified_base (427)..(427): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaattgtctctggtacaacagcacccggcaatgccccaaaatcatgatttatgaggtcactcatcggcctcaggggtttctaatcgccttctctgcatccaagtctggcaacacgcctcctgaccatctctgggctccagctgaggacgaggctaattattctgcagttcatatacaaccagctaaacnctactgctattcggcggacgggaccaagctacgaccgtacctaagtcaacgcccaaggcctcgcccccttccgg

SEQ ID NO: 407937 - DNA, 491 bp, Homo sapiens
  misc_feature: GZ8MTXP02F2KBC.38.5.A05.1.454.CMB.2.raw
  modified_base (297)..(297): a, c, t, g, unknown or other
  modified_base (366)..(366): a, c, t, g, unknown or other
  modified_base (447)..(447): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccggcaatcgcccccaaaatcaatgatttangaggtcactcatcggccctcaggggtttctaatcgccttctctgcatccaagtctgcaacacgcctccngacccatctctggctccagctgaggacgaggactaattattctgcagttcatatacaaccagcaacactctgctattcggnggacggaccaagctagaccgtcaagtcagcccagctcgccctcg

SEQ ID NO: 407938 - DNA, 570 bp, Homo sapiens
  misc_feature: GZ8MTXP02FIWL1.38.5.A05.1.454.CMB.2.raw
  modified_base (289)..(289): a, c, t, g, unknown or other
  modified_base (425)..(425): a, c, t, g, unknown or other
  modified_base (565)..(565): a, c, t, g, unknown or other
  modified_base (569)..(569): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgagacacggccttgtattactgtgcaaaagtnttttgagtttagagtagtaagggtctactactacggtatggacgtcgtggggccccaagggaccacggtcaccgtctcctcagcctccaccgaagggcccatcggtccttccccgtggcgccctgcctccgaggcnccaccgtccgagacgcacgaggccgccctaggggcctcgcccgttgggtaccaacgggaccttaccgttccgacggttcgacgttccggacttcggacggccggggtctcggggacaaacgggtcgaccgtagtacggcncgcng

SEQ ID NO: 407939 - DNA, 528 bp, Homo sapiens
  misc_feature: GZ8MTXP02HY6UQ.38.5.A05.1.454.CMB.2.raw
  modified_base (254)..(254): a, c, t, g, unknown or other
  modified_base (409)..(409): a, c, t, g, unknown or other
  modified_base (414)..(414): a, c, t, g, unknown or other
  modified_base (417)..(417): a, c, t, g, unknown or other
  modified_base (426)..(426): a, c, t, g, unknown or other
  modified_base (494)..(494): a, c, t, g, unknown or other
  modified_base (523)..(523): a, c, t, g, unknown or other
  modified_base (525)..(525): a, c, t, g, unknown or other
  modified_base (527)..(528): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaaggccgattcagcatctccagagacaacgccaagaattccctgtatctaacaaatgaacagtctgagngctgaggacacggccttgtattactgtgacaaagtattttgagtttagagtagtaaggtctactacgtacgtatggacgtcgtggggacccaaggggaccacggtcaccgtctcctcacgcctccaccgaacggcccatccggtccttcccccgngcccnccngctcgcgcnccaccgcgagcacacgcgccgccgtggctcgccgtggacgacgtacctacgtcgacgtcactcgacgnggcggcggcgtcggacgaacggcacgagngncnn

SEQ ID NO: 407940 - DNA, 544 bp, Homo sapiens
  misc_feature: GZ8MTXP02FW77N.38.5.A05.1.454.CMB.2.raw
  modified_base (258)..(258): a, c, t, g, unknown or other
  modified_base (290)..(290): a, c, t, g, unknown or other
  modified_base (368)..(368): a, c, t, g, unknown or other
  modified_base (450)..(450): a, c, t, g, unknown or other
  modified_base (457)..(457): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataatttgtctctgtacaacngcaccggcaatcgccccaaaatcatgatttangaggtcactcatccggcctcgaggggtttctaatcgtccttctctgcatccaagtctggcaaacgaccggccctcccncgaccctatctccgtgggcctccgaggcctgaggacgaggacttaattatttctgctagttcatactaacaaccagacaacnctacgtncttacgttcgggacgggaacgggaaccaacgtccgtacgaccgtaccgtaaagtcaacgcccgaaggtcctccgcccccgttaccgg

SEQ ID NO: 407941 - DNA, 516 bp, Homo sapiens
  misc_feature: GZ8MTXP02F4D3B.38.5.A05.1.454.CMB.2.raw
  modified_base (247)..(247): a, c, t, g, unknown or other
  modified_base (400)..(400): a, c, t, g, unknown or other
  modified_base (421)..(421): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaattgtntctggtacaacagcaccggcaatcgaccccaaaatcatgatttatgagtcactcatcgcctcagggttctaatcgcttctctgctcaagtctggcaacacgacctccctgaccatctctgactcgagctgaggacgaggctagacttactacngactagttacatataacgaanctactactcctcttcgtgttacttcggcggtacgggacctagggtacgaccggtactaagtccgacgaccaacggctaccgcccccgtcggtccc

SEQ ID NO: 407942 - DNA, 507 bp, Homo sapiens
  misc_feature: GZ8MTXP02IYEY2.38.5.A05.1.454.CMB.2.raw
  modified_base (220)..(220): a, c, t, g, unknown or other
  modified_base (401)..(401): a, c, t, g, unknown or other
  modified_base (430)..(430): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataattgtctctgtacaacagcaccggcaatcgacccccaaaatcatgatttatgagtcactcatcggcctcgaggggtttctaatcgtcttctctgcatccaagtctggcaacgaccgcctcctgaccatctcgtggctcgagctgaggacgagtactaattnttctgctagtcataacacaacagacaacnctctgactacgttcggacggacgggaccaagtcgtacgaccgtactaacgtcaacgccaacggctccgccccttcgg

SEQ ID NO: 407943 - DNA, 526 bp, Homo sapiens
  misc_feature: GZ8MTXP02IQ164.38.5.A05.1.454.CMB.2.raw
  modified_base (253)..(253): a, c, t, g, unknown or other
  modified_base (348)..(348): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcacatctcctgcactggaaccagcagtgacgttggtgttataattgtctctgtacangcaccggcaatcgaccccaaaatcatgtatttatgagtcactcagtcgcctcgtaggggtttctaatcgtccttctctgctcaagtctggacacncggcctcctgaccatctctcggactccaggtctggacggacgaggctagacttactacgttgactagttactatactacaagctactactccttacttctgttacgtcggcggacggtacgaggtcgaccgtacgtaaacgtcgacgacccgacggcctccggtcccctacggtaccc

SEQ ID NO: 407944 - DNA, 580 bp, Homo sapiens
  misc_feature: GZ8MTXP02GIB9H.38.5.A05.1.454.CMB.2.raw
  modified_base (291)..(291): a, c, t, g, unknown or other
  modified_base (431)..(431): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataattgtctctggtacaacagcaccggcaatcgaccccaaaatcatgatttangagtcactcatcgcctctaggggtttctaatcgccttctctgcatccaagtctggactaaacgccggtcctcccgtgaccctatcctcgtcggggcctccgaggtctggagggacgacggacttaaagtttactttccgngtactagttacctaatactaaacccgaactacgacaacacttactcgtacttaacggttccgggacgggtaacggaacccaaacgtcgtacgacccgttacgtaaacgtccaacggaccccaaacggtcctcccggacccccttccggg

SEQ ID NO: 407945 - DNA, 512 bp, Homo sapiens
  misc_feature: GZ8MTXP02FV5M4.38.5.A05.1.454.CMB.2.raw
  modified_base (416)..(416): a, c, t, g, unknown or other
  modified_base (436)..(436): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctctggtaccaacagcacccggcaatcgacccccaaaatcatgatttatgagtcactcatcggcctcgaggggtttctaatcgccttctctgcatccaagtctggcaacaccgcctccctgaccctatctctcgggactccgagctgaggacgagactaattatttcngctagttcataatacaacanacaacactctgtctacgtcggacggaacggacacgcgtacgaccgtactaacgacacgaccacgcctccgccctcg

SEQ ID NO: 407946 - DNA, 518 bp, Homo sapiens
  misc_feature: GZ8MTXP02IK3S4.38.5.A05.1.454.CMB.2.raw
  modified_base (256)..(256): a, c, t, g, unknown or other
  modified_base (265)..(265): a, c, t, g, unknown or other
  modified_base (376)..(376): a, c, t, g, unknown or other
  modified_base (439)..(439): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgtactggaaccagcagtgacgttggtgttataatttgtctctgtacanagcaccggnaatcgcccccaaatcatgatttatgaggtcactcatccggccctcgaggggtttctaatcgctttcctctgcatcaagttctggcaacacggccctccctgaccatctcgnggctccgaggctagacggacgagtactaattactttctgtactagttacattactaacaacanacaacactctagctagttcggacggagacctaagctcgacctcgtaagtcacgaccgaggcctaccgcccctcggtacc

SEQ ID NO: 407947 - DNA, 554 bp, Homo sapiens
  misc_feature: GZ8MTXP02FNFK2.38.5.A05.1.454.CMB.2.raw
  modified_base (222)..(222): a, c, t, g, unknown or other
  modified_base (260)..(260): a, c, t, g, unknown or other
  modified_base (268)..(268): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataattgtctctgtaccaacngcaccggnaatcgacccccaaaatcatgatttatgagtcactcatcggccctcgtaggggtttactaatccgtcttctctgcactccagtctggacaacaccggcctcctcgaccatctcgcggctcgagctgaggacgagcttaaattattctgtctagttcaatactacaacagacaacacgtctgacttagttcgggacggacgggaaccaaacggtcctacggtaaccccgttaaccgtaaacggtaccgaaccgaccccgaaacggtcccgttaccggtacccccccgg

SEQ ID NO: 407948 - DNA, 599 bp, Homo sapiens
  misc_feature: GZ8MTXP02F8CHU.38.5.A05.1.454.CMB.2.raw
  modified_base (292)..(292): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaattgtctctgtacaacagcacccggcaatcgaccccaaaatcatgatttangaggtcactcatccgccctcgaggggtttctaatcgccttctctgctatccaagttcgtggaccaaacgaccggcccctacccgtcgaaccctactccttccgtcgggccttccgaggtctggaacggaacggaggtacttaagtttactttctgtctagttcaatactaaccaaccagacaaacctactactacgtcttaacgttcggggacggtaaacgggacccaaaggtccgtacggtcccggttaccctaaaggtcccgaacggaccccgaaaggtcccgtaccggtccccccgtttaccgg

SEQ ID NO: 407949 - DNA, 554 bp, Homo sapiens
  misc_feature: GZ8MTXP02FLX73.38.5.A05.1.454.CMB.2.raw
  modified_base (294)..(294): a, c, t, g, unknown or other
  modified_base (439)..(439): a, c, t, g, unknown or other
  modified_base (548)..(548): a, c, t, g, unknown or other
  modified_base (551)..(554): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaaacagtctgagagctgaggacacggccttgtattactgtgacaaaagtnttttgagtttagagtagtaagggtctactactacggtatggacgtcgtggggacccaagggaccacggtcaccgtctcctcacgcctccaccgaacgggccctatccggtccttcccccgtggcccgccctgcctccgagggacnccaccctccgagacgccaacgacggccggcccctggggcctcggcctggtacaaacggacctacgttccaacgtgactcgactggacgccgggctggacaaggcgacanagnnnn

SEQ ID NO: 407950 - DNA, 570 bp, Homo sapiens
  misc_feature: GZ8MTXP02FY2LA.38.5.A05.1.454.CMB.2.raw
  modified_base (279)..(279): a, c, t, g, unknown or other
  modified_base (290)..(290): a, c, t, g, unknown or other
  modified_base (565)..(565): a, c, t, g, unknown or other
  modified_base (568)..(569): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtgggtctcaggtattagttggaacagtggtaggataggctatgcggactctgtgaagggccgattcagcatctccagagacaacgccaagaacttccctgtatctaacaaatgaacagtctgagagctgagacacggccttgtattacngtgacaaagtntttgagtttagagtagtaaggtctactactacggtatggacgtcgtggggacccaagggccacggtcaccgtctcctcacgcctccaccgaacgggcccagtccggtcccttcccccgtggcccgccctgccctccgaggacgccaccgtccgagacgccacgacggcgcccgtgggcctcgccgtggtaccgaaacggtcctaccgttcccgacggttcgacgtccgacgtggacggcgggtaccgtgggaccgaagggcccgacgtacgaggngcnng

SEQ ID NO: 407951 - DNA, 501 bp, Homo sapiens
  misc_feature: GZ8MTXP02FLV2M.38.5.A05.1.454.CMB.2.raw
  modified_base (219)..(219): a, c, t, g, unknown or other
  modified_base (408)..(408): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctcctggtaccaacagcacccggcaatgcccccaaaatcatgatttatgaggtcactcatcggccctcaggggtttctaaatcgccttctctgcatccaagtctggcaacacgcctcctgaccatctctgggctccagctgaggacgaggctaattatttcngcagttcatatacaacagcaacactctgctattcggcggacggaccaagctacgaccgtacctaagtcacgcccaaggcctcgcccccttcgg

SEQ ID NO: 407952 - DNA, 546 bp, Homo sapiens
  misc_feature: GZ8MTXP02FT2OE.38.5.A05.1.454.CMB.2.raw
  modified_base (271)..(271): a, c, t, g, unknown or other
  modified_base (358)..(358): a, c, t, g, unknown or other
  modified_base (396)..(396): a, c, t, g, unknown or other
  modified_base (417)..(417): a, c, t, g, unknown or other
  modified_base (435)..(435): a, c, t, g, unknown or other
  modified_base (442)..(442): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttaataaatttgtctctgtaccaacagcacccggnaatgacccccaaaatcatgatttatgaggtcactcatccggccctcgtaggggtttctaaatcgtccttctctgctatccaagttcnggcaacaccgcctcctgaccatctctgggctccagtcngaggacgagactaattattcngcattcatatacaacganacaaacnctactgctaacgttcgggacggacgggaaccaaaggtcctacgacccgttaaccgtaaagtaccgaacgacccgaaacgggtccttaccgcccccgtttaacgg

SEQ ID NO: 407953 - DNA, 563 bp, Homo sapiens
  misc_feature: GZ8MTXP02JW64G.38.5.A05.1.454.CMB.2.raw
  modified_base (291)..(291): a, c, t, g, unknown or other
  modified_base (558)..(558): a, c, t, g, unknown or other
  modified_base (560)..(563): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtaaggtctactactacggtatggacgtcgtggggccccaagggaccacggtcaccgtctcctcacgccctccaccgaacgggccccatcccggtccttcccccgtggcccgccctgccctcccgaggacgccaaccctccgagacgccacgacggccggcccgtggggcctcgcccgtggtaccaaagggtccttacttcccgaacggttgacgtcgacgtggacggcgggctggacaagggcgactagngnnnn

SEQ ID NO: 407954 - DNA, 557 bp, Homo sapiens
  misc_feature: GZ8MTXP02HTBJI.38.5.A05.1.454.CMB.2.raw
  modified_base (293)..(293): a, c, t, g, unknown or other
  modified_base (554)..(557): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaacagtctgagagctgaggacacggccttgtattactgtgactaaaagtnttttgagtttagagtagtaaggtctatacgtacgtatggactcgtggggacccaaggggaccacggtcaccgtctcctcacgccctccaccgaacggggcccccattcccggtccttcccccgtggcccgccctgccctccacggacgccacccgtccgagacgcacacggtccgcccgtggggcctcgccgtcgggtacaaacggccttaacgtccaacgtgactcgactggacgcgggctaggcgaacggcgacatagnnnn

SEQ ID NO: 407955 - DNA, 617 bp, Homo sapiens
  misc_feature: GZ8MTXP02HHKNB.38.5.A05.1.454.CMB.2.raw
  modified_base (220)..(220): a, c, t, g, unknown or other
  modified_base (260)..(260): a, c, t, g, unknown or other
  modified_base (465)..(465): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaattgtctctggtaccaacngcacccggcaatcgacccccaaaatcatgtatttatgaggtcactcactccggccctcgtaggggtttctaagtcgccttctctgctactccaagtcgtaggactaaaccgaccggtccctccctgaccctatcctcgtcgggcctccgaggtctggaggacgaggtactaattatttctgactagttacatactaacaaccganacctaaacacctctagtaccgtttaaacgttcgggggacggaacggggtaaccgaaacggtccgttaaccggaaccccggttaccgtaaacggttcccaacgggacccccgttaaaagggccccttacccgggtacccccccgtttaccggg

SEQ ID NO: 407956 - DNA, 562 bp, Homo sapiens
  misc_feature: GZ8MTXP02GD62C.38.5.A05.1.454.CMB.2.raw
  modified_base (249)..(249): a, c, t, g, unknown or other
  modified_base (295)..(295): a, c, t, g, unknown or other
  modified_base (419)..(419): a, c, t, g, unknown or other
  modified_base (440)..(440): a, c, t, g, unknown or other
  modified_base (464)..(464): a, c, t, g, unknown or other
  modified_base (544)..(544): a, c, t, g, unknown or other
  modified_base (556)..(556): a, c, t, g, unknown or other
  modified_base (558)..(562): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaacttccctgtatctaacaaatgaacngtctgagagctgaggacacggtccttgtattactgtgacaaaagtntttgagtttagagtagtaaggtctactactacggtatggacgtcgtggggcccaagggaccacggtcaccgtctcctcacgccctacaccgaacgggcccagtccggtccttcccccgtggccncccctgccctaccgagggacncccacctacccgagaacgcaacgnggtcccgcccgtggggctcggcctcgggtacaaacgggtccttaacctccgaacgtgactcggaactggacgcggggccngggacaaggcanannnnn

SEQ ID NO: 407957 - DNA, 570 bp, Homo sapiens
  misc_feature: GZ8MTXP02HWU6D.38.5.A05.1.454.CMB.2.raw
  modified_base (291)..(291): a, c, t, g, unknown or other
  modified_base (410)..(410): a, c, t, g, unknown or other
  modified_base (437)..(437): a, c, t, g, unknown or other
  modified_base (567)..(567): a, c, t, g, unknown or other
  modified_base (569)..(570): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtaagggtctactactacggtatggacgtgtggggcccaagggaccacggtcaccgtctcctcagccctccaccgaaggggcccattccggtccttcccccgnggcccgcccctgccctccgagggaccnccaccgtcgagacgccacgcggccggcccgtgggcctcgccgtcggtacgaacggtacctaccgttaccgacgttacgacgtacgacgtcggacggccggggacgtcggacgaacggccgacgagtagcncnn

SEQ ID NO: 407958 - DNA, 699 bp, Homo sapiens
  misc_feature: GZ8MTXP02JAYHW.38.5.A05.1.454.CMB.2.raw
  modified_base (220)..(220): a, c, t, g, unknown or other
  modified_base (257)..(257): a, c, t, g, unknown or other
  modified_base (265)..(265): a, c, t, g, unknown or other
  modified_base (290)..(290): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataatttgtctctgtacaangcaccggnaatcgaccccaaatcatgtatttangagtcactcactcgcctcgtagggtttctaagtcgtccttctcgtcgactactaccgtaagttcgtacgggaccaaaccgaccggtccccttacccgtacgaaccctacttccgtccgtcggggcccttcccggacggtcgtcgggaaacgggtaccggtaacgggtacctttaaagttttacttttccgtaggtaccttacgtttaccaattaaactaaaccgaaacctaacgaaccaaacctaacttctacgtactttaacggttacccggggacgggtaaaccggggtaaaccaaacgggtcccgttaaaccgggtaaccccgtttaacccgtaaaacggttccccgtaaccggaacccccggaaaacgggtccccgttcccccgggtaaccccccgtttaccggg

SEQ ID NO: 407959 - DNA, 546 bp, Homo sapiens
  misc_feature: GZ8MTXP02JS5T5.38.5.A05.1.454.CMB.2.raw
  modified_base (300)..(300): a, c, t, g, unknown or other
  modified_base (480)..(480): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagccacccggcaactcgacccccaaaatcatgatttangaggtcactcactccggtccctcgtacggggtttactaagtcgtccttctctgcatccaagtctggacaacaccggcctccctgacccatctcgtcgggctccgaggctaggacggacggaggtctaaatttattctgctagttcatatacaaccagacaactactctgcttacgtcggnggacggaccaacgtcgtacgaccgtacgttaacgcaacgccgaacggcctaccggccccttaccgg

SEQ ID NO: 407960 - DNA, 599 bp, Homo sapiens
  misc_feature: GZ8MTXP02GA6G7.38.5.A05.1.454.CMB.2.raw
  modified_base (259)..(259): a, c, t, g, unknown or other
  modified_base (302)..(302): a, c, t, g, unknown or other
  modified_base (369)..(369): a, c, t, g, unknown or other
  modified_base (431)..(431): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatcctcctgcactggaaccagcagtgacgttggtagttataattgtctctgtaccaacngcaccggcaatcgaccccaaaatcatgtattatgagtcactcntccggcctgtagggttctaatcgtcttctctgctactaccaagtctggacaaaccgccgtccctccncgaccctattcctacgtcggctccgacggtcgtaggacggaccggtaggtacttaaactttntttcctagtactagttacaattaactaacctaacgacactaaacctactcgtacgtacgttacgttaccgggacgggaaacggtaacccgaaacggtccgtacggtaaccccgttaaccgtaacgtaccgaaccggacccgaacggtcctacccggtccccgttccgg

SEQ ID NO: 407961 - DNA, 510 bp, Homo sapiens
  misc_feature: GZ8MTXP02IWPFO.38.5.A05.1.454.CMB.2.raw
  modified_base (331)..(331): a, c, t, g, unknown or other
  modified_base (430)..(430): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctctggtaccaacagcaccggcaatgcccccaaaatcatgatttatgaggtcactcatcgcctcaggggtttctaatcgcttcnctgcatccaatctggcaacacgccctcctgacccatctctcgggctccagctgaggacgaggctaattatttctgcagttcatactacaacagcaaacnctctgtctaagttcggacggacgggaccaaacgctacgaccgtactaagtccacgcccgaaggcctccgccccgttaccg

SEQ ID NO: 407962 - DNA, 517 bp, Homo sapiens
  misc_feature: GZ8MTXP02JGHGS.38.5.A05.1.454.CMB.2.raw
  modified_base (293)..(293): a, c, t, g, unknown or other
  modified_base (407)..(407): a, c, t, g, unknown or other
  modified_base (438)..(438): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctctggtaccaacagcacccggcaatcgccccaaaatcatgatttangaggtcactcatcggcctcgaggggtttctaatcgccttctctgcatccaagtctggcaacaccggcctccctgaccatctcgtggctcagctgagacgaggctaagttattcngctagttcatatacaacagacaacactctancttaagttcgggacggaacggggaccaaagtcgtacgacccgtactaagcacgaccccgaagccctcgcccccttccgg

SEQ ID NO: 407963 - DNA, 515 bp, Homo sapiens
  misc_feature: GZ8MTXP02HMLKX.38.5.A05.1.454.CMB.2.raw
  modified_base (294)..(294): a, c, t, g, unknown or other
  modified_base (430)..(430): a, c, t, g, unknown or other
  modified_base (438)..(438): a, c, t, g, unknown or other
  modified_base (443)..(443): a, c, t, g, unknown or other
  modified_base (447)..(447): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaattgtctctggtaccaacagcaccggcaatcgaccccaaaatcatgtatttangaggtcactcatcggcctcgaggggtttctaaatcgccttctctgctatccaagtctggacaaaccacggtccctccctgaccattctcgtgggctccgagctgaggacgagactaattattctgctagttcatanacaaccanacacnctgnactacgtcggacggacggacacgctacgtaccgtactaacgtcgacgaccgacgcctaccgcccgtcg

SEQ ID NO: 407964 - DNA, 565 bp, Homo sapiens
  misc_feature: GZ8MTXP02JEL0M.38.5.A05.1.454.CMB.2.raw
  modified_base (240)..(240): a, c, t, g, unknown or other
  modified_base (249)..(249): a, c, t, g, unknown or other
  modified_base (533)..(533): a, c, t, g, unknown or other
  modified_base (559)..(560): a, c, t, g, unknown or other
  modified_base (562)..(562): a, c, t, g, unknown or other
  modified_base (564)..(565): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggatctgtgaagggccgattcagcatctccagagacaacgccaaagaattccctgtaatcctaanaaatgaacngtctgagagctgaggacacggtccttagtacttactgtagaacaaagtaagtttagtagttaagtagtagtaaggtacgtactacgtacgtagtagtacgtcgtcggacccgaacggaccgacgtaccgaccgtcctcctcacgacctaccaccgaacggaccgacgtccgttcccgttccccgtccggccgcccgtcgcgtccgacgacgacacctaccgacgacgacacgacgccgccgtcggcgtcgccgtcgacgacgactactcacgtacgagtcgcgngacgcgcgcgacgaacgacgacgacnncncnn

SEQ ID NO: 407965 - DNA, 505 bp, Homo sapiens
  misc_feature: GZ8MTXP02JDLEI.38.5.A05.1.454.CMB.2.raw
  modified_base (269)..(269): a, c, t, g, unknown or other
  modified_base (297)..(297): a, c, t, g, unknown or other
  modified_base (337)..(337): a, c, t, g, unknown or other
  modified_base (410)..(410): a, c, t, g, unknown or other
  modified_base (429)..(429): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctctggtaccaacagcacccggnaactcgacccccaaaatcatgtatttangagtcactcatcgcctcgagggtttctaatcgcttctctncatccaagtctggcaacgaccgcctccctgaccatctctcgggctcaggctggaggacgaggctaattattcngctagttcatatacaacanacaacactcagcctagttcggcggaacgggaccaacgctacgaccgtactaacgcacgccaaggcctcgcccctcg

SEQ ID NO: 407966 - DNA, 568 bp, Homo sapiens
  misc_feature: GZ8MTXP02HB9JE.38.5.A05.1.454.CMB.2.raw
  modified_base (290)..(290): a, c, t, g, unknown or other
  modified_base (565)..(568): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctacaaatgaacagtctgagagctgaggacacggccttgtattactgtgcaaaagnttttgagtttagagtagtaaggtctactactacggtatggacgtcgtggggaccccaaggggaccacggtcaccgtctcctcacgcctaccaccgaacggggccccaagtccgggtcccttccccccgtggcccgtccctgcctccaggacgccacctccgagacgcacgagccgccccgtggggcctcggcccgttgggtacaaacgggtaccttaccgttacccgacgtcgacttcggaactggaacgcggggctgggaccaaggcgacatgnnnn

SEQ ID NO: 407967 - DNA, 738 bp, Homo sapiens
  misc_feature: GZ8MTXP02II7P5.38.5.A05.1.454.CMB.2.raw
  modified_base (219)..(219): a, c, t, g, unknown or other
  modified_base (255)..(255): a, c, t, g, unknown or other
  modified_base (263)..(263): a, c, t, g, unknown or other
  modified_base (287)..(287): a, c, t, g, unknown or other
  modified_base (334)..(334): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccngcagtgtacgttggtagttataattgtctctgacangcaccggnatcgaccccaaatcatgtatttangagtcactcacgtccgcctgtacgggtttctaactcgtaccttctcncgtctataccaagtcgtacggaccaaccgaccggtccctcccgacgtaccctacttcccgtcgtcgggtaccttacccggaagggtcgtacggggaaacgggtaaccggtaacgggttaacctttaaacgtttttacgtttaccgtacggttacctttaaacggtttacctaaacggttaaaccttaaaaccgaaaaccccgttaaacggtaacccaaaccgttaaaccttcgtaaccgttaaccgtttaacgggtttaccgggggaaaccggggtaaacgggaaacccgtaaacggtacccgttaaaccgggtaaccccgtttaaccgttaaaacggtacccgaaaccgggttaccccgaaacgggtttcccccgtaccccggttaacccccggttaccccgg

SEQ ID NO: 407968 - DNA, 543 bp, Homo sapiens
  misc_feature: GZ8MTXP02H15HI.38.5.A05.1.454.CMB.2.raw
  modified_base (294)..(294): a, c, t, g, unknown or other
  modified_base (327)..(327): a, c, t, g, unknown or other
  modified_base (407)..(407): a, c, t, g, unknown or other
tcagtcgatcacgtcacgaccggtgctcgatttagatagatagacaggggtggggtcacagggggcagcgctctcaggacatctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctgtacaacatcaccagacaagcccccaaatcataatttangactcagtatcgcctcagggttctgatcgctcncagctcagtctggcaacacgcctccctgaccatctctgggctccgaggttgaggacgaggctgacttatattgcgtcttnacatggaatcgaggtagggtttcggacggtagggaccgtaaaacggtgaccggttacctaggtccgaacggacccgaaaggtcccgtcgcccccgtcgggtaccaccgttccgtccgtttccccacccctttcccg

SEQ ID NO: 407969 - DNA, 532 bp, Homo sapiens
  misc_feature: GZ8MTXP02GYAFW.38.5.A05.1.454.CMB.2.raw
  modified_base (269)..(269): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaattgtctctggtaccaacagcacccggnaatcgcccccaaaatcatgatttatgaggtcactcactcggccctcgaggggtttctaatcgccttctctgcactccaagtctaggcaaccacggtccctccctcgacccatctcctgggcctccgaggctaggacggacgaggtactaaatttatttctgctagttcatataaccaaacagacaacactctgctacgtcggacggagggaccaagccgtacgaccgtactaagtcacgccgaagcctaccgccccgttccgg

SEQ ID NO: 407970 - DNA, 542 bp, Homo sapiens
  misc_feature: GZ8MTXP02F3PL6.38.5.A05.1.454.CMB.2.raw
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctctgtacaacagcaccggcaatcgaccccaaatcatgatttatgaggtcactcatcggccctcgaggggtttctaatccgtcttctctcgcatccagtctggactaacacggtccctcctcgacctatctagtcgggctcgagctgaggacgaggcttaaagttattcgtgctagttcataactacaacacgactaacactcacgtctacgttcgggacggacgggaaccgaacgtcgtacgtacccgtaacgtaaactacgacggacccgaacggtccgtcgtcccccgg

SEQ ID NO: 407971 - DNA, 524 bp, Homo sapiens
  misc_feature: GZ8MTXP02IQNHC.38.5.A05.1.454.CMB.2.raw
  modified_base (410)..(410): a, c, t, g, unknown or other
  modified_base (436)..(436): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctctggtaccaacagcacccggcaatgacccccaaaatcatgatttatgagtcactcatcggccctcgaggggtttctaatcgcttctctgcatccaagtctggcaacacgcctcctgaccatctcgtgggctcccagctgaggacgaggactaattatttcngctagttcatactacaacagcaaacnctactgacttagttcggacggacgggaaccaacgctacggacccgttacctaagtccgaacgcccaaaggtcctccgcccccttccgg

SEQ ID NO: 407972 - DNA, 546 bp, Homo sapiens
  misc_feature: GZ8MTXP02GBGDA.38.5.A05.1.454.CMB.2.raw
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaatttgtctctggtaccaacagcacccgggcaatgcccccaaaatccatgatttatgaggtcactcatcggccctcgaggggtttctaatcgccttctctgctatccaagtctggacaacacggcctccctgaccatcctcgtcgggctcccaggctacgagggacgaggtaccttaaagttactttctagctagttcattataccaaaccagtacaaacactctagcctaagttcggcggtaacggaccaagtcgacgaccgtccgtaaagtccacgtacccgaaggcctaccgccccgttccgg

SEQ ID NO: 407973 - DNA, 582 bp, Homo sapiens
  misc_feature: GZ8MTXP02G9U61.38.5.A05.1.454.CMB.2.raw
  modified_base (292)..(292): a, c, t, g, unknown or other
  modified_base (452)..(452): a, c, t, g, unknown or other
  modified_base (579)..(582): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaacagtctgagagctgaggacacggcttgtattactgtgacaaaagtnttttgagtttagagtagtaaggtctactactacggtatggacgtcgtggggccccaagggaccacggtccaccgtctcctcacgccctcccgaccgaacggggcccccagtcccgggttcccttccccccgtgggcccgcccctgccctccgagggaccncccacccgtccgagacgccaacgacggccggcccgtggggcctcggcctgggtaccaacggtacctacgttccacggttgaactcggactggacggtccgggactcgggacaacgggcgcaagtcgnnnn

SEQ ID NO: 407974 - DNA, 519 bp, Homo sapiens
  misc_feature: GZ8MTXP02GPGUX.38.5.A05.1.454.CMB.2.raw
  modified_base (219)..(219): a, c, t, g, unknown or other
  modified_base (413)..(413): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagcgcacagggtcctgggcccagtctgccctggctcagcctgcctccgtgtctgggtctcctggacagtcgatcaccatctcctgcactggaaccngcagtgacgttggtagttataaattgtctctggtaccaacagcaccggcaatcgacccccaaaatcatgattatgaggtcactcatcggtccttcgtaggggtttctaatccgcttctctccatccaagtctggcaacacgcctcctcgaccatctctgggcctccaggctgaggacgaggactaattatttcngtctagtcataactacaaccagacaaacactctgacttaacgtcggacggagggaccaagctacgaccgtacctaaagcaacgacccaacgctaccgcccctccgg

SEQ ID NO: 407975 - DNA, 643 bp, Homo sapiens
  misc_feature: GZ8MTXP02I07BP.38.5.A05.1.454.CMB.2.raw
  modified_base (259)..(259): a, c, t, g, unknown or other
  modified_base (267)..(267): a, c, t, g, unknown or other
  modified_base (293)..(293): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtagttataattgtctctgtaccaacngcaccggnaactcgaccccaaatcatgtatttangagtcactcactccggcctcgtacgggtttctaatcgtccttctctgactactaccaagtctgggacaaccgaccggccctccgacgacctactccgtcgtcgggcctacccgaggtctacgggaacggacggtacggtacctttaaagttttacgtttcgtacggacttaagttctaattaactaaccaaaccgaagaccctaaaactccttactacgtaccgtttacggttccgggaaaccggggtaacgggaaaccctaacggtcccgttaacggtaacccgttaacctaacggtaccgaaaccgtaccccggaacgtccccgttacccggtaccccccgtttcggg

SEQ ID NO: 407976 - DNA, 571 bp, Homo sapiens
  misc_feature: GZ8MTXP02I1X8D.38.5.A05.1.454.CMB.2.raw
  modified_base (291)..(291): a, c, t, g, unknown or other
  modified_base (456)..(456): a, c, t, g, unknown or other
  modified_base (565)..(565): a, c, t, g, unknown or other
  modified_base (568)..(571): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtaagggtctactacgtacggtatggacgtgtggggccccaagggaccacggtcaccgtcctcctcgacgccctccacccgaacggggccccagttcccggtcccttcccccgtcggcccgccctgcctccgacggagccacctccganagccacgacggcggcccctggggccctcgcccgtgggtacaaacgggaccttaaccgtccacgttacgacgttccggactggacggcgggcctgggccgaaggcgacanagnnnn

SEQ ID NO: 407977 - DNA, 594 bp, Homo sapiens
  misc_feature: GZ8MTXP02JNGDQ.38.5.A05.1.454.CMB.2.raw
  modified_base (259)..(259): a, c, t, g, unknown or other
  modified_base (294)..(294): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataattgtctctggtacaangcaccggcaatcgacccccaaaatcatgtatttangagtcactcatccggccctcgtaggggtttctaatcccgtcttctctgcatacctagtctggacctaaccgacggccctccctacgaccctatcctcgtcgggcctccgaggccgtaggaacggacgtaggtacttaaagtttctttcgtggtacctagtttaccaattaactaacaaaccctagaacaaacctacctctacgtacgttacggttcgggaccgggaacgggaaccaacggtccgtacggtacccgtaacgtaaagtccgaacgacccgaacggtcctacccggtcccccg

SEQ ID NO: 407978 - DNA, 551 bp, Homo sapiens
  misc_feature: GZ8MTXP02JG62T.38.5.A05.1.454.CMB.2.raw
  modified_base (291)..(291): a, c, t, g, unknown or other
  modified_base (410)..(410): a, c, t, g, unknown or other
  modified_base (416)..(416): a, c, t, g, unknown or other
  modified_base (432)..(432): a, c, t, g, unknown or other
  modified_base (541)..(541): a, c, t, g, unknown or other
  modified_base (548)..(551): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagttagagtagtaagggtctactactacggtatggacgtcgtggggccccaagggaccacggtcaccgtctcctcagccctccaccaacgggcccagtccggtcccttcccccnggcccnccctgctcccaggacnccaccctccgagacgcacacggccggccctggggcctcgccgtgggtcaaagggccttaccttccgaccgttgacgtcgacgtggacggcgggccgtggacaacgggcncagtagnnnn

SEQ ID NO: 407979 - DNA, 521 bp, Homo sapiens
  misc_feature: GZ8MTXP02JIABE.38.5.A05.1.454.CMB.2.raw
  modified_base (354)..(354): a, c, t, g, unknown or other
  modified_base (415)..(415): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaattgtctctgtacaacagcaccggcaatcgaccccaaaatcatgatttatgagtcactcatcggccctgaggggtttctaatccgcttctctgcatccagtctcggcaacncggacctccctgacccatctcgtcgggctccgagctgacggacgaggcttaaattatttcngtctagtttcattaataccaaacagacaaactactctgactagttcggcggacgggaccaagcctcggaccgtcgtaaacgtcacgcccgaaggcctcgtcccccg

SEQ ID NO: 407980 - DNA, 694 bp, Homo sapiens
  misc_feature: GZ8MTXP02H1CKI.38.5.A05.1.454.CMB.2.raw
  modified_base (219)..(219): a, c, t, g, unknown or other
  modified_base (264)..(264): a, c, t, g, unknown or other
  modified_base (287)..(287): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatcctctgcactggaaccngcagtgacgttggtgttataattgtctctgtacacagcacccggnatcgaccccaaatcatgtattangagtcactcatcggccctgagggtttacaagtcgtccttctctgactataccaagtcgtcggacaacccgaccggtccccttcccgtacgtaaccctacttccgtccggttcggggccctcccggagggtaccgtagggacgggtaaccggagggtacctttaaatttaacgttttaccgtggtacgtttaacggtttaccaaatttaactaaaaccccaaaaccgtaacgaaccctaaaaccgtaccgttaccttacgtacccgtttaaaaccggttccgggggaaaccggggtaaacgggtaaaccccgaaaagtcccgttaccggtaaaccccgttaccgtaaaacgttccgaaccggtaccccggtaaacggcccgtttccccggtaccccccgtttaccggg

SEQ ID NO: 407981 - DNA, 606 bp, Homo sapiens
  misc_feature: GZ8MTXP02JEOHZ.38.5.A05.1.454.CMB.2.raw
  modified_base (219)..(219): a, c, t, g, unknown or other
tcagtcgatcacgtcacgaccggtgctcgatttagatagatagacaggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctctggtaccaacagcacccggcaatcgacccccaaaatcatgatttactagtaggtacgtactactactacggtcccgtcctacggggtttacggtttaactacgtcccgttcttctcgtcactacctaacgtacgttcgacgaaccaaccgccgtccctcgaccactctccgtcggcgtcctacgcgtcgaggacggacgacgtattattacttgacgtagtactatataactaaccaacgacaacaactcgtacgtactacgttacgggtacgggacgggaaaccggaacgtacgtaccggaccgttaacccgtaacgttacgaccgaccgaccgtacgtcccgtacccgtccccgg

SEQ ID NO: 407982 - DNA, 587 bp, Homo sapiens
  misc_feature: GZ8MTXP02FPG33.38.5.A05.1.454.CMB.2.raw
  modified_base (292)..(292): a, c, t, g, unknown or other
  modified_base (436)..(436): a, c, t, g, unknown or other
  modified_base (584)..(587): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctacaaatgaacagtctgagagctgaggacacggccttgtattactgtgacaaaagtnttttgagtttagagtagtaagggtctactactaggtatgacgtctggggacccaagggaccacggtcaccgtctcctcacgcctccaaccgaagggcccagtccggtccttcccccgtggccgccccgtgcctcccgagggacnccgtaccctcccgaagacgccacgacggccggccccgtgggggcccttcggaccgttggtaccgaaacgggtacttaaccgttccgaaccggttgaacttccggaacttgggacggccggggctgggaccgaaaggccgacagtacgnnnn

SEQ ID NO: 407983 - DNA, 555 bp, Homo sapiens
  misc_feature: GZ8MTXP02F815D.38.5.A05.1.454.CMB.2.raw
  modified_base (289)..(289): a, c, t, g, unknown or other
  modified_base (552)..(555): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgcaaaagnttttgagtttagagtagtaagggtctactactacggtatggacgtcgtggggccccaaggggaccacggtcaccgtctcctcagcctccaccgaagggcccatcggtccttccccctggccgccctgcctccaggacgccacctccgagacgccacgacgccggcccctgggggcctcggcccgtcgggtaccgaaagggtacctaccgttcccgacgtacgactcggacctggacggccggggctggacaaggcgcagtagnnnn

SEQ ID NO: 407984 - DNA, 527 bp, Homo sapiens
  misc_feature: GZ8MTXP02IYHQ0.38.5.A05.1.454.CMB.2.raw
  modified_base (295)..(295): a, c, t, g, unknown or other
  modified_base (445)..(445): a, c, t, g, unknown or other
  modified_base (455)..(455): a, c, t, g, unknown or other
tcagtcgatcacgtcacgaccggtgctcgatttagatagatagacagggggtctcaggaggcagcgctctcaggacatctccaccatggcctgggctctgctgctcctcaccctcctcactcagggcacaggggtcctgggcccagtctgccctggctcagcctgcctccgtgtctgggtctcctggacagtcgatcaccatctcctgcactggaaccagcagtgacgttggtggttataaattgtctctggtaccaacagcacccggcaatcgaccccaaaatcatgtatttangaggtcactcatcggccctcgaggggtttctaaatcgccttctctgctatccaagtctcggacaaaccaccggccctccctgacccatctcgtcgggctcgagctgaaggtacgaggctaatttatttctagctagttcataatacacanacaacactcngcttacgttcgggcggtaacggaaccaagctacgaccgtacctaagtcacgcccaaggcctcgccccttcgg

SEQ ID NO: 407985 - DNA, 547 bp, Homo sapiens
  misc_feature: GZ8MTXP02I792L.38.5.A05.1.454.CMB.2.raw
  modified_base (291)..(291): a, c, t, g, unknown or other
  modified_base (411)..(411): a, c, t, g, unknown or other
  modified_base (429)..(429): a, c, t, g, unknown or other
  modified_base (544)..(547): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagtnttttgagtttagagtagtaaggtctactactacggtatggacgtgtggggcccaagggccacggtcaccgtctcctcagccctcaccaacgggcccatccggtccttcccccgtggcccncccctgccctccgacggngcccaccctccgagacggccaacgacggccggcccctgggggcctcggcccgtgggtccaaaagggccttactcccgaacgtgatcgactgacgcggctggccaaggcgcaatgnnnn

SEQ ID NO: 407986 - DNA, 568 bp, Homo sapiens
  misc_feature: GZ8MTXP02FMHVJ.38.5.A05.1.454.CMB.2.raw
  modified_base (292)..(292): a, c, t, g, unknown or other
  modified_base (565)..(568): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaacagtctgagagctggagacacggccttgtattactgtgacaaaagtnttttgagtttagagtagtaaggtctactactacggtatggacgtcgtggggacccaagggccaggtcaccgtctcctcacgccctccacccgaacgggcccacgtccggtcccttcccccgtggcccgccctgccctccgacggacgcccacccgtaccgacgacgccaacgcggccggcccgtcgggctcgcctgggtcaaacgggactacctccgacgttcgactcgaactcggaacggtccgggcgtcggaccgaaggccgagacgtagnnnn

SEQ ID NO: 407987 - DNA, 500 bp, Homo sapiens
  misc_feature: GZ8MTXP02IKUJK.38.5.A05.1.454.CMB.2.raw
  modified_base (201)..(201): a, c, t, g, unknown or other
  modified_base (289)..(289): a, c, t, g, unknown or other
  modified_base (424)..(424): a, c, t, g, unknown or other
  modified_base (429)..(429): a, c, t, g, unknown or other
  modified_base (433)..(434): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccntctcctgcactggaaccagcagtgacgttggtgttataaattgtctctgtacaacagcaccggcaatgcccccaaaatcatgatttangaggtcactcatcggccctcaggggtttctaatcgccttctctgctatccaagtctggcaaacaccggcctcctgaccatctctgggctcgagctgagacgagactaattatttctgctagttcatatacaacanacaanactnncttacttcggcggacggaccaaagctacgaccgtactaagtcacgcccaagctccgccccgttcgg

SEQ ID NO: 407988 - DNA, 582 bp, Homo sapiens
  misc_feature: GZ8MTXP02HBR50.38.5.A05.1.454.CMB.2.raw
  modified_base (222)..(222): a, c, t, g, unknown or other
  modified_base (257)..(257): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataattgtctctgtacangcaccggcatcgaccccaaatcatgatttatgaggtcactcatccgtcctcgtagggttctaatccgtcttctctcgctactccagtcgtcggaccaaaccgaccggtccctaccctacgaccctacttcctcgtcggggccctccgaggtccgtaggacggacgagtacttaaatttactttcgtgtactagttacaattaacaaccaacgtacactaactactacgtcgtacgtacggttaccgggacggaacgggaaccacggtccgtaccggtaccgtaaccgtaacgccacgacccgtaggtcccgtacccgtcccccgg

SEQ ID NO: 407989 - DNA, 525 bp, Homo sapiens
  misc_feature: GZ8MTXP02JIGZV.38.5.A05.1.454.CMB.2.raw
  modified_base (295)..(295): a, c, t, g, unknown or other
  modified_base (448)..(448): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaattgtctctggtaccaacagcacccgggcaatcgcccccaaaatcatgatttangagtcactcatcggcctcaggggtttctaatcgccttctctgcatccaagtctggcaacgaccgcctcctgacccatcctctcgggctccgagtctgaggacgaggactaatttattctgctagttcattataacaaccagacaacactctanactagttcggacggtaacggaccaacgctacgaaccgtcctaagtccacgacccaaggtccctacgcccccgttcgg

SEQ ID NO: 407990 - DNA, 555 bp, Homo sapiens
  misc_feature: GZ8MTXP02H4MM6.38.5.A05.1.454.CMB.2.raw
  modified_base (268)..(268): a, c, t, g, unknown or other
  modified_base (282)..(282): a, c, t, g, unknown or other
  modified_base (291)..(291): a, c, t, g, unknown or other
tcagtcgatcacgtcacgaccggtgctcgatttagatagatagacaggggtggggtctcaggaggcagtgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccagcagtgacgttggtagttataattgtctctggtacaacagcaccggnaatcgaccccaaancatgattangagtcactcatcgcctgtagggttctaatccgtcttctctgcattaccagtctgacaaccaccggccctcctcgaccctactctcgcgggcctccgaggctaggaggacgagtactaatttactttcgtgtctacgttcaataataaccaaacagaccaaacctactccgtagtctaacgttcgggacggtaacgggaccaaacgtcgtacggtaacccgtaacgtaacgacgaccgacccgtaacggccctaccggtcccccg

SEQ ID NO: 407991 - DNA, 656 bp, Homo sapiens
  misc_feature: GZ8MTXP02IRNHY.38.5.A05.1.454.CMB.2.raw
  modified_base (223)..(223): a, c, t, g, unknown or other
  modified_base (279)..(279): a, c, t, g, unknown or other
  modified_base (289)..(289): a, c, t, g, unknown or other
  modified_base (433)..(433): a, c, t, g, unknown or other
  modified_base (635)..(635): a, c, t, g, unknown or other
  modified_base (650)..(650): a, c, t, g, unknown or other
  modified_base (655)..(655): a, c, t, g, unknown or other
tcagtcgatcacgtcacgaccggtgctcgatttagatagatagacagggaattcttggcgttgtctctggagatgctgaatcggcccttcacagagtccggcaagctccagggaagggcctggagtgggtctcaggtattagttggaacagtggtaggataggctatgcggactctgtgaagggccgattcaacatctccagagacaacgccaagaattcccngtatctaacaaatgaacagtctagagagctgaggacacggccttgtattactgtanactaaaagtntttgagtttagagtaagtaaggtctaactacgtacggtagtggaacgtcgtggggaccaaaggggacccacggtaccaccccggttctcctacgacgtccctacccaaccgacggggccccaagttccgggtcccttcccccgnggccccgtccctgcctccgacggacgcccacccgtacgacgacgaccaaccgcggtcccggccccgttgggaccctcggtcccgttagggtacaaaaccgggtcttaaccccgttccgaaccggttgaccgtaccgtaaccggtacgggaccgggccgggtaccgtacggggaaccgtaaacggtcccgaaacgtagacggngcgacgacgacgacncgagng

SEQ ID NO: 407992 - DNA, 526 bp, Homo sapiens
  misc_feature: GZ8MTXP02F4VEA.38.5.A05.1.454.CMB.2.raw
  modified_base (221)..(221): a, c, t, g, unknown or other
  modified_base (258)..(258): a, c, t, g, unknown or other
  modified_base (292)..(292): a, c, t, g, unknown or other
  modified_base (446)..(446): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataattgtctctgtacaacngcaccggcaatcgaccccaaaatcatgtatttangagtcactcatccgcctcgaggggtttctaatcgtccttctctgcatccaagtctggacaacgaccgccctccgtgaccatctcgtgggcctcgagctggacggacgaggtacttaagtttactttctgactagttacaatactaaccaaccanacaactactctacgtctacgtcgggcggacggaacacgctacgaccgtcaagtcacgacccaaggccaccgtccccgtcg

SEQ ID NO: 407993 - DNA, 604 bp, Homo sapiens
  misc_feature: GZ8MTXP02I5GU8.38.5.A05.1.454.CMB.2.raw
  modified_base (290)..(290): a, c, t, g, unknown or other
  modified_base (410)..(410): a, c, t, g, unknown or other
  modified_base (603)..(604): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgacaaaagnttttgagtttagagtagtaggtctactactacggtatgacgtcgtggggaccccaagggacccacggtcaccgtctcctcacgcctccaccagggcccagtccggtcttccccctggccnccctgccctcgacgggactccaccctccgagacgaccacgtacggccggtcccccgtgggggtccctcggcccgttacggggttccaaaacggggtcccttaacttccccgaaccggttagacgttaccggaaccgttggaacggcccgggggtctcgggggacccaaagggggcccgaacgtacgtagcgcnn

SEQ ID NO: 407994 - DNA, 593 bp, Homo sapiens
  misc_feature: GZ8MTXP02IDECF.38.5.A05.1.454.CMB.2.raw
  modified_base (293)..(293): a, c, t, g, unknown or other
  modified_base (448)..(448): a, c, t, g, unknown or other
  modified_base (591)..(593): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctacaaatgaacagtctgagagctgaggacacggccttgtattactgtagacaaaagtnttttgagtttagagtagtaagggtctactactacggtatggacgtgtggggaccccaagggaccacggtcaccgtcctcctcacgccctaccgaccaacggggccccagtccggtcccttcccccgtggccgccccgtgccctaccacggggacncccacccgtccgagacgcccaacgacggccgggcccccgtggggcctcggccgttgggtacgaaaacggcctttaacgtttcccaacggttgacttcggacttggacggtccggggctacgggccaaagggcgactagtagcnnn

SEQ ID NO: 407995 - DNA, 568 bp, Homo sapiens
  misc_feature: GZ8MTXP02GNMII.38.5.A05.1.454.CMB.2.raw
  modified_base (218)..(218): a, c, t, g, unknown or other
  modified_base (264)..(264): a, c, t, g, unknown or other
  modified_base (288)..(288): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcatcaccatctcctgcatggaaccngcagtgacgttggtagttataatttgtctctgtacacagcaccggnatcgaccccaaatcatgtatttangagtcactcacgtccgccctacgtacgggtttactaactcgtcctttctctgctacttaccgaagttctaggaccaacgacccgcctcctacgacctactcgtcgtcggactccgagctaggaggacgaggtactagtttattctagtactatactattaacaaaccacgacacaactactctgtactacggttcgggacggaacggaacacgtccgtacggtacccgttaaccgtaagtaccgacggacccaagggtccctcccggtcccgttacccgg

SEQ ID NO: 407996 - DNA, 580 bp, Homo sapiens
  misc_feature: GZ8MTXP02I06PL.38.5.A05.1.454.CMB.2.raw
  modified_base (248)..(248): a, c, t, g, unknown or other
  modified_base (294)..(294): a, c, t, g, unknown or other
  modified_base (328)..(328): a, c, t, g, unknown or other
  modified_base (452)..(452): a, c, t, g, unknown or other
  modified_base (466)..(466): a, c, t, g, unknown or other
  modified_base (542)..(542): a, c, t, g, unknown or other
  modified_base (573)..(573): a, c, t, g, unknown or other
  modified_base (577)..(577): a, c, t, g, unknown or other
  modified_base (579)..(580): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtgggtctcaggtattagttggaacagtggtaggataggctatgcggactctgtggaaggccgattcagcatctccagagacaacgccaaagaacttccctgtatctaacaaatgaacngtctgagagctgaggacacggtccttgtattactgtgacaaaagtntttgagtttagagtagtaggtctactacgtagtntggacgtgtcgggacccgacgggaccacggtccaccgtctcctcgacgccctaccgaaccgaacgggccctacgttcccggttacccttcccccgtggcccgcccttgccctccgagggtaccncccaccgcgagacnccacgcggcccgtcccgtgggcctacggccgtaggtaccgaaacgtccttaccgtacgcgtacgtacgtcggacgnggcggccggtacgcgggaacaaggccgatanagcncnn

SEQ ID NO: 407997 - DNA, 598 bp, Homo sapiens
  misc_feature: GZ8MTXP02JO59T.38.5.A05.1.454.CMB.2.raw
  modified_base (220)..(220): a, c, t, g, unknown or other
  modified_base (259)..(259): a, c, t, g, unknown or other
  modified_base (267)..(267): a, c, t, g, unknown or other
  modified_base (291)..(291): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcacatctcctgcactggaaccngcagtgacgttggtagttataattgtctctggtaccaangcaccggnaatcgaccccaaatcatgatttangagtcactcatcggcctgtagggtttcaatcgccttctctgcatccaagtcgtgacaaccgaccgaccctcccgtagacccatcctcgtcggcctcgaggctaggacggaccgaggtaccttatttacttctgtacttagttacaagttaactaaccaaccagacctaaacacttcctgtaccgttaggttccgggacgggaaccggggaacctaaacggtcccgtacggtaacccccgtttaacgaacgttacccgaaccggaccccggtaaaggtccccgtttacccggccccccgtttaaccgg

SEQ ID NO: 407998 - DNA, 595 bp, Homo sapiens
  misc_feature: GZ8MTXP02JJI6J.38.5.A05.1.454.CMB.2.raw
  modified_base (294)..(294): a, c, t, g, unknown or other
  modified_base (427)..(427): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccagcagtgacgttggtgttataatttgtctctgtaccaacagcacccggcaactcgaccccaaaatcatgtatttangagtcactcatccggcctcgtaggggtttactaactcgtccttctctgcactccaagtctacggacacgaccgcctcctgaccatcgtcgtggcctcgagctcggaggacgaaggtcttaaagtttatttccngtactactttacaattaactaacccaacctaacactaaaacctcctacgtacgtacgttacgttcggggaccgggaacggggaacccttaacggaccttaccggaacccgttaccgtaaggtaccgaccgaccccgaaagggtccctcccggtcccccgtttacccgg

SEQ ID NO: 407999 - DNA, 602 bp, Homo sapiens
  misc_feature: GZ8MTXP02G4I6I.38.5.A05.1.454.CMB.2.raw
  modified_base (271)..(271): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataaattgtctctggtaccaacagcacccggnaatcgacccccaaatcatgatttatgaggtcactcatcggccctcgtaggggttctaatccgtcttctctgctatccagtctggacaacaccggcctccctagacccatcctcgtcgggcctccgaggcctaggacggacgtacggtactttaaaagtttctttctgtccgtaagtttaccctaattaactaaccaaacccgagtaaccaaactccttacctagtaccgttaacgttccggggacggtacgggaaccgtaaacgccgtacggtacccggttaacctaaacggtaccaccggacccgaaacgggtcctaccccggtcccccg

SEQ ID NO: 408000 - DNA, 569 bp, Homo sapiens
  misc_feature: GZ8MTXP02GKCPC.38.5.A05.1.454.CMB.2.raw
tcagtcgatcacgtcacgaccggtgctcgatttagatagatagacagggggtggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctctgcactggaaccagcagtgacgttggtgttataattgtctctgtacacagcaccggcaatgaccccaaatcatgattatgaggtcactcactcggcctcgagggttctaatccgtacttctctcgctactctagtctacggacaaccgaccggtccctaccctcgaccctactccgtcgtcgggcttaccgaggctggaacggacggacggtactttaaactttagtttcgtcggtactagtttaccaatttaacaaccaacaacgacaacactctacggtctacgttcgggacggaggaaccagtactacgtaccgtaacgtaacgtacgaacgtcccgaacggtccgtccgtacccccg

SEQ ID NO: 408001 - DNA, 552 bp, Homo sapiens
  misc_feature: GZ8MTXP02JK69G.38.5.A05.1.454.CMB.2.raw
  modified_base (254)..(254): a, c, t, g, unknown or other
  modified_base (287)..(287): a, c, t, g, unknown or other
  modified_base (376)..(376): a, c, t, g, unknown or other
  modified_base (382)..(382): a, c, t, g, unknown or other
  modified_base (417)..(417): a, c, t, g, unknown or other
  modified_base (422)..(422): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctggtctctggacagtcatcaccatcctcctgcactggaaccagcagtgacgttggtgttataattgtctctgtacacngcaccggcaatcgaccccaaatcatgtatttangagtcactcacgtccggcccttgtacggggtttcaacgttcgccttcgtctgcactccaagtctggacaacaccgtcctcctcgacctntctcgngggtcctccgagtctggacggacgtgacttaattnttcgngtactagtactataacaacaacacaactaactactactgtacgttacggtacgggacggtaacggactacgtccgtaccgtacccgtactaacgtaccgaccgaccgacggtccctacccgtcccgtacg

SEQ ID NO: 408002 - DNA, 625 bp, Homo sapiens
  misc_feature: GZ8MTXP02IOP3D.38.5.A05.1.454.CMB.2.raw
  modified_base (222)..(222): a, c, t, g, unknown or other
  modified_base (262)..(262): a, c, t, g, unknown or other
  modified_base (298)..(298): a, c, t, g, unknown or other
  modified_base (489)..(489): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtggttataattgtctctggtaccaacngccaccggcaactcgacccccaaatcatgtatttangtagtcactcagtcgccctacgtagggtttctaatcccgacttctctgctactcagtctacgaccacgaccggtcctaccctgaccctattcctcgttcgggctcccgacggcgttaggaacgggtacgtaggtaccttaaagttttacttctcggtacacggtttactaatacgtaaaccaaaccgtaanacctaaactaccgtacgtcgtaccgttacggttccgggacgggtaacggggaacctaaacgtcgtacccgtaaccgtaacccgttaaacggaccgtaccggaccccggtaaacggtcccgtaccccggtcccccgg

SEQ ID NO: 408003 - DNA, 577 bp, Homo sapiens
  misc_feature: GZ8MTXP02HHZO5.38.5.A05.1.454.CMB.2.raw
  modified_base (258)..(258): a, c, t, g, unknown or other
  modified_base (292)..(292): a, c, t, g, unknown or other
  modified_base (457)..(457): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttaataattgtctctgtaccacngcaccggcaatcgaccccaaaatcatgtatttangaggtccgaatccggccctacgaggtaactttctaatcgtcttcctctcgtctaccaagtctacggccaaacgaccggccctccctacgaccctatcctcgtcggacctccgaggcctaggacggacgaggctagacttactactcgactattacatactacaancctactacttcctcttctgttacgttcgggacggtacggacccgtagggtaccgtacccggtacgttaacgcgaaccgacccgaaacggtcctacccgcccccgttacggtaccttcccg

SEQ ID NO: 408004 - DNA, 529 bp, Homo sapiens
  misc_feature: GZ8MTXP02F4E8W.38.5.A05.1.454.CMB.2.raw
  modified_base (220)..(220): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataaatttgtctctggtaccaacagcaccggcaatcgacccccaaaatcatgatttatgaggtcactcatcggcctcgtaggggtttctaatcgccttctctgcatccaagtctgcaacaccgcctcctcgaccatctcgtgggcctccgaggctggacggacgaggtacttaagtttatttctgtctagttctaatataaccaaccagacaacactctgactacgttcggacggacggaaccaacgctacgaccgtacctaagtcgacgacccgaagcctcgccccttcgg

SEQ ID NO: 408005 - DNA, 642 bp, Homo sapiens
  misc_feature: GZ8MTXP02JZTCT.38.5.A05.1.454.CMB.2.raw
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtgttataatttgtctctggtaccaacagcaccggcaatcgaccccaaaatcatgatttatgaggtcactcatccggccctcgtacggggtttctaagtcgtccttctctgctataccaagtctggactaacgacggtccctccctcgacccattcctcgtcggggccttcccgagggtctgggaacgggacggtaagggacctttaaatttacgttttcgtacggtctacggtttcaagttaaccttaaccaaaccctaacggaccaaaccctaccttaccttcggtactttacggtttacccggggaccggggaaacggggaaacccctaaaggccgtacgaaccccgttccgtaaacgtccgaaccggaccccgtaaacgggccgttacccggcccccctttccggg

SEQ ID NO: 408006 - DNA, 525 bp, Homo sapiens
  misc_feature: GZ8MTXP02IAXW1.38.5.A05.1.454.CMB.2.raw
  modified_base (216)..(216): a, c, t, g, unknown or other
  modified_base (294)..(294): a, c, t, g, unknown or other
  modified_base (423)..(423): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcaggcacagggtcctgggcccagtctgccctggctcagcctgcctccgtgtctgggtctctggacagtcatcacatctcctgcactggaaccngcagtgacgttggtgttataaatttgtctctggtacaacagcacccggcaactcgacccccaaaatcatgtaatttangagtcactcatccggcctcgagggtttctaatcgtccttctctgcatccaagtctaggcaaaccgccgtccctcctcgaccactctcgtcgggcctcgagcgtgaggacgaggtacttaatttatttcngtctagttactatataaccacagacaacactctgtactacgttcggcggacggacagctacgaccgtactaacgtcgaacgcccgaagcctcgcccccgtcg

SEQ ID NO: 408007 - DNA, 610 bp, Homo sapiens
  misc_feature: GZ8MTXP02GR2DX.38.5.A05.1.454.CMB.2.raw
  modified_base (210)..(210): a, c, t, g, unknown or other
  modified_base (297)..(297): a, c, t, g, unknown or other
  modified_base (427)..(427): a, c, t, g, unknown or other
  modified_base (433)..(433): a, c, t, g, unknown or other
  modified_base (452)..(452): a, c, t, g, unknown or other
  modified_base (604)..(604): a, c, t, g, unknown or other
  modified_base (609)..(609): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccaganacaacgccaaagaacttccctgtatctaacaaatgaaacagtctgagagctggagacacggtccttgtattactgtagacaaaagtnttttagtagttagagtagtaaggtctactactacggtatggtacgtcgtcggggacccgaacgggaccacgggtacaccgtctcctcacgccctaccaccgaacgggcccagtcccggtcccttcccccncggccnccctcgcctcccgaggacnccacccgtccgagacgcaaaccgcggccggcccgtcggggcctcggccgtcggtacgaaacggacccttaccgtacccgtacggttacgacgttccggaccgttaggacgggtccggggccgtacgggaacgaacggtccggaacacgtagngcacng

SEQ ID NO: 408008 - DNA, 589 bp, Homo sapiens
  misc_feature: GZ8MTXP02G7GFQ.38.5.A05.1.454.CMB.2.raw
  modified_base (294)..(294): a, c, t, g, unknown or other
  modified_base (427)..(427): a, c, t, g, unknown or other
  modified_base (462)..(462): a, c, t, g, unknown or other
  modified_base (588)..(589): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaacagtctgagagctggaggacacggccttgtattactgtagacaaaagtnttttgagtttagagtagtaaggtctactactacggtatggacgtcgtggggaccccaaagggaccacggtcaccgttctcctcacgcctcccaccgaacgggcccagttcccggtcccttcccccgtggcccncccgtgccctccgacggacgccaccgtccgagacncacgacggccggcccgtggggcctcggccgtggtacgaaacgggtaccttaccgttcccgaacggttcgaactcggtacctgggaacggccgggacgtcggaccgaaggggccacgacgtagcgcnn

SEQ ID NO: 408009 - DNA, 579 bp, Homo sapiens
  misc_feature: GZ8MTXP02JH0U8.38.5.A05.1.454.CMB.2.raw
  modified_base (363)..(363): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaattgtctctgtacaacagcaccggcaatcgaccccaaaatcatgattatgagtcactcactcggccctgagggtttctaatccgtcttctctgcatccagtctggcaacgacgcctccngaccatctcgtggctcgagctgacggacgaggacttaaattactttcgtacgtcgtacgttactataactaaccaaaccacgaaccaaactacctacgtacgtaaccttacgttccggggacgggaaacgggaaccctaacggtaccgtacgtaaacccggttaacgtaaacgtaccgaaccggacccgaaacggtccccgttaccggtccccccg

SEQ ID NO: 408010 - DNA, 565 bp, Homo sapiens
  misc_feature: GZ8MTXP02HWIYB.38.5.A05.1.454.CMB.2.raw
  modified_base (290)..(290): a, c, t, g, unknown or other
  modified_base (563)..(565): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccattcagcatctccagagacaacgccaagaattccctgtatctacaaatgaaacagtctgagagctgagacacggccttgtattactgtgacaaaagtnttttgagtttagagtagtaaggtctactactacggtatggacgtcgtggggaccccaagggacccacggtcacccgtctcctcacgccctccaccgaagggccccattcccgggtccttcccccgtggcccgccccctgccctcccgaggcgccacccgtcgaacgacgccacacggtcccggccctggggcctggcccgtggtaccaaaggtcctacgttccgacgtgactccgactggacgtcgggcctgggacgaaggccgacgatagcnnn

SEQ ID NO: 408011 - DNA, 565 bp, Homo sapiens
  misc_feature: GZ8MTXP02HN0WM.38.5.A05.1.454.CMB.2.raw
  modified_base (222)..(222): a, c, t, g, unknown or other
  modified_base (270)..(270): a, c, t, g, unknown or other
  modified_base (288)..(288): a, c, t, g, unknown or other
  modified_base (293)..(293): a, c, t, g, unknown or other
  modified_base (359)..(359): a, c, t, g, unknown or other
  modified_base (370)..(370): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctcgtgtctgggtctccgtggacagtcgatcaccatctcctgcactggaaccngcagtgacgttggtagttataattgtctctggtaccaacagcaccggnaatcgaccccaaatcatnattangagtcactcactcgccctgtagggtttctaatccgtcttctctgcactccagtctaggacaaaccnccggccctccncgacctatcctcgtcgggccttccgaggtcctaggacggacgaggtacttaaagtttactttcgcgttactagttactaattaactaacccaaacaagtaccaaacctacttcgtacgtacgttacggttcgggacgggacggaacacgcgtacgaccgtaacgtaagcacgacccgacggtcctccgtcccccg

SEQ ID NO: 408012 - DNA, 587 bp, Homo sapiens
  misc_feature: GZ8MTXP02HNNH3.38.5.A05.1.454.CMB.2.raw
  modified_base (192)..(192): a, c, t, g, unknown or other
  modified_base (220)..(220): a, c, t, g, unknown or other
  modified_base (255)..(255): a, c, t, g, unknown or other
  modified_base (286)..(286): a, c, t, g, unknown or other
  modified_base (487)..(487): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacngtcgatcaccatctctgcactggaaccngcagtgacgttggtgttataattgtctctgtacangcaccggcatcgaccccaaatcatgatttangaggtcactcagtccgccttacgtaggggtttctaaactcgtccttctctgctactccgtaagtcgtcggacaacctacccgggtccctccctacgaccctattcctccggtcgggtaccacccgtagggccgtaggacgggaacgtacggtatttaaacgtttactttcgtctacgtttatactaataactaacaccaanactaactactctacgcttaacggttcggacggaacggaactaacgtccgtacgtaccgtacgttaaggacaccgaccgtaagccctccgaccccgttccg

SEQ ID NO: 408013 - DNA, 617 bp, Homo sapiens
  misc_feature: GZ8MTXP02J29SD.38.5.A05.1.454.CMB.2.raw
  modified_base (221)..(221): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttaataactatgtctactggtaccaaacaacaccaggacaaacgccccaaatcatgatttatgaggtacaactaactccggccctacgtacgggtttactaatccgtacttcctcgtggcctaccgtaagtttcggacaccgaccgggtccctcccgtgacctatttcgtcgggcctaccgagccgtaggacgggtaccgagggtcctaggttaaattttacgttcgtccttcctactactacgtacgagggacagcacgtaccctaccccgttatccgttacgttaccggactacggggaacctaacggtcctaaacccgtccttacgaccgaaccgacccgaacggaccccaacccgtactccgtaccacgtcctcccg

SEQ ID NO: 408014 - DNA, 609 bp, Homo sapiens
  misc_feature: GZ8MTXP02JJ4SS.38.5.A05.1.454.CMB.2.raw
  modified_base (220)..(220): a, c, t, g, unknown or other
  modified_base (293)..(293): a, c, t, g, unknown or other
  modified_base (450)..(450): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgtactggaaccngcagtgacgttggtgttataattgtctctggtaccaacagcaccgggcaatcgacccccaaatcatgatttangagtcactcactccggccctcgtacggggtttactaacgtcgtctttccctctcgcacttccaagtcgtcgggacaaccgaccggccctccctcgacctctcctcgtcggcctaccgaggcgtagacgggacgtacggtacttaaatttactttccnggtactacgttacattaactaccaaaccagaccaaactactctacgtacttacggttacggggacggtaacggggaaacccaggtacctacggtaacccgttaccgtaagtaaccgaaccggacccgtaacggcccgttaccgcccccgttacggtccc

SEQ ID NO: 408015 - DNA, 634 bp, Homo sapiens
  misc_feature: GZ8MTXP02JY0YM.38.5.A05.1.454.CMB.2.raw
  modified_base (293)..(293): a, c, t, g, unknown or other
  modified_base (629)..(629): a, c, t, g, unknown or other
  modified_base (631)..(634): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaacttccctgtatctaacaaatgaacagtctgagagctgaggacacggccttgtattactgtgacaaaagtnttttgagttagagtagtaaggtctactacgtacgtatggacgtcgtggggacccaagggaccacggtccaccggtcctcctccacgtcccctacccgaccgaaacggggccccctaacgttcccgggttaccccctttccccccggtcggccccgtcccccttcggcccttacccgacgggaccgtccccacccgttcccgggaagacggccaaccgcggcccgggtccccgtgggggcccttccggcccgttgggtaacccaacgggtacccttaccgtcccgacggttcgaacctcggaacgtggacggtccgggctggacgaaggccgacagngnnnn

SEQ ID NO: 408016 - DNA, 556 bp, Homo sapiens
  misc_feature: GZ8MTXP02FMRX9.38.5.A05.1.454.CMB.2.raw
  modified_base (259)..(259): a, c, t, g, unknown or other
  modified_base (268)..(268): a, c, t, g, unknown or other
  modified_base (292)..(292): a, c, t, g, unknown or other
  modified_base (365)..(365): a, c, t, g, unknown or other
  modified_base (406)..(406): a, c, t, g, unknown or other
  modified_base (409)..(409): a, c, t, g, unknown or other
  modified_base (433)..(433): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgcactggaaccagcagtgacgttggtgttataaattgtctctggtaccanagcaccggnaatcgaccccaaatcatgatttangaggtcactcatcggccctcgaggggtttctatccgcttctctgcatccagtctggacaacgacggcctcccngaccatctctcgggctccgagcctgaggcgagcttaaattnttntgactagttcaattactacaaccngtacaaacactctcgtactagttacgggacgggaacggggaaccaacggtcctacggaaccccgtaacgttaaacggtcccaaacggtacccccgaaacggtccctacccggttaccccccgg

SEQ ID NO: 408017 - DNA, 547 bp, Homo sapiens
  misc_feature: GZ8MTXP02I1KQ1.38.5.A05.1.454.CMB.2.raw
  modified_base (290)..(290): a, c, t, g, unknown or other
  modified_base (544)..(547): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtgggtctcaggtattagttggaacagtggtaggataggctatgcggactctgtgaagggccgattcagcatctccagagacaacgccaagaattccctgtatctaacaaatgaacagtctgagagctgagacacggccttgtattactgtgacaaaagtnttttgagtttagagtagtaaggtctactactacgtatggacgtcgtggggaccccaagggacaacggtcaccgtctcctcgacgccctaccaaccgtaacggggccccctagttcccgggtcccttcccccgtggcccgcccctgcctccgaggacgccaccctcgagacgcacgaggccgccctgggcctgcctggtcaaggctacgtcgagtcgatcgactggacgccggctggaccgaaggccacgatagnnnn

SEQ ID NO: 408018 - DNA, 603 bp, Homo sapiens
  misc_feature: GZ8MTXP02GNY3N.38.5.A05.1.454.CMB.2.raw
  modified_base (221)..(221): a, c, t, g, unknown or other
  modified_base (262)..(262): a, c, t, g, unknown or other
  modified_base (270)..(270): a, c, t, g, unknown or other
  modified_base (297)..(297): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcaggtgacgttggtagttaataatttgtctctgtaccaangcaccggnaactcgaccccaaaatcatgtatttangtagtcactcatccggccttcgtaggggtttctaagtcgtccttctctcgactactcctaagtcgtcgacaaccgaccgtccctacctcgaccctatcctcgtcgggcctaccgaggtcgtaggaacggacgtaggtacttaaatttcgtttcaggtactagttacaaacttacaaccaaaccgaactaccaaaactctacgtacgtacttaacgttcggggacgggtaacggaaccacgtccgtacgaccgttaccgaaacggtcacggtacccgaacggtcccgtcccggtaccccgttaccgg

SEQ ID NO: 408019 - DNA, 692 bp, Homo sapiens
  misc_feature: GZ8MTXP02I0G8S.38.5.A05.1.454.CMB.2.raw
  modified_base (258)..(258): a, c, t, g, unknown or other
  modified_base (266)..(266): a, c, t, g, unknown or other
  modified_base (293)..(293): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatccaccatctcctgcactggaaccagcagtgacgttggtagttataattgtctctgtacaangcaccggnaatcgacccccaaaatcatgtatttangagtcactcactcggtcctcgtagggtttctaagtcgtccttctctgctacgtccaagtcgtcggaccctaaacgcccggtccctaccgtacgaccctacgttccttccgtcggggtccctaccgtaacgggtcgtcgggaaacgggtaccggtaacggttacttaaacgttttacggttttaacctcggtacctttaacgttacctaactttaaactaaaccccgaaaaccctaacggaccctaaaacctcccgtttaacgtccggttacctttaaccgggttaccgggggtaaccggggaaaccggggttaaaccgacggtccgtaaccggtaccccgttacgtaacgacccgtacgacccccggtaaggccccttcccggaacccccgtttccggg

SEQ ID NO: 408020 - DNA, 683 bp, Homo sapiens
  misc_feature: GZ8MTXP02JWG3U.38.5.A05.1.454.CMB.2.raw
  modified_base (222)..(222): a, c, t, g, unknown or other
  modified_base (264)..(264): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngctagtgtacggttggtagttaataattgtctctgtaccacncgccgaccggacacaccgacccaaatcatagtattagtgacgtcactctacgtccgtccgtacgtacgggttactacgtcccgtcttctctcgctactacgtacgtcgtacggaccaaccgtaccgtccctcccgtacgaccctacgttccgtccggtcgggtccgttaccggtaggttacgggaacgggtacggtaggtacgtacgttaacttagttacgtcgccgtacctacgtaacgtagtacggtaacgtacgggtacggggtttacgggggtttacggggacggggtaacgggtaaaccggtaaacggtaccggtacccggttacggtaacgggtaccgaccggtaacccggtaacggtcccgtaccccggtaccccgtccggtacctacccgtttaccgtacccgttaccccg

SEQ ID NO: 408021 - DNA, 555 bp, Homo sapiens
  misc_feature: GZ8MTXP02IVW6U.38.5.A05.1.454.CMB.2.raw
  modified_base (193)..(193): a, c, t, g, unknown or other
  modified_base (302)..(302): a, c, t, g, unknown or other
  modified_base (452)..(452): a, c, t, g, unknown or other
  modified_base (486)..(486): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctgccctggctcagcctgcctccgtgtctgggtctcctggacngtcgatcaccatctcctgcactggaaccagcagtgacgttggtggttataaatttgtctcctggtaccaaacagcacccgggcaatcgacccccaaaatcatgatttangaggtcactcatcggcccctgtacggggtttctaactccgtcttctcttcgctactccgagtcctggaacctacgaccgtcctccctgaaccctatccttcgtgggccttccgacggctgaacggtacgaaggtacttaaattctttcgngctagttcaattactaacaactagacaacactcncgtacttagtcggacggacggaccacgtctacgaccgtccgaagtcacgacccaggccaccgtcccccg

SEQ ID NO: 408022 - DNA, 567 bp, Homo sapiens
  misc_feature: GZ8MTXP02G6VER.38.5.A05.1.454.CMB.2.raw
  modified_base (291)..(291): a, c, t, g, unknown or other
  modified_base (422)..(422): a, c, t, g, unknown or other
  modified_base (564)..(564): a, c, t, g, unknown or other
  modified_base (566)..(567): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccattcagcatctcagagacaacgccaagaacttccctgtatctaacaaatgaacagtctgagagctgagacacggtccttgtattactgtgacaaaagtnttttgagtttagagtagtaaggtctactagtacgtatggtacgtcgtgggacccgaacgggaccacggtccacccgtctccctcacgcctccgaccgaacggggcccaacgtcccgggtcccttcccccgnggcccgccccgtgccctccgacggcgcccaccgtcgagacgcaacgtcggccgcccgtgggctcgcccgtggtacgaacggtacttaccgttccgacgttgactcgacgtggacgcgggactcggacgaaggcgacagtagncnn

SEQ ID NO: 408023 - DNA, 594 bp, Homo sapiens
  misc_feature: GZ8MTXP02GUNR0.38.5.A05.1.454.CMB.2.raw
  modified_base (285)..(285): a, c, t, g, unknown or other
  modified_base (292)..(292): a, c, t, g, unknown or other
  modified_base (426)..(426): a, c, t, g, unknown or other
  modified_base (590)..(590): a, c, t, g, unknown or other
  modified_base (592)..(593): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtacttactgtganaaaagtnttttgagtttagagtagtaagggtctactactacggatggacgtcgtgggacccaaggggaccacggtcaccgtctacctcacgccctccaaccgaacggggcccaacgtccgggtcccttcccccgtcggccncccctgccctcgaggacgccacccgtccgagcgaccacgacgtccgggccctggggacctcggcccttggggacctaaagggccttaaccgtttccccgaagggttcaacggttaccacgtggaacgggccgggcgtcggacgaaacgggtcacgaaggtcgcncnng

SEQ ID NO: 408024 - DNA, 544 bp, Homo sapiens
  misc_feature: GZ8MTXP02JA1CL.38.5.A05.1.454.CMB.2.raw
  modified_base (292)..(292): a, c, t, g, unknown or other
  modified_base (385)..(385): a, c, t, g, unknown or other
  modified_base (415)..(415): a, c, t, g, unknown or other
  modified_base (434)..(434): a, c, t, g, unknown or other
  modified_base (443)..(443): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctctggacagtcgatcaccatctcctgcactggaaccagcagtgacgttggtgttataaattgtctctgtaccaacagcaccggcaatcgacccccaaaatcatgtatttangagtcactcatccggcctcgtaggggtttctaagtcgtccttctctcgactacgtccaatcgtggacaaccgacgccctcctgaccatctcgnggcctccgagctgaggacgagacttaattnttctggctagttcattaanaaccaacanaccaaactctactacgcttacgtcggacggaacgggaacctaacgcctacgtacccgtccgtaaacgtcaacgacccgaaggccttaccgccccttaccgg

SEQ ID NO: 408025 - DNA, 606 bp, Homo sapiens
  misc_feature: GZ8MTXP02HY025.38.5.A05.1.454.CMB.2.raw
  modified_base (294)..(294): a, c, t, g, unknown or other
  modified_base (429)..(429): a, c, t, g, unknown or other
  modified_base (603)..(603): a, c, t, g, unknown or other
  modified_base (605)..(606): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaacttccctgtatctaacaaatgaacagtctgagagctgagacacggtccttgtattactgtgactaaaagtnttttagagttagagtagtaaggtctactactacggtatcggacgtcgtggggacccaagggacctacggtcaccgttcctcctcacgcctaccacccgaacgggccccagttcccggtcccttcccccgggcccnccctgccctccgaggtcaccacccgtcgaagacgaccacgtacggcccgtccccgtggggccctcggtcccgtacgggttaaccaacgggtacccttaccgttccgaacggttcgaaacgtccggaaacctgggaacggtccggggctacgggcgaaacgggcaacgacgtagncnn

SEQ ID NO: 408026 - DNA, 611 bp, Homo sapiens
  misc_feature: GZ8MTXP02GUBVG.38.5.A05.1.454.CMB.2.raw
  modified_base (221)..(221): a, c, t, g, unknown or other
  modified_base (294)..(294): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataattgtctctggtacaacagcaccggcaatcgacccccaaaatcatgtatttangtaggtcactcatccggcctcgtaggggtttctaagtcgtccttcgtctgctactccaagtcgtacgactaaccaccggtccctccgacgacctactctcgtggtcctcgaggctggacggacgaggtacttaatttactttctgtacctagttacaagttaactaaccaaaccaacgtacctaaacctactacgtacgtacgttaacggttccggggaacgggaaccgggacgtaaacggtcgtacccggtacccgttaccgtaacggtaccgaaccggacccgtaacggtaccgtcccggtacccccgttcccgg

SEQ ID NO: 408027 - DNA, 604 bp, Homo sapiens
  misc_feature: GZ8MTXP02IBKFC.38.5.A05.1.454.CMB.2.raw
  modified_base (229)..(229): a, c, t, g, unknown or other
  modified_base (238)..(238): a, c, t, g, unknown or other
  modified_base (243)..(243): a, c, t, g, unknown or other
  modified_base (251)..(251): a, c, t, g, unknown or other
  modified_base (255)..(255): a, c, t, g, unknown or other
  modified_base (258)..(258): a, c, t, g, unknown or other
  modified_base (284)..(284): a, c, t, g, unknown or other
  modified_base (370)..(370): a, c, t, g, unknown or other
  modified_base (423)..(423): a, c, t, g, unknown or other
  modified_base (604)..(604): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaaggccgattcagcatctccagagacaacgccaaagaattcccngtatctaanaaatnaacagtcngagngcngagacacgcttgtattactgtagaanaaaagtatttgagtttagagtagtaaggtctaatacgtagtatggacgtcgaggggacccgaaagggaccacgtacaccgtctccncagccctacccaaccgaacggtcccaacgttcccgggtacccctttcccccgnggcccgtccccctccgtcccgtacccgacggacgaccgacccgtacccgaacgacgacgacgacgaccggcccggcgggcgtcgccgtacggtacgtaacgtaaccgtacctaccgtacgtacgtacgtacgacgtacgacggacgggccgtacggacgaacggacgacgacgagacacan

SEQ ID NO: 408028 - DNA, 636 bp, Homo sapiens
  misc_feature: GZ8MTXP02HL8UZ.38.5.A05.1.454.CMB.2.raw
  modified_base (272)..(272): a, c, t, g, unknown or other
  modified_base (299)..(299): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttaataaatttgtctctggtaccaacagcaccggnaactcgaccccaaaatcatgtatttangagtcactcatccggcctgtaggggtttctaagtcgtccttctctgctatacaacgtctcgggactaaaccgaccgcccttcccgacgtacccattcctccggtcggcctccgaggtctggaacggacgtaggtacttaatttatttcctggacttagttacataactacaactacgacaaacacttcgtacgtacgttaacggttacggggacggaacggggaaaccctaaacggtccgttaaccgggtaaccccggttaaccgttaaaccggttaccgaacccggtaaccccgaaaccggggtccccttccccgggtaaccccccgtttcccggg

SEQ ID NO: 408029 - DNA, 627 bp, Homo sapiens
  misc_feature: GZ8MTXP02HL9KB.38.5.A05.1.454.CMB.2.raw
  modified_base (222)..(222): a, c, t, g, unknown or other
  modified_base (303)..(303): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatcctcctgcacgtggaaccngcagtgtacgttggtagttaataaatttgtctcctggtaccaacagcacccggcaactcgaccccaaaatcatgtatttangagtcactcatccggcctgtacggggtttctaacgtcgtccttctctgctacgtccaagtctgggaacaaaccgtaccggtacccttcccgtcgtaaccctacttcctccggtcggggtccctaccggacggtcgtaggaacgggtaaccggtacggtacttaagttttactttcgtaggtacttacgtttcaattactaacaaccagactaaactcttacgtacgtcttacggtcgggacgggtaacggaccgtaaacgctacggtaacccgtacctaacgtacgaaccgacccgtaacggccctaccgtcccccgttaccgg

SEQ ID NO: 408030 - DNA, 595 bp, Homo sapiens
  misc_feature: GZ8MTXP02GPD3A.38.5.A05.1.454.CMB.2.raw
tcagtcgatcacgtcacgaccggtgctcgatttagatagatagacagggggggtctcaggaggcagcgctctcaggacatctccaccatggcctgggctctgctgctcctcaccctcctcactcaggcacagggtcctgggcccagtctgccctggctcagcctgcctccgtgtctgggtctccgtggacagtcgatcaccatcctcctgcactggaaccagcagtgacgttggtagttataattgtctctggtacaacagcaccggcaatcgaccccaaaatcatgtattatgagtcactcatcgcctacgtagggtttactaatcgccttctactgctatccaagtcgtgacaaccgaccggccctccctcgaccctagtcctacgtcggcctacccggagtcgtaggacgggacgtaggtacctaagtttactttaccgtgacgttagttacctaatactaaaccgacctaacgacaaaactcctctacgtacttaacggttcgggacgggtacggaaccgaaacgtctacggtacccctacggttaacgtccaaccgtaccgaacgggtccttcccggacccccgttccgg

SEQ ID NO: 408031 - DNA, 589 bp, Homo sapiens
  misc_feature: GZ8MTXP02FZ5N8.38.5.A05.1.454.CMB.2.raw
  modified_base (293)..(293): a, c, t, g, unknown or other
  modified_base (440)..(440): a, c, t, g, unknown or other
  modified_base (584)..(584): a, c, t, g, unknown or other
  modified_base (588)..(588): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaattccctgtatctaacaaatgaaacagtctgagagctgaggacacggccttgtattactgtgacaaaagnttttgagtttagagtagtaagggtctaactactacggtatggagtcgtggggaccccaaagggacccacggtccaccgtcctcctcagccctccacccgaaggcccatccggtcccttcccccgtggccgccctgcctcccaggacncacctccgagacgctacgacgccggccctaggggcctacgcccgtggtacaaacgggcctaacgtttcccaacggttgaacgttccggaacgtaggaacggccgggggactaggggaaccgaaacgggccgtacaaagtacggngcanc

SEQ ID NO: 408032 - DNA, 566 bp, Homo sapiens
  misc_feature: GZ8MTXP02G0XSM.38.5.A05.1.454.CMB.2.raw
  modified_base (220)..(220): a, c, t, g, unknown or other
  modified_base (374)..(374): a, c, t, g, unknown or other
  modified_base (384)..(384): a, c, t, g, unknown or other
  modified_base (555)..(555): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctccgtggacagtcgatcaccatcctcctgcactggaancagtagtgactagtttgggtagttaataactatcgtctctcgtaccaacaaccaccagacaaacgcccccaaactcatctatttatgactcactcactccggtccctcgtagggtttcctactcccgtcttctctgtctcctagttcgacaacnccgtcctccngacctatttcgtgcctcgaggctaggacggacgaggtcttagttacttttagtcgtccttcctactatatacgagcacgcacgtctacccttagtccgttcgttacggacgtacgggaacctaaacggtccaacccgttcctacgtaccaacgcccgaaacgcccaacccnctcgtactacc

SEQ ID NO: 408033 - DNA, 666 bp, Homo sapiens
  misc_feature: GZ8MTXP02IT1GW.38.5.A05.1.454.CMB.2.raw
  modified_base (271)..(271): a, c, t, g, unknown or other
  modified_base (543)..(543): a, c, t, g, unknown or other
tcagtcgatcacgtcacgaccggtgctcgatttagatagatagacaggggtgggggtctcaggaggcagcgctctcaggacatctccaccatggcctgggctctgctgctcctccaccctcctcactcagggcacgagggtcctgggcccagtctgccctggctcagcctgcctcgtgtctgggtctccgtggacagtcgatccacatcctcctgcacgtcggaaccagcgagtgacggttggtagttaattaatttgtctcgtgtaccanagccgacccggcaactccgaacccccaaagtccattagttaactttagtaggacggtcaccttacgtacgtccggtaccctcggttacgggtttacctaacttcccgtccgtttcttctcgactacgttaccagttccgtggaccaaccgcccggtcccctaccgtaccgaacctcttccgtcgtccgggtctacgaggtccgaggacggacgtaacgtatttaaacgtttactttcgagtaccttagtactaaactactaaccgaaactanaaacctactacgtcgtacgtaccgtaggttaccggggacgggaaacggactaaacggtccgttacccggtaacctaaccgtaaccggtcgacccgacccgtacggtccgtaccccgtccccgg

SEQ ID NO: 408034 - DNA, 595 bp, Homo sapiens
  misc_feature: GZ8MTXP02HAWAN.38.5.A05.1.454.CMB.2.raw
  modified_base (258)..(258): a, c, t, g, unknown or other
  modified_base (267)..(267): a, c, t, g, unknown or other
  modified_base (290)..(290): a, c, t, g, unknown or other
  modified_base (298)..(298): a, c, t, g, unknown or other
  modified_base (315)..(315): a, c, t, g, unknown or other
  modified_base (353)..(353): a, c, t, g, unknown or other
  modified_base (385)..(385): a, c, t, g, unknown or other
tcagtcgatcacgtcacgaccggtgctcgatttagatagatagacaggggggtgtctcaggaggcagcgctctcaggacatctccaccatggcctgggctctgctgctcctcaccctctcactcagggcacagggtcctgggcccagtctgccctggctcagcctgcctccgtgtctgggtctccgtggacagtcatcaccatctcctgcactggaaccagcagtgacgttggtagttataaattgtctctgtacaanagcaccggnaatcgacccaaatcatgtattangagtctancatcgcctagtacggtntacgtcgtactctctgtcactacagtctcggactaacnccggtcctccacgacactcgtcgcgggtaccncgacgtcgtaggacggtacgtacgtactttaaatttacttacgtagtactaacgttacaataacgtaaccaaactacgtaacctaaactacgttacgtacgtaccgttacggttacgggaacggtaacggaaacctaacgtccgtaaccggtaacccgtaaccgttaacgtaccgtaaccgtaccgtaccggtaccgttacccgtccccg

SEQ ID NO: 408035 - DNA, 598 bp, Homo sapiens
  misc_feature: GZ8MTXP02H85L0.38.5.A05.1.454.CMB.2.raw
  modified_base (220)..(220): a, c, t, g, unknown or other
  modified_base (258)..(258): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccngcagtgacgttggtgttataatttgtctctgtaccaanagcacccggcaatcgacccccaaaatcatgtatttatgaggtcactcacgtccggcctcgtaggggtttactaatcgtccttctctgctatccaagtctggacaaaccgaccggtccctccctagaccctactcctcgttcgggcctcccgaggtctaggacggacgacggtacttaaatttatttcgttacgacgttacgtttctaacttaactaaccaaaccgacactaacctaacctctacgtacttacgttacgggacggtacggaacccaaagtccgtacgtacccgtacgtaacgtccgaacgcccgaaacggtccctaccgtcccccgtccgg

SEQ ID NO: 408036 - DNA, 595 bp, Homo sapiens
  misc_feature: GZ8MTXP02J1YE4.38.5.A05.1.454.CMB.2.raw
  modified_base (267)..(267): a, c, t, g, unknown or other
  modified_base (303)..(303): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcacctatcctcctgcactaggaaccagcagtgtacgttggtagttaataatttgtctcctggtaccaacngccgaccggacactcgaccccaaatcatgtatttangagtcactcagtcgcctcgtaggggtttactaagtccgtccttctctgtcactccagtctggaccacgacgccctcacgcctattctcgtcgggtacctccggagtcgtaggacgggacgtaggtactttaaagttatttccgagtactagttctaacttaataaccaaacacgaacctaactaccttacgtcgtaccttaaggttccgggacggaacggggaaccacggtacgtccggaaccgttaccgtaacgtaccgacgacccgtaacgtccgtcccgtcccgttccg

SEQ ID NO: 408037 - DNA, 667 bp, Homo sapiens
  misc_feature: GZ8MTXP02F14C3.38.5.A05.1.454.CMB.2.raw
  modified_base (262)..(262): a, c, t, g, unknown or other
  modified_base (282)..(283): a, c, t, g, unknown or other
  modified_base (289)..(289): a, c, t, g, unknown or other
  modified_base (294)..(294): a, c, t, g, unknown or other
  modified_base (333)..(333): a, c, t, g, unknown or other
tcagtcgatcacgtcacgaccggtgctcgatttagatagatagacaggggggggtctcaggaggcagcgctctcaggacatctccaccatggcctgggctctgctgctcctcaccctcctcactcaggcacagggtcctgggcccagtctgccctggctcagcctgcctccgtgtctgggtctccgtggacagtcgatcaccatcctcctgcactaggaaccagcagtgactattggtacttataacatgtctctgtaccanatcaccagacacgccccaannatattngactnagtagtccgccttcgtagggttctgtactccgtacttcncgtacggctaccgaagtcgtacggaccaaacgacccgtaccctccctacgaccctatccgttaccgtcgggtccttaccgtagggttaggacggtaacggacgtcgtacggtacttacgttaagttcgcccgtaccttaccgaaccgtagtaacggtaactccgggtaagggggtttacggggtttacgggacgggtaacggggaaacctaaacgggttccggtacccggttacgtaacgggtaccgtaaccggacccgttaacggcccgttcccggacccccgttacgggttacccaccgtttcccggttcccgttcccccggtttacccccg

SEQ ID NO: 408038 - DNA, 542 bp, Homo sapiens
  misc_feature: GZ8MTXP02IPLI7.38.5.A05.1.454.CMB.2.raw
  modified_base (246)..(246): a, c, t, g, unknown or other
  modified_base (296)..(296): a, c, t, g, unknown or other
  modified_base (380)..(380): a, c, t, g, unknown or other
  modified_base (421)..(421): a, c, t, g, unknown or other
  modified_base (435)..(435): a, c, t, g, unknown or other
  modified_base (539)..(542): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacngtctgagagctgacggacacggccttgtaacttacgtgtgactaaaagtnttttagagtttagagtagtaaggtctaacgtatacggtatggaactcgtggggccccaagggccacggtcaccgtctcctcacnccctaccaccgacgggcctagtcggtcctcccccgtggccnccctgctccaggcnccaccgtcgagacgacacgacgccgccgtgggctcgacgtgcaaacggtcttaacgtcgacgtgacgtcgacgtgacgtcggctggacaaggcgactagtacgnnnn

SEQ ID NO: 408039 - DNA, 548 bp, Homo sapiens
  misc_feature: GZ8MTXP02IUILK.38.5.A05.1.454.CMB.2.raw
  modified_base (219)..(219): a, c, t, g, unknown or other
  modified_base (254)..(254): a, c, t, g, unknown or other
  modified_base (289)..(289): a, c, t, g, unknown or other
  modified_base (450)..(450): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctcgtgtctgggtctcctggacagtcgatcaccatctcctgccatggaaccngcagtgacgttggtgttataattgctctgtaccancgcaccggcaactcgaccccaaatcatgtatttangtgtcactcactcggcctcgtagggtttctaatcgtccttctcgtgcctatccaagtcgtacggcaaaccgccgtccctccacgaccatccgtcgtgggcctcgagtctaggacggtacgtagtacttaatttattctgtctacgttcataactcaaaccngaacaactctactagtcgttaacgtcgggacggtaacggaacacggtcctacgccgttacaacgtcgaaccgtccgaacggtccctccggtcccctcg

SEQ ID NO: 408040 - DNA, 614 bp, Homo sapiens
  misc_feature: GZ8MTXP02JYHBN.38.5.A05.1.454.CMB.2.raw
  modified_base (295)..(295): a, c, t, g, unknown or other
  modified_base (608)..(608): a, c, t, g, unknown or other
  modified_base (613)..(613): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaagaattccctgtatctaacaaatgaaacagtctgagagctgaggaccacggccttagtattactgtgacaaaagtnttttagagtttagagtagtaaggtctatactagtatggacgtcgtgggacccaagggaccacggtccaccgtcctcctcacgccctaccaccgaacgggcccagtccgtcccttcccccgtgcccgtccctgcctaccgaggacgaccacccgtcgaacgacgaccacgacggccggcccgtggggcctcggcccgtagggtaccgaaacgggtacccttaccgttccgaaccggttcgaaaccgttccggacgttcgggaacgggtccggggtccgtaacgggaccgaaaacgggccgacgtaacgtggacncgacng

SEQ ID NO: 408041 - DNA, 756 bp, Homo sapiens
  misc_feature: GZ8MTXP02F3NTQ.38.5.A05.1.454.CMB.2.raw
  modified_base (294)..(294): a, c, t, g, unknown or other
  modified_base (442)..(442): a, c, t, g, unknown or other
  modified_base (754)..(754): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaagggccgattcagcatctccagagacaacgccaaagaacttccctagtatctaacaaatgaactagtctgagagctgagacacgccttgtattactgtgacaaaagtntttgagtttagagtagtagggtctactacgtacggtatcggagtcggtcgggacccgtaacggggacccacgggtccaacggtcctcctcgaacgcctacccaaccgtaacggggcccctaagtcccgggttaccctttccccccggngggtcccccgcccccgtttagcccgttacccggaacgggttacgaccccgaaccccgttacccggaaggaaccgccaaaaccggtcggaccccgggtcccggtaccgggggtccctttccgggaacccgttacgggggttacccgaaaaccggttacccgtttaaacccgtttaccccggtaccggttaggggttaaccctaccgggtaaaccccggtttaggtaccgggggaccgggggtttcccgtaagggggacccgggaaaaacgggggtttccccgggtaaaacgtaaacgggtagaccgacgtacncg

SEQ ID NO: 408042 - DNA, 630 bp, Homo sapiens
  misc_feature: GZ8MTXP02FS96Z.38.5.A05.1.454.CMB.2.raw
  modified_base (245)..(245): a, c, t, g, unknown or other
  modified_base (253)..(253): a, c, t, g, unknown or other
  modified_base (279)..(279): a, c, t, g, unknown or other
  modified_base (288)..(288): a, c, t, g, unknown or other
  modified_base (606)..(606): a, c, t, g, unknown or other
  modified_base (627)..(629): a, c, t, g, unknown or other
tcagtcgatcacgtcacgaccggtgctcgatttagatagatagacagggaattcttggcgttgtctctggattcagctttgatgattatggcatgcactgggtccggcaagctccagggaaggcctggagtgggtctcaggtattagttggaacagtggtaggataggctatgcggactctgtgaagggccattcagcatctccagagacaacgccaaagacttccctgtatctacaaatgaacngtctgagngctgagacacggccttgtattctgtnacaaaagtntttgagtttagagtagtaggtctactacgtacggtatggacgtcgtggggaccccaacggggtaccacggggtaccaccggttcctccgttcgacgccccttaccgacccgaaacggggtccccctagtcccgggtttacccttccccccgtcggtcccgcccccgttgtacctaccgacggggtactacccgaccgttaccccggagtacgcccgtaacgacgggtcccgcccgttaggggccttcggcccgtttacgggacaaaccgggtacttaccgttcccgaggtcgaacgtcgtacgtgacggcgggtaccnggacgaaggtcacacgtagcnnng

SEQ ID NO: 408043 - DNA, 628 bp, Homo sapiens
  misc_feature: GZ8MTXP02FNKW5.38.5.A05.1.454.CMB.2.raw
  modified_base (222)..(222): a, c, t, g, unknown or other
  modified_base (261)..(261): a, c, t, g, unknown or other
  modified_base (269)..(269): a, c, t, g, unknown or other
  modified_base (344)..(344): a, c, t, g, unknown or other
tcagtcgatcacgtcacgaccggtgctcgatttagatagatagacaggggtggggtctcaggaggcagcgctctcaggacatctccaccatggcctgggctctgctgctcctcaccctcctcactcagggcacagggtcctgggcccagtctcgccctggctcagcctgcctccgtgtctgggtctcctggacagtgatcaccatctctgcactcggaaccngcagtgtacgttggtagttataatttgtctctgtaccangcaccggnaactcgaccccaaaatcatgtatttagtgagtcactcactccggcctcgtagggtttactaagtccgtcttactntgacataccagtcgtcgaccaaaccgccgtcccgtcctacgaacctgttcctcgtacgggtccctcgtacggccgttagggaacggtacggtacggtaactttaaagtttactttctaggtacttacgtttacaaattaacctaaaccaaaccgtagaaccaacctacctacgtagtaccttacggttacgggacgggtaacgggaaacctacggtaccgtacggtaacccgtaacgttaaacgaccgtaacccggaccgtaacggcccgtacccgtccccccg

SEQ ID NO: 408044 - DNA, 714 bp, Homo sapiens
  misc_feature: GZ8MTXP02JNIV7.38.5.A05.1.454.CMB.2.raw
  modified_base (710)..(710): a, c, t, g, unknown or other
  modified_base (712)..(712): a, c, t, g, unknown or other
  modified_base (714)..(714): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtggaagggccgattcagcatctccagagacaacgccaaagaacttccctagtatctaacaaatgaacagtctgagagctgaggacacggtccttgtacttactgtagactaaaagtattttagaggtttaggagttaaggttaaagggttacttaacgtacgttacggtagtagggtacgtcggtacggggaccccgaacggggaccacggtccaccgtctcctcacgtaccctaccgaacccgaacggggccccagttaccccgggttaccccttcccccgtacgggcccgtcccccgttcgcccttacccggaaccgggacgtacccccgtacccgtacccggaacgtaccgaccgtaaaccggacccggggtccccgggacccccggttcgggggaccttaccggtcccggtacggggttaaccgaaacgggttaccccttaacccgttacccgacggttaacggtctaccgggtaacgtcgggacgggtcggccgtagggaccgaacggtccgagtagacgcncncn

SEQ ID NO: 408045 - DNA, 536 bp, Homo sapiens
  misc_feature: GZ8MTXP02JNQHW.38.5.A05.1.454.CMB.2.raw
  modified_base (294)..(294): a, c, t, g, unknown or other
  modified_base (370)..(370): a, c, t, g, unknown or other
  modified_base (372)..(372): a, c, t, g, unknown or other
  modified_base (455)..(455): a, c, t, g, unknown or other
  modified_base (497)..(497): a, c, t, g, unknown or other
  modified_base (533)..(536): a, c, t, g, unknown or other
tcagtcgatcacgtcacgaccggtgctcgatttagatagatagacagggaattcttggcgttgtctctggattcagctttgatgattatggcatgcactgggtccgcaagctccagggaaggcctggagtgggtctcaggtattagttggaacagtggtaggataggctatgcggactctgtgaagggccattcagcatctccagagacaacgccaaagaatccctgtatcaacaaatgaacagtctgagagctagaggacacggtccttagtacttagtgtagaacaaaagtnttttgaagtttagagtagtaagggtctaactactaggtatggacgtgtcggggcccaagggccacgtcaccgttcncncacgctccacgtagccatcgtccctcccgtgctcccgtgcctccaggcgcctaccgaccgagcgacgacacggcccgtcccgnggcgtcgtcgtcggtaccaagtaccgtctacccgatcggacncgaacctgggcgccggctggacaagccgactgacgnnnn

SEQ ID NO: 408046 - DNA, 538 bp, Homo sapiens
  misc_feature: GZ8MTXP02GG8PZ.38.5.A05.1.454.CMB.2.raw
  modified_base (275)..(275): a, c, t, g, unknown or other
  modified_base (287)..(287): a, c, t, g, unknown or other
  modified_base (298)..(298): a, c, t, g, unknown or other
  modified_base (387)..(387): a, c, t, g, unknown or other
  modified_base (422)..(422): a, c, t, g, unknown or other
  modified_base (426)..(426): a, c, t, g, unknown or other
  modified_base (429)..(430): a, c, t, g, unknown or other
  modified_base (434)..(434): a, c, t, g, unknown or other
  modified_base (437)..(437): a, c, t, g, unknown or other
  modified_base (439)..(439): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (449)..(449): a, c, t, g, unknown or other
  modified_base (495)..(495): a, c, t, g, unknown or other
  modified_base (533)..(533): a, c, t, g, unknown or other
  modified_base (536)..(538): a, c, t, g, unknown or other
tcagtcgatcacgtcacgaccggtgctcgatttagatagatagacagggaattcttggcgttgtctctggattcagctttgatgattatggcatgcactgggtccggcaagctccagggaagggcctggagtgggtctcaggtattagttggaacagtggtaggataggctatgcggactctgtgaaggccgattcagcatctccagagacaacgccaaagaacttccctagtactctaacaaatgaaactgtctgagagctgagacacggcttntacttactgtanaactaaaagtnttttagagtttagagttaagtaacggtctaacgtacgtacggtatggacgtggtcggggaccccgaaagggcccacggtcaccgtctcncacgcctccaacgacggccagtccgtccctcccgngccnccnnctcngcncncncgnacncncgagccgcctgggctcgccgtggacaacggtcttacctcgcggtanacgcgacgtggacggcggcgtggaccgaaggcgacagngcnnn

SEQ ID NO: 408047 - DNA, 574 bp, Homo sapiens
  misc_feature: GZ8MTXP02HXOK6.38.5.A05.1.454.CMB.2.raw
  modified_base (201)..(201): a, c, t, g, unknown or other
  modified_base (293)..(293): a, c, t, g, unknown or other
  modified_base (442)..(442): a, c, t, g, unknown or other
  modified_base (486)..(486): a, c, t, g, unknown or other
tcagtcgatcacgtcacgaccggtgctcgatttagatagatagacagggggggtctcaggaggcagcgctctcaggacatctccaccatggcctgggctctgctgctcctcaccctcctcactcagggcacagggtcctgggcccagtctgccctggctcagcctgcctccgtgtctgggtctcctggacagtcatcaccntctctgcactggaaccagcagtgtacgttggtgttataattgtctctggtaccaacagcaccggcaatcgaccccaaaatcaatgtatttangtacggtacactcagtccggcctgtacgggtttcaagtcgtccttctctgcactaccaagtcgtaggacaaccgtaccggccctcccgtacgaaccctactcgtcgtcgggtctcccgaaggtcctaggacggacgaggtacttaattntttctgactagttacatactaacgaacacgacaactcgtactancgttaacgtcgggtacggacggtacccaagccgtacgtacccgtactaacgtaccgacgaccccgtaacggcctccgacccccgttcg

SEQ ID NO: 408048 - DNA, 513 bp, Homo sapiens
  misc_feature: GZ8MTXP01DSN3R.44.28.C06.1.454.CMB.2.raw
  modified_base (192)..(192): a, c, t, g, unknown or other
  modified_base (220)..(220): a, c, t, g, unknown or other
  modified_base (442)..(442): a, c, t, g, unknown or other
  modified_base (485)..(485): a, c, t, g, unknown or other
tcagacagtatatacacgaccggtgctcgatttagagctcacgtattgggtttggggcacaagaggcagcactcaggacaatctccagcatggcctggtctcctctcctcctcactctcctcgctcactgcacagggtcctgggcccactctgtgctgacgcagcccgccctcagtgtctggggccccgggnagagggtcaccatctcctgcactgggancagatccaacatcggggacagattctgatgtccactggtaccaacaccttccaggaacagcccccaaaactcctcatctttggtaacactatcggccctcaggggtccctgaccgattcctctggctccaagtctggcacctcagcctccctggccatcactgggctccaggctagaagatgagggtgattattactggcctagtcctatgacagcagcctnagtggttgggtgttcgggcggagggaccaagcttggccgttcngggtcaagcccagggctcgccccgtcgg

SEQ ID NO: 408049 - DNA, 565 bp, Homo sapiens
  misc_feature: GZ8MTXP01EFH9H.44.28.C06.1.454.CMB.2.raw
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcacgaccccagaaacacgacccccaaatcatttattatgcgtacaatcgttccgccctttccggtgtccctgacgcgtcttctccgtgggtaccaagtctggaccaaacgccggtccctccctgaccctatctcgtcgggcctcgaggctgaggacgaggtctagacttattactgacagtctactaataataacgaaggtaggaaacctactttaactagttccggcgcgaagggaaccaagctacgaccgtcgtaggttcgcgcccgaaggcctcgcccctggcctcgttcgtcccg

SEQ ID NO: 408050 - DNA, 644 bp, Homo sapiens
  misc_feature: GZ8MTXP01A8I7F.44.28.C06.1.454.CMB.2.raw
  modified_base (189)..(189): a, c, t, g, unknown or other
  modified_base (222)..(222): a, c, t, g, unknown or other
  modified_base (233)..(233): a, c, t, g, unknown or other
tcagacagtatatacacgaccggtgctcgatttagagctcacgtattgggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcactgganccagcgtaatnttcttagtcttaacttgtctctggtatcaacatcatccagtaaacgccccaaactcatcatctatgaggctataagacgccctgtagggtttctaatcgcttccactcgccctacaacgtcccggactaacgaccggtccctccctagacctaactctcgtcggctccgaggctaggacggacgaggtctagtattattagttgttgcttctaaggtacttcggttcgtcgtctaacttacttaaccgtttagttcggtttccgttaacggggtaaacggttcgggggttaaacccgtaaacgggttccccgtaaaccgggttcccttaacgggggttccaacccgggtaaccccgaaacgggcccctaaacccccggtacttccggttaacccgttaaccgtttcccccg

SEQ ID NO: 408051 - DNA, 587 bp, Homo sapiens
  misc_feature: GZ8MTXP01D4EIV.44.28.C06.1.454.CMB.2.raw
  modified_base (225)..(225): a, c, t, g, unknown or other
  modified_base (371)..(371): a, c, t, g, unknown or other
  modified_base (435)..(435): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagccctccctccgtgtccgggtctcctggacagtcagtcaccatctctgcactgaaccanagtgacgtcggtcgtttgacgtgtctctggtaccagcacgacccagaaacacgacccccaaatctattattatgcgtcaatcgttccgtccccgtttccggtcgtccctgacgtcgtcttctccgtggtacaagtctggaacaacnccggcctccctgacctatctcgtcgggcctccgaggctggaggacgaggctagtattattacgngacacgtctactaagtaactaacgaaggtaacgtaacttacgtttaacgtacgtccggacgacgaacgggaacctaacgcgtacgaccgtacgtacgttacgaccgacccgaacggtcctcccgtccccgtcgttacctccgttccgtcccg

SEQ ID NO: 408052 - DNA, 567 bp, Homo sapiens
  misc_feature: GZ8MTXP01C94PO.44.28.C06.1.454.CMB.2.raw
  modified_base (383)..(383): a, c, t, g, unknown or other
  modified_base (524)..(524): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctctgcactggaaccaacagtgacgtcggtcgttttgaccgtgtctctggtaccagcacgaccccagaaacacgaccccccaaatcatttatttatcgcggtcaattcgttccgcccctttccggtgtcccctgacgccgtcttcctccgtgggtaccaagtcctggaaccaacnccggccctccctgaccatctcgtcgggcctcgaggctgaggacgaggctagattattacgtgacagctcaatataacaagtaggaactactttacagttcggacgcgagggaacctaagctcgaccgttccgtacggttcncgacccgaaggctccgcccctggttcctaaccttccgttcccg

SEQ ID NO: 408053 - DNA, 590 bp, Homo sapiens
  misc_feature: GZ8MTXP01ECBOY.44.28.C06.1.454.CMB.2.raw
  modified_base (190)..(190): a, c, t, g, unknown or other
  modified_base (224)..(224): a, c, t, g, unknown or other
  modified_base (466)..(466): a, c, t, g, unknown or other
  modified_base (572)..(572): a, c, t, g, unknown or other
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaaatattcttagtcttaactttgtctcctggtatcaacatcatccaaggtaaacgacccccaaactcatcatctatgacgcctaagtaagacggtccctcgtagggtttctaatcgtcttccactcgcctccaagtcccggacaaccgaccggtccctccctagaacctaactctcgtcgggcctccgaggtcctaggacggaacgaggtctagtatttattattgttgccttanagtattggttccgtcgctatctactttatcgttcgttacggaaggtcgggacctaacgggttcaaccggttcgttaggttcacgaacccaacggccccaaaccccnttacgtccttaacttccg

SEQ ID NO: 408054 - DNA, 510 bp, Homo sapiens
  misc_feature: GZ8MTXP01DR9B8.44.28.C06.1.454.CMB.2.raw
  modified_base (223)..(223): a, c, t, g, unknown or other
  modified_base (267)..(267): a, c, t, g, unknown or other
  modified_base (361)..(361): a, c, t, g, unknown or other
  modified_base (499)..(499): a, c, t, g, unknown or other
  modified_base (506)..(506): a, c, t, g, unknown or other
tcagacagtatatacacgaccggtgctcgatttagagctcacgtattgggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcgtaatattcttagtcttaactttgtctcctggtatcaanatcatccaagtaaacgcccccaaatcatcatctatgagctataagagccctgagggtttcaatcgcttccactcgcctccaagtcccggcaacncggcctcccctgacaatctctgggctccgagctgagacgaggctgattattattgttgctcagtatgttcgtcgctatctattatgtcttgggaatgggaccaaggttcacgtcaggttcacgcccaagcccaacccnttcgtcnctcc

SEQ ID NO: 408055 - DNA, 651 bp, Homo sapiens
  misc_feature: GZ8MTXP01CTZ63.44.28.C06.1.454.CMB.2.raw
  modified_base (226)..(226): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagccctccctccgtgtccggtctcctggacagtcagtcaccatctctgcactggaaccaanagtgacgtcggttcgtttgaccgtgtctctggtaccagcacgaccccaagaaacacgacccccaaatctaatttattatcgtacggtactaattcgttccgtccccgtttccgggtcgtcccctgacgccgtcttcgtccgtcgggtaccaagtctacggaaccaacgccggtccctacccgtcgaccctactccgtcgtcgggtcctccgaggtcgtaggacgggacggaggtccttaggtaatttacgttactgacaagtctactaattaactaacgtaaaggtacggtaaacttacgtttaaacttacgttccggacgtacgaacgggaacctaaggccgtacggacccgttacgtacggttaccgacgacccgaacggtcctcccggacccccgttcggttaccctccgttccgttccccg

SEQ ID NO: 408056 - DNA, 592 bp, Homo sapiens
  misc_feature: GZ8MTXP01BIFWU.44.28.C06.1.454.CMB.2.raw
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaaacacgcccccaaatcattattatgcgtcaatgttcgcccttcggtgtccctgagcgcttctcctgggtcaagtctggacaacgcggcctccctgacccatctctcgggcctccgaggctggaggacgaggctgattattactgcagctcaatatacgaaaggtcgggaaactacgtttactagttcgggaccgacgaggggaacccaaaggcccgttcgaaacccggttcccgtaaacgggttccgacgggttacccccaaagggggcccttccgggcccccctcggggttcctaacccttcccgttccccggg

SEQ ID NO: 408057 - DNA, 561 bp, Homo sapiens
  misc_feature: GZ8MTXP01AC3VX.44.28.C06.1.454.CMB.2.raw
  modified_base (226)..(226): a, c, t, g, unknown or other
  modified_base (302)..(302): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgtcctggctcagcctccctcgtgtccggtctcctggacagtcagtcaccatctcctgcactggaaccaacngtgacgttcggttcgttttgaccgtgtctccgtggtaccagcagaccccagaaacacgcccccaaatcattattangcgtcaatgttccgcccttccggtcgcccctgacgcgtcttctcctgggtcaagtctggaccaacgcggccctccctgaccctatcctcgtcgggcctccgaggctggaggacgagggctagtattattactgcagctacaatataacgaaggtagggaaactactttaactagttcggcgacgagggaaccaagctcgaccgtctagggttcacggcccaagggcctccgccccgtcgttcctaaccgttcgttcccg

SEQ ID NO: 408058 - DNA, 619 bp, Homo sapiens
  misc_feature: GZ8MTXP01EF33L.44.28.C06.1.454.CMB.2.raw
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtcccgggtctcctggacagtcagtcaccatctcctgcactaggaaccaacagtgacgttcggtcgtttgaccgtgtctcctggtaccagcacgacccagaaacacgaccccaaatcattattatgcggtcaatcgttccgtcccgtttccggtctcccgtgacgcgtcttctcgtcgggtcaagtcgtggaaccaacgccggcctcccgtgacctactctcgtacgggcctcgaggcgtaggacggacgacggctagtaattactactgctagctactaatactaacgaaggtcggtaaacttactttacgtaacgttccggcgtaacggacgggaacccaaaggcctacggttacccgtacgttaacgggccaccggacccaacggggtccctcccggtcccccgtcgggttaccctaacggtttcccgttaacccccg

SEQ ID NO: 408059 - DNA, 565 bp, Homo sapiens
  misc_feature: GZ8MTXP01DDALQ.44.28.C06.1.454.CMB.2.raw
  modified_base (225)..(225): a, c, t, g, unknown or other
  modified_base (299)..(299): a, c, t, g, unknown or other
  modified_base (368)..(368): a, c, t, g, unknown or other
  modified_base (477)..(477): a, c, t, g, unknown or other
  modified_base (513)..(513): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagccctccctccgtgtccggtctcctggacagtcagtcaccatctctgcactgaaccaangtcgacgtcgtcgtttgaccgtgtctcctggtaccagcagaccccagaaacacgacccccaaatcattatttangcggtcaatcgttccgccctttccggtcgccctgacgcgtcttctccgtgggtcaagtctcggacaacnccggcctcccgtgacctatcctcgcgggcctcgaggctggaggacgaggctagatttatactggcagctcattataacgaagtcgaactaacgtttactagttcggacncgagggaacaagcgtacgaccgttcgtaaggttccncgaccccgtaaggccctcggacccccgtggacctaaccgttccttaaccccg

SEQ ID NO: 408060 - DNA, 575 bp, Homo sapiens
  misc_feature: GZ8MTXP01C4TD2.44.28.C06.1.454.CMB.2.raw
  modified_base (226)..(226): a, c, t, g, unknown or other
  modified_base (268)..(268): a, c, t, g, unknown or other
  modified_base (285)..(285): a, c, t, g, unknown or other
  modified_base (400)..(400): a, c, t, g, unknown or other
  modified_base (433)..(433): a, c, t, g, unknown or other
tcagacagtatatacacgaccggtgctcgatttagagctcacgtattgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggacnccagcgtaatattctagttcttaactttgtctctgtatcaanatcatccaaggtaaacncccccaaatcatcatctatgaggcctaataagacgtccctcgtagggtttactaatcgcttccactcgcctcaacgtcccgcaacacggccctcctagacatctctgggctccgngctgaggacgaggctagtaattattattgttcncgttacagtattcgttcgtcgctatctaactttatgtacgttagggaaaggtcgggaactaacgggttcctaccggtcgttacgggttcaacggtccccgaaacggtccccaaaccctacgacttaacccgaacgtttcccg

SEQ ID NO: 408061 - DNA, 674 bp, Homo sapiens
  misc_feature: GZ8MTXP01BY077.44.28.C06.1.454.CMB.2.raw
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgtttgaccgtgtctctggtaccagcagaccccagaaacacgacccccaaactcattattatgcggtcaatgttccgtccctttccggtcgtccctgacgcgtcttctccgtggggtccaagtctcggacaaccgccggccctccccgtgaccctatcctcgtcgggcctccgaggctggacggacgagggtctagtattacttactgacagtctcagtatacgtaaggtaggtaaccttaacgttttaacgtacgttaccgggcgtaccggaacggggtaacctaaacgggttccgttaccggaaccccggttacccgttaacggggttaccccaaccgggacccccgtaaaccggggtccccgttaaccccgggtcccccccccggttcgggggttaccccttaaccccggtttccccggttttccccccggg

SEQ ID NO: 408062 - DNA, 583 bp, Homo sapiens
  misc_feature: GZ8MTXP01AZ150.44.28.C06.1.454.CMB.2.raw
  modified_base (191)..(191): a, c, t, g, unknown or other
  modified_base (226)..(226): a, c, t, g, unknown or other
  modified_base (445)..(445): a, c, t, g, unknown or other
tcagacagtatatacacgaccggtgctcgatttagagctcacgtattgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcacgtggacnccagcggttaaattattcttagtctttaactttgtctcctggtatcaacatcatccaaggtaacgacccccaaactcatcatctatgagacctataagacggtccctcgtaggggtttactaagtcgtcttccactcgccctaccgaacgtcccggaccaaccgaccggtccctccctagactaactctcgtcgggcctccgagggctaggacggacgngtctagtatttattattgtagcgtcagtatgttcgctctactctacttatcgttcgttacgggaagtcgggacctagggttcctacggtcttacggttcacggcccaacgccctaacccgattcgtccttcgttcccg

SEQ ID NO: 408063 - DNA, 581 bp, Homo sapiens
  misc_feature: GZ8MTXP01AHIQM.44.28.C06.1.454.CMB.2.raw
  modified_base (191)..(191): a, c, t, g, unknown or other
  modified_base (225)..(225): a, c, t, g, unknown or other
  modified_base (236)..(236): a, c, t, g, unknown or other
  modified_base (310)..(310): a, c, t, g, unknown or other
  modified_base (313)..(313): a, c, t, g, unknown or other
tcagacagtatatacacgaccggtgctcgatttagagctcacgtattgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaacttgtctcctggtatcaacatcatccaagtaaacgcccccaaatcatcatctatgagctanagngcctgagggttcatcgcttccactcgcctaccaagtcccggacaaccgaccggccctcccgtcgaactaactctcgtcgggctccgaggctaggaggacgaggtctagtattattagttgttcgctcgtagtattgttccgcgtcacttctactttatcgttccgttgggaagtcgggaccgtaaacggttccgtaacccggttccgttacggttccacggccccgaacggtccccaacccctcgttccgtccgttaacctttccccg

SEQ ID NO: 408064 - DNA, 610 bp, Homo sapiens
  misc_feature: GZ8MTXP01CFVNT.44.28.C06.1.454.CMB.2.raw
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtccggtctcctggacagtcgatcacatctctgcactgggtccagcaatgacattgggagatataacttgtctcctgtatcaacaacatccaggaccaaacgcccccaaactctacttacttttgagtccagtgacgcggccgtcgaggttgttactaactcgtcttctctggacctccgaagtcgtcggcccacgaccggcccttcctgtccgatccgtcgtcgggccgtccggcctaggacggacgcggtctcgtacttacgttacggtcggtcggtcttactacttttaacaacttcgttagacgttacgtttggggtcggtttcgggcggggtacggttacgtccgaccgttacggtccgttccgttaacgggttccaacggtaccccgtaagggccctcccggttcccccgtcggttcctaaccccg

SEQ ID NO: 408065 - DNA, 581 bp, Homo sapiens
  misc_feature: GZ8MTXP01A1DRP.44.28.C06.1.454.CMB.2.raw
  modified_base (192)..(192): a, c, t, g, unknown or other
  modified_base (395)..(395): a, c, t, g, unknown or other
  modified_base (461)..(461): a, c, t, g, unknown or other
  modified_base (476)..(476): a, c, t, g, unknown or other
tcagacagtatatacacgaccggtgctcgatttagagctcacgtattggggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcactggagccagcgtaatattcttagtcttaactttgtctcctggtatcaacatcataccaaggtaaacgcccccaaactcatcatctatgaggacctataagacggccctgtagggtttactaagtcgcttccactcgcctaccaacgtcccggacaaccgacggtccctacccgtnaccgaacttcgtctgggcctccgaggctaggacggacgaggctagtatttattacttgttacgctntagtatcgttcgtcntattcacttatgtcttagggaagtcgggttacagggttccaaccgttcgttacggttccacggaacccaacggccctaaacccgcgttcgtccttaacgttcccg

SEQ ID NO: 408066 - DNA, 638 bp, Homo sapiens
  misc_feature: GZ8MTXP01EDKU3.44.28.C06.1.454.CMB.2.raw
  modified_base (228)..(228): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagccctccctccgtgtccgggtctcctggacagtcagtcaccatctcctgcactggaaccaanagtgacgtcggtcgtttgaccgtgtctcctggtaccagcacgacccagaaacacgacccccaaatcattattatgcgtcaatgttccgtcccttccggtctccctgacgcgtcttctccgtgggtccaagtctcggaccaacgccggtccctccctcgacctatctcgtcgggcctccgaggtctggaggacgaggctagtattatactgacagctactataataacgaaggtacgggtaaacttacgtttaactagttccgggacgtaccggaacggggaacccaaaggttccgttacggttaaccccggttaccgtaacgggttacccgaccggaccccggtaacgggtcccttccccgggtcccccccgttacgggttccccttaaccgtttcccgttttcccccgg

SEQ ID NO: 408067 - DNA, 540 bp, Homo sapiens
  misc_feature: GZ8MTXP01BQHWG.44.28.C06.1.454.CMB.2.raw
  modified_base (374)..(374): a, c, t, g, unknown or other
  modified_base (532)..(532): a, c, t, g, unknown or other
tcagacagtatatacacgaccggtgctcgatttagagctcacgtattgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcgtaatattcttagtcttaactttgtctcctggtatcaacatcatccaaggtaaacgcccccaaactcatcatctatgagcctatagacgcctgagggtttctaatcgcttccactgcctccaagtcccgcaacacggccctccncgacaatctctggctccgagctggaggacgagctagtattattattgttgctcagtatgttcgtcgctatctacttattgtcgtggaaggttcggacctaaacggttccgaccgtcttaacggttcacggaaccccaacggcccaaccccattcgtcncgttcccg

SEQ ID NO: 408068 - DNA, 586 bp, Homo sapiens
  misc_feature: GZ8MTXP01EN6M9.44.28.C06.1.454.CMB.2.raw
  modified_base (192)..(192): a, c, t, g, unknown or other
  modified_base (226)..(226): a, c, t, g, unknown or other
  modified_base (309)..(309): a, c, t, g, unknown or other
  modified_base (566)..(566): a, c, t, g, unknown or other
tcagacagtatatacacgaccggtgctcgatttagagctcacgtattggggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcacgtgganccagcgtaatattcttagtcttaactttgtctctgtatcaacatcatcaagtaaacaccccaaatcatcatctatgagactanaagcgcctgtaggtttctaatcgtcttccactcgcctacaacgtcccgacaaccgccggccctcccagaacctactcgtcgtcgggctccgaggctaggaggacgaggtctagtatttattagttgttcgacgttgaaggttattcggttcgtcgctatcttacttagtcgttcgttacgggaagttcggggaacctaaggttcccgaaccggttcgttacggttccacgtaaccccgaacggcccctaaaccccgnttacgtccttaacgttcccg

SEQ ID NO: 408069 - DNA, 635 bp, Homo sapiens
  misc_feature: GZ8MTXP01DTHG9.44.28.C06.1.454.CMB.2.raw
  modified_base (226)..(226): a, c, t, g, unknown or other
  modified_base (278)..(278): a, c, t, g, unknown or other
  modified_base (300)..(300): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagccctccctccgtgtccggtctcctggacagtcagtcaccatctctgcactaggaaccanagtgacgtcggtcgtttgacgtgtctctggtaccagcacgaccccagaaacncgacccccaaatcatttattangcgtactaattgttccgccctttccggtgtccctgacgtctcttcgtccgtcgggtaccaagtcctaggaacccaaacgccggtccctaccccgtacgaacccctgttccgtcgtacgggtcctccgaaggtccgtaggaacgggacggaggtctagtaattacttacgtgactacgtctactaagtaacgtaacgtaacggtacggtaaactttacgtttaacgtcggtccggacgacggaacgggtaacaacggttccgtacggttaccgtacgtacggaccgaccgaccgaacggtccgtccgtccccgtcgttacctccgttccgttcccg

SEQ ID NO: 408070 - DNA, 595 bp, Homo sapiens
  misc_feature: GZ8MTXP01CITWW.44.28.C06.1.454.CMB.2.raw
  modified_base (192)..(192): a, c, t, g, unknown or other
  modified_base (226)..(226): a, c, t, g, unknown or other
  modified_base (269)..(269): a, c, t, g, unknown or other
  modified_base (283)..(283): a, c, t, g, unknown or other
  modified_base (295)..(295): a, c, t, g, unknown or other
  modified_base (302)..(302): a, c, t, g, unknown or other
  modified_base (471)..(471): a, c, t, g, unknown or other
tcagacagtatatacacgaccggtgctcgatttagagctcacgtattgggtttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcncctggacagtcggtcaccatctcctgcactgganccagcgtaatatttctagtcttaacttgtctcctgtatcaacntcatccaagtaacnccccaaactcancatctangagctagtaacgcgcctgtaggtttcaagtcgtcttcctcgtacgctacaagtcgtacggccaaccgaccggtcccttcccgtacgaacctacttcctcgttcgggacctccgaggtctagggaacggtacgaggtctagtaacttactagtcgacacgtctacaatanaacaagcagcacgtcctaccttgtcgtacgttacggaacgttcggggtaaacctacggttccacccggttcgtaacgggaccaaccgtccccaaacggaccccctaaaccccgttcgttaaccg

SEQ ID NO: 408071 - DNA, 580 bp, Homo sapiens
  misc_feature: GZ8MTXP01BN1UR.44.28.C06.1.454.CMB.2.raw
  modified_base (281)..(281): a, c, t, g, unknown or other
  modified_base (401)..(401): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtcccgggtctcctggacagtcagtcaccatctcctgcactggaaccacagtgacgtcggtcgtttgaccgtgtctctggtaccagcacgaccccagaaaccncgacccccaaatcatttattatgcgtcaattcgttccgcccctttccgggtgtccccgtgacgtcgtctttctccgtcggggtccaagtctggaccaacgccggtccctccctcgacctntctcgtcgggctccgaggctggacggacgaggctagattacttacgtgcacgctactatactaacgtaaggtagggtaacttactttacgtacgttcggcgacgagggaaccaagctacgaccgtccgtaggttcgcgcccgaaggcctccgcccctcggttcctaaccgttcgtcccg

SEQ ID NO: 408072 - DNA, 702 bp, Homo sapiens
  misc_feature: GZ8MTXP01CKGU0.44.28.C06.1.454.CMB.2.raw
  modified_base (191)..(191): a, c, t, g, unknown or other
  modified_base (266)..(266): a, c, t, g, unknown or other
  modified_base (308)..(308): a, c, t, g, unknown or other
tcagacagtatatacacgaccggtgctcgatttagagctcacgtattggggtttgggggggtcacaagaggcagcgctctcgggacgtctccaccatggcctgggctctgctgctcctcactctcctcacccaggacacagggtcctgggcccagtctgccctgactcagcctgcctcgtgtcgtgggtcncctggacagtcgtcaccatctcctgcacgtgagccagcgtaatattcttagtcttaacttgtctctgtatcaacntcatcaagtaaacgacccccaaatcatcatctatgagcctanaagacgcctcgtagggttctaatcgtcttaccactcgtaccctacgaacgtcccggactaaccgaccggtccctacccgtacgaactaacttccgtaccgttacggggccttacccggaagggtcgttacgggaacgggaacggtacggtaccttaggtaatttaaagtttgtttagttcgtcttaacgtagttacgttacggttccggttcgactacttacccttaactttagtcggtttaccgttaaccgggtaaagggttaccggggttaaaccgtaaaccgggttcccgtaaacccgggttacgttacggttcccgaaccggtaaccccgaaaaccgggtaaccccctaaaccccgtacgttaccgtttaacccgaaccgttttcccccg

SEQ ID NO: 408073 - DNA, 653 bp, Homo sapiens
  misc_feature: GZ8MTXP01BNNZ5.44.28.C06.1.454.CMB.2.raw
  modified_base (192)..(192): a, c, t, g, unknown or other
tcagacagtatatacacgaccggtgctcgatttagagctcacgtattggggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcgtaatattcttagtcttaactttgtctcctggtatcaacatcatccaaggtaaacgcccccaaactcatcatctatgaggacctaataagacggtccctcgtaggggtttctaatcgtcttccactgccctccaagtcccggacaaccgacggccctccctgaactaatctacgtcgggctccaggctaggacggacgaggtacttggtatttattattgttcgcttacgtagtattcggtttcgtcgctacttacctatttagttcgttacggttcgggaaaggtttcggggaaccgttaaacgggttcccgtaaacccggtttcccgttaacggggttcccgaaccggtaacccccgtaaaaccgggaaccccctaaaaccccccgacgttacccggttccgttaaccccgttttccccg

SEQ ID NO: 408074 - DNA, 643 bp, Homo sapiens
  misc_feature: GZ8MTXP01DX9XU.44.28.C06.1.454.CMB.2.raw
  modified_base (196)..(196): a, c, t, g, unknown or other
  modified_base (226)..(226): a, c, t, g, unknown or other
  modified_base (238)..(238): a, c, t, g, unknown or other
  modified_base (255)..(255): a, c, t, g, unknown or other
  modified_base (373)..(373): a, c, t, g, unknown or other
  modified_base (419)..(419): a, c, t, g, unknown or other
  modified_base (473)..(473): a, c, t, g, unknown or other
  modified_base (610)..(610): a, c, t, g, unknown or other
tcagacagtatatacacgaccggtgctcgatttagagctcacgtattgggtttgggggggcacaagaggcagcactcaggacaatctccagcatggcctggtctcctctcctcctcactctcctcgctcactgcacagggtcctgggcccactctgtgctgacgcagccgccctcagtgtcgtcggggccccgggnaggagggtcaccatctcctgcacgtgggancagactccaaanagtcgggacagtattcngatcgtaccactggtaaccaactaccttccaaggaaccacgacccccaaatcctatattctttaggaaaccacttactcccggccctcgacggggttcccctagaccgtatttccccncgtcggcctaccaagtccgtggcccacctcgaccgtccctacccgnggaccctactccgacgtcgggcctcgaggtcttaaggaagagttaggagggttntaatttacgttacgtcggggtacctagttcctaagtcgaacgcggactacgtccgttacgagggtttcggggttgggtcggttcgggacgggtaacggacgtaacggtcttaccgggttaccgttccggttgggacncgggacccgacggttcctaaccgttccccgtcg

SEQ ID NO: 408075 - DNA, 656 bp, Homo sapiens
  misc_feature: GZ8MTXP01DAHCK.44.28.C06.1.454.CMB.2.raw
  modified_base (513)..(513): a, c, t, g, unknown or other
  modified_base (532)..(532): a, c, t, g, unknown or other
tcagacagtatatacacgaccggtgctcgatttagagctcacgtattgggtttggggatctcaggaggcagctctctcggaatatctccaccatggcctgggctctgctcctcctccaccctcctcactcagggcacaggatcctgggctcagtctgccctggctcagccctccctccgtgtccggtctcctggacagtcagtcacatctctgcactggaaccaacaggtcgacgttcggttcgtttcgaccgtgtcctccgtggtaccagcacgaaccccaagaaaccacgacccccaaatctaatttatttatgcgtactaagttcgttccgtccctttccgggtcgtcccctggacgtccgttctttacgtccccgttaggggtacctaaggtcgtacggaaccaaaccgcccggtccccttacccgtacgaacccctacgttcccgttcggtcggggtccctcccgaaggccgtaggaacggtacggaggtcttagtaatttatacgtnacctagctacgtaaataanaaccgtaaggtacggtaacttaacgtttactaagttcggacgcgaacgggtaaccaagcgtacgaccgttcaggttccgacgacccgaagtcgtcccgccccgtcgacctccgttccgttcccg

SEQ ID NO: 408076 - DNA, 675 bp, Homo sapiens
  misc_feature: GZ8MTXP01CSP7H.44.28.C06.1.454.CMB.2.raw
  modified_base (193)..(193): a, c, t, g, unknown or other
  modified_base (226)..(226): a, c, t, g, unknown or other
  modified_base (237)..(237): a, c, t, g, unknown or other
  modified_base (267)..(267): a, c, t, g, unknown or other
tcagacagtatatacacgaccggtgctcgatttagagctcacgtattggggtttggggggggtcacaagaggcagcgctctcgggacgtctccaccatggcctgggctctgctgctcctcactcctcctcacccaggacacagggtcctgggcccagtctgccctgactcagcctgcctccgtgtctgggtcncctggacagtcgtcaccatctcctgcactgganccagcgtaatnttcttagtcttaacttgtctctgtatcaanatcatccaagtaaacgcccccaaatcatcatctatgaggacctaagtaacgacgccccttgtacggggttttctaaagttcgtcctttaccacgtcgccctaccgaaacgtcccggacaaccgacccggtccctacccgtcgaacctaaacttctcccgtgggtcccttaccgaacgggtcctagggaacgggtacggacgggtactaggttatttaagtttacttaggtttcacgttactagtacttcggttacgtccgtactattaccgttacttacgtacgttccgttaaacgggaaggttacgggaaaccgtaaacgggttcccgtaaccgttccgttacgggttcaaccggaacccctaaacggaacccctaaacccgcgttacttaacccgaactttccccg

SEQ ID NO: 408077 - DNA, 567 bp, Homo sapiens
  misc_feature: GZ8MTXP01C3WKW.44.28.C06.1.454.CMB.2.raw
  modified_base (260)..(260): a, c, t, g, unknown or other
  modified_base (264)..(264): a, c, t, g, unknown or other
  modified_base (299)..(299): a, c, t, g, unknown or other
  modified_base (430)..(430): a, c, t, g, unknown or other
  modified_base (549)..(549): a, c, t, g, unknown or other
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctccgtgtctggtcgcctggacagtcggtcaccatctcctgcactggagccagcgtaatattcttagtcttaacttgtctctgtancaanatcatcaagtaaacgacccccaaatcatcatctangagcctagaagacggtcctcgtagggtttctaaactcgtcttccactcgcctaccaagtcccgacaacgacgccctcctagacactctctggcctccgaggctaggacggagaggtctagtatttaagttnttagtcgtcttacgtagtattcgtttacgcgactattctaacttagtgtacgttcgggtaaaggtcgggacctaacggcgtaaccgtcttacggcacgaacccgaaggtcccaaacccngttacgtccgaacgttcc

SEQ ID NO: 408078 - DNA, 745 bp, Homo sapiens
  misc_feature: GZ8MTXP01C7A69.44.28.C06.1.454.CMB.2.raw
  modified_base (191)..(191): a, c, t, g, unknown or other
  modified_base (199)..(199): a, c, t, g, unknown or other
  modified_base (238)..(238): a, c, t, g, unknown or other
  modified_base (273)..(273): a, c, t, g, unknown or other
tcagacagtatatacacgaccggtgctcgatttagagctcacgtattgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacngtcgtcacatcctctgcacgtggacgccagcgtaaattnttcttagttactttaactttgtctcctgtatcaanatcactacgaacgtaaccgaccccctaaatcatactatctagtcgacgtacctaagtaacggacgtcccgtaggttacggtttactaacgtcgtaccttaccctaccgtcgtacccttacccgaacggttaccccgaaccgaacccggtaacccgtccccttaccccgtaaacgtaacccgtaaacgttccgtaccgggttcggggtacccttacccggacgggttaccgtaacgggtaaccgggggaacggtaacgggttaccttaagggttaaacttttaacgtttaaggtttacggttcgtaccgttacgtaaaggttccgtttacggttccgtccgtactacttacgtacgttagttccgttacgttacgggtaacggtcggaaccgtacgttccgtaccgttcgttacgggcaaccggaaccaaccgtaaccccaaacccgtgttacctaaccttaaccttaacccg

SEQ ID NO: 408079 - DNA, 895 bp, Homo sapiens
  misc_feature: GZ8MTXP01EMRR8.44.28.C06.1.454.CMB.2.raw
  modified_base (198)..(198): a, c, t, g, unknown or other
  modified_base (227)..(227): a, c, t, g, unknown or other
  modified_base (256)..(256): a, c, t, g, unknown or other
tcagacagtatatacacgaccggtgctcgatttagagctcacgtattggggtttgggggggcacaagaggcagcactcaggacaatctccagcatggcctggtctcctctcctcctcactctcctcgctcactgcacagggtcctgggcccactctgtgctgacgcagcccgccctcagtgtcgtcggggccccgggnaggaggtcaccatctcctgcacgtgggancagactaccaacagtcgggacagtattcngatcgtaccacgtacgtaacccaactaccttaccgaaaggaacccaaccgaccccccctaaacttcccctactactttaccgtttaaggaaaaccaactttacgtccccgggtaccctacggaccgggggttcccctaggaccccgtatttccccgtccgtcggtaccctacccgtaacggttcccgttcggaacccctaacccgttcccaacccgtcccccccgttcccgtacgggacccctaacgttccgacccggttcggggaccctacccggtaagggtacccgttaaagggtaaacggtacggttacgggggtaaggggttaacggtttaaatttaacgtttaaccccggttacggggttaccccgttaaccgggtttaccccttaaagttaccggaaaccgtaacggcccgttaaccggtcccccggttaaggggtttacgggggtttggggggtttccgggggtttcggggttacccgggggaacggggggtaaaccgggaaacccggttaaacgggtcccgggttacccgggttacccggtttaccccgggggtcggggttaccccgtaaaccggggtcccccggaacggggttacccccggttccccgggttccccccggtttccccggg

SEQ ID NO: 408080 - DNA, 695 bp, Homo sapiens
  misc_feature: GZ8MTXP01BZP0E.44.28.C06.1.454.CMB.2.raw
  modified_base (227)..(227): a, c, t, g, unknown or other
  modified_base (303)..(303): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccacngtgacgtcggtcgtttgaccgtgtctctggtaccagcagaccccagaaaccacgacccccaaatcatttaatttancgtcggtcaacttggttcccgtccccgtttccggtcgtccccctaggtacgccgtcctttccgtcccgtacggggtccaaaggtccgtcggaacccaaaccgtcccgggcccttcccccgtagaacccctacgtttcctcggtcggggcccttaccgacgggtcttacgggaagggaccggtaacgggccgtttaagtaattttaacgttacctggacctaacggtccttacgtaaattacgtaaacgtaaaggttacggaaaccttacttttaaccgtacgttccggggactcggaaccgggaacctaacgccgtaccggttaaccgtccgtaaggttccgcgacccgaacgggcctcccgaccccgtggttccctaaccgttccgtcccg

SEQ ID NO: 408081 - DNA, 603 bp, Homo sapiens
  misc_feature: GZ8MTXP01DQMZ4.44.28.C06.1.454.CMB.2.raw
  modified_base (268)..(268): a, c, t, g, unknown or other
  modified_base (309)..(309): a, c, t, g, unknown or other
  modified_base (445)..(445): a, c, t, g, unknown or other
tcagacagtatatacacgaccggtgctcgatttagagctcacgtattggggtttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcgcctggacagtcggtcaccatctcctgcactggagccagcgtaatattcttagtcttaacttgtctctgtatcaanatcatccaagtaacgccccaaactcatcatctatgagctanaagacgcctgtagggtttctaatcgtcttccactcgccctaccaacgtcccgacaacgccggccctccctagaccaatctctcgggctccgaggctaggaggacgaggctgtattagttattgttgcttcgtagtnttcggttcgtcgctatacttacgtttaatcgttcgttacgggaaaggtcgggttaaccgtaacgggttccgtaaccggtccgttaggttcccgacgtaaccccgtaaaccgggaacccctaaaaccccgtcgttacggtaacccgttaactttccccg

SEQ ID NO: 408082 - DNA, 701 bp, Homo sapiens
  misc_feature: GZ8MTXP01A1ILJ.44.28.C06.1.454.CMB.2.raw
  modified_base (191)..(191): a, c, t, g, unknown or other
  modified_base (226)..(226): a, c, t, g, unknown or other
  modified_base (238)..(238): a, c, t, g, unknown or other
tcagacagtatatacacgaccggtgctcgatttagagctcacgtattggggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacaggtcggtcaccatctcctgcactgganccagcggtaatnttcttagtcttaacttgtctcctggtatcaacatcataccaaggtaaacgcccccaaactcatcatctatgaggtacctagtaacgacggccctacgtaggggtttactaagtcgcttcccactcgccctccaacgtcccgacaacgaccggccctccctagaccaactctacgtcgggcctaccgacgggtctgggaacgggaccggaggtccgtaggttaactttagtttaagtttcgtttacgtcgttacgtaaggttacgttacggtttccggtaccgacgttacttacctactttaacgttcggttacgtttaccggggaaaggttcggggttaaacccgtaaggggttaccccgaaccgggtttacccgttaacggggttcccaaccgggtaaccccgaaaccgggaacccctaaaaccccgtacgttaccggtaacccttaaccggtttaaccccg

SEQ ID NO: 408083 - DNA, 500 bp, Homo sapiens
  misc_feature: GZ8MTXP02I2C6M.44.28.C06.1.454.CMB.2.raw
  modified_base (321)..(321): a, c, t, g, unknown or other
  modified_base (369)..(369): a, c, t, g, unknown or other
  modified_base (419)..(419): a, c, t, g, unknown or other
  modified_base (492)..(492): a, c, t, g, unknown or other
tcagacagtatatacacgaccggtgctcgatttagagctcacgtattgggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaacgcccccaaatcatcatctatgagcctataagaggccctnagggtttctaatcgcttcactgcctccaagtccgcacacggcctcccngacaatctctgggctccaggctgagacgaggctgattattattgttgctnagatgttcgtcgcatcactttatgtcttggaagtgggaccaaggtcacgtcagtcagcccaaggcccaacccntctcactc

SEQ ID NO: 408084 - DNA, 572 bp, Homo sapiens
  misc_feature: GZ8MTXP02GFNM9.44.28.C06.1.454.CMB.2.raw
  modified_base (267)..(267): a, c, t, g, unknown or other
  modified_base (412)..(412): a, c, t, g, unknown or other
  modified_base (422)..(422): a, c, t, g, unknown or other
tcagacagtatatacacgaccggtgctcgatttagagctcacgtattgggtttgggggcacaagaggcagcactcaggacaatctccagcatggcctggtctcctctcctcctcactctcctcgctcactgcacagggtcctgggcccactctgtgctgacgcagccgccctcagtgtctggggccccgggcaggagggtcaccatctcctgcactgggagcagatccaacatcggggacagattctgatgtccactggtaccaacnccttccaggaacacgcccccaaatcctcatctttaggaacaactatccggccctcgacggggtccctgaccgattcctcgtggctccaagtctggccacctcacgccctccctggcccatcacgtggcctccgaggctagaacgngtggagggtntattattactgaccctagttcctagtcgacctagcacgcctgaggtggttggggtcgttcggggacgggacgggacccaaggtccgtacggtacccgtccggtggggtaccaccggtaccccgaacggtccgtccggccccccgtttcgg

SEQ ID NO: 408085 - DNA, 554 bp, Homo sapiens
  misc_feature: GZ8MTXP02F00AF.44.28.C06.1.454.CMB.2.raw
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaaaccacgacccccaaatcatttattatgcgtcaatgttcgccctttcggtctccctgacgcgtcttctccgtcgggtccaagtctggaccaacgccggcctccctgaccctattctcgtgggcctccgaggctggaggacgaggctagtatttatactgcagctacatataacgaagtggaactactttactacgttcggacgcgaacgggaccaagctacgaccgtcgtacggtcacgacccgaaggcctacgccccctcggtccacctcgtcccg

SEQ ID NO: 408086 - DNA, 495 bp, Homo sapiens
  misc_feature: GZ8MTXP02JMALK.44.28.C06.1.454.CMB.2.raw
  modified_base (322)..(322): a, c, t, g, unknown or other
  modified_base (486)..(486): a, c, t, g, unknown or other
tcagacagtatatacacgaccggtgctcgatttagagctcacgtattgggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaatcatcatctatgaggcctataagaggccctnaggggtttcaatcgcttcactgcctcaagtccgcacacgctccctgacaatctctggctccagctgagacgaggctgattatattgttgctcagatgttcgtcgcatcacttatgtcttcggaagtcgggaccaaggtcaccgtctagtcagccaagccacccntcgcactcg

SEQ ID NO: 408087 - DNA, 575 bp, Homo sapiens
  misc_feature: GZ8MTXP02H0SE1.44.28.C06.1.454.CMB.2.raw
  modified_base (224)..(224): a, c, t, g, unknown or other
  modified_base (234)..(234): a, c, t, g, unknown or other
  modified_base (249)..(249): a, c, t, g, unknown or other
  modified_base (426)..(426): a, c, t, g, unknown or other
  modified_base (435)..(435): a, c, t, g, unknown or other
tcagacagtatatacacgaccggtgctcgatttagagctcacgtattgggtttggggggcacaagaggcagcactcaggacaatctccagcatggcctggtctcctctcctcctcactctcctcgctcactgcacagggtcctgggcccactctgtgctgacgcagcccgccctcagtgtctggggccccggggcaggagggtcaccatctcctgcactgggancagatccaanatcgggacagattcngatgccactggtaccaacaccttccaaggaacacgccccccaaactcctcatcctttaggaaacctaactatccggcccttcgacggggtcccctgaccgtattccctcgtggcctaccaagttcctggccacctcacgccctccctggccatccacgtggctccgaggctagaagntggagggtnattatacgtgcctagtcctatacgacagcacgcctacgaggttgggttcgggtggttccgggacgggaacgggaccgaaacggtcgtacgtacccggtcgtaacgggtcacggacccgaaggcctccggtcccccgtcgg

SEQ ID NO: 408088 - DNA, 514 bp, Homo sapiens
  misc_feature: GZ8MTXP02H9KGD.44.28.C06.1.454.CMB.2.raw
  modified_base (276)..(276): a, c, t, g, unknown or other
  modified_base (320)..(320): a, c, t, g, unknown or other
  modified_base (326)..(326): a, c, t, g, unknown or other
  modified_base (355)..(355): a, c, t, g, unknown or other
  modified_base (363)..(363): a, c, t, g, unknown or other
  modified_base (373)..(373): a, c, t, g, unknown or other
  modified_base (390)..(390): a, c, t, g, unknown or other
  modified_base (405)..(405): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctcctcgtgtccggtctcctggacagtcagtcaccatctcctgcactggaaccaacagtgacgtcggtcgtttgaccgtgtctcctgtaccagcagaccccagaaacngccccaaactcattatttatgcggtcaatgttcgcccttcggtntcctgngcgcttctcctgggtccagtctggcaacncgcctccngacctatctntcggcctcagctgacgntgagctgattatacngcagctcgatggagcactatgtatttgcgttttcggcggtacgggacctagactcggaccgtccgtacggtcacgcccgaaggcctcgcccccgtcggtcctactcccg

SEQ ID NO: 408089 - DNA, 500 bp, Homo sapiens
  misc_feature: GZ8MTXP02IY5IW.44.28.C06.1.454.CMB.2.raw
  modified_base (188)..(188): a, c, t, g, unknown or other
  modified_base (319)..(319): a, c, t, g, unknown or other
tcagacagtatatacacgaccggtgctcgatttagagctcacgtattgggtttgggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaacttgtctcctggtatcaacatcatccaggtaaacgccccaaactcatcatctatgagcctataagagccctnaggggtttctaatcgcttcactgcctccaagtccggcacacgcctccctgacaatctctgggctccagctgagacgaggctgattattattgttgctcagtatgttcgcgcatcacttatgtcgttcggaagtggacaaggtcacgtctaggtcacgccaacggccaacccgatcgcactc

SEQ ID NO: 408090 - DNA, 544 bp, Homo sapiens
  misc_feature: GZ8MTXP02JVUQX.44.28.C06.1.454.CMB.2.raw
  modified_base (364)..(364): a, c, t, g, unknown or other
  modified_base (384)..(384): a, c, t, g, unknown or other
  modified_base (421)..(421): a, c, t, g, unknown or other
  modified_base (520)..(520): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcacgaccccagaaacacgcccccaaactcattattatgcggtcaatgttcgccctttccggtgtccctgagcgcttctctgggtccaagtctggcacncggccctccctcgaccatcnctgggctcccaggctgaggacgaggctgattattacngcagctcatatacgaagtgggaactacttttacatttccgggacgacaggggaacccaaagctacgtaacccgtcctacgggtcacgccccgaaggtcncgcccccgtggtccactcttcccg

SEQ ID NO: 408091 - DNA, 514 bp, Homo sapiens
  misc_feature: GZ8MTXP02F97HZ.44.28.C06.1.454.CMB.2.raw
  modified_base (320)..(320): a, c, t, g, unknown or other
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaatcatcatctatgagcctataagagcctnagggtttcaatcgcttcactgctccaagtccgcacacgcctccctgacaatctctgggctccaggctgaggacgaggctgattattattgttgctcagatgttcgtcgctatctacttatgtcgttacggaagtgggaccaaacgggtcaccgtctacggtcacgcccaaggcccaacccgatcgtcacttccg

SEQ ID NO: 408092 - DNA, 596 bp, Homo sapiens
  misc_feature: GZ8MTXP02H51IC.44.28.C06.1.454.CMB.2.raw
  modified_base (431)..(431): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctcgtgtctggttctcctgacagtcgatcacatctcctgcactgggtccagcaatgactagttgggagatataacctgtctcctggtatcaacaacatccaggacaaacgacccccaaactcattacttttgatccagtgagcggccgtcgaggttcgttacctaatcgtcttctcgtggcctcctaaagtctcggcccacgaccggcctccctgttaccgattccgtcgtcgggccctccgggcctggaacgggacgnggctacggacttattacgtgccggtctactatttaaccaacttccgttgaacggtacgtttggggtcggtttcgggcgggtaggggactaccgtccgtacggacccgttaccgtacgggtaaccacggaccccgaaggcccgtcccggtcccccgttcggtcccc

SEQ ID NO: 408093 - DNA, 561 bp, Homo sapiens
  misc_feature: GZ8MTXP02FWA14.44.28.C06.1.454.CMB.2.raw
  modified_base (332)..(332): a, c, t, g, unknown or other
  modified_base (375)..(375): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcacgaccccagaaaccacgcccccaaactcatttattatgcggtcaatgttccgccctttccggtntcccctgacgcgtcttctccgtgggtccaagtctggaccaacnccggccctccctgacccatctcgtcgggctccgaggctggacggacgaggctagattatactgcagctacatactaacaagtacggaactaactttactaagttcggacgcgaacgggaccagctacgaccgtactacggtacacgacccgaaggcctaccgcccccgtcggtccacctcgtcccg

SEQ ID NO: 408094 - DNA, 605 bp, Homo sapiens
  misc_feature: GZ8MTXP02IDLV2.44.28.C06.1.454.CMB.2.raw
  modified_base (282)..(282): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctcctccggtgtcccgggtctcctggacagtcagtcaccatctcctgcactggaaccaacagtgacgtcggtcgttttgaccgtgtctcctggtaccagcagaccccagaaacngacccccaaatcatttattatgcgtcaatgtttcgccctttccggtgtccctgacgcgctttctcccgtgggtccaagtctggccaacgcggcccttcctgaccctatcctctgggcctcgacggctggaggaccgaggctaggtacttattactgacgagtctactataataacgtaagtagggtaaactacgtttaactacgtttacggcgtacgacggggaaccaagcgtacgtaacccgtaccgttacggtaccgtaacgacccgtaaaacggccgttaccggaccccccgttacgggtcccgtaacctttcctccccg

SEQ ID NO: 408095 - DNA, 568 bp, Homo sapiens
  misc_feature: GZ8MTXP02GSTBT.44.28.C06.1.454.CMB.2.raw
  modified_base (224)..(224): a, c, t, g, unknown or other
  modified_base (460)..(460): a, c, t, g, unknown or other
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaacttgtctctggtatcaacatcatccaggtaaacgccccaaatcatcatctatgagcctaataagaggccctgtaggggtttctaatcgtcttccactcgcctcaacgtccggacacaccggcctccctagaccaatctcgtcgggctcccgaggctggaggacgaggctagtattattattgtgctcagtattgtcgcgctatctaacttntgttcgttacggaacgttcgggaacctaaacggtctacccggttacgtacggtaccacgaaccccgaaaggaccccaaaccccgagttacggtacctaacgtttcccg

SEQ ID NO: 408096 - DNA, 529 bp, Homo sapiens
  misc_feature: GZ8MTXP02IPD4K.44.28.C06.1.454.CMB.2.raw
  modified_base (228)..(228): a, c, t, g, unknown or other
  modified_base (316)..(316): a, c, t, g, unknown or other
  modified_base (368)..(368): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagccctccctccgtgtccgggtctcctggacagtcagtcacatctcctgcactggaaccaacngtgacgtcggtcgttttgaccgtgtctcctggtaccagcagaccccagaaacacgcccccaaactcattattatgcggtcaatgttcnccctttccggtcgtccctgagcgtcttctccgtgggtccaagtctggcaacncggcctcctgaccatctctgggctcgaggctgagacgagctagattatactgcagctcatactacaagtggaaactactttactattcggacgcgagggtaaccaagcgtacgaccgtcctaggtcacgcccaaggcctacgcccctggtccactctcccg

SEQ ID NO: 408097 - DNA, 518 bp, Homo sapiens
  misc_feature: GZ8MTXP02G16MR.44.28.C06.1.454.CMB.2.raw
  modified_base (223)..(223): a, c, t, g, unknown or other
  modified_base (282)..(282): a, c, t, g, unknown or other
  modified_base (403)..(403): a, c, t, g, unknown or other
  modified_base (420)..(420): a, c, t, g, unknown or other
  modified_base (434)..(434): a, c, t, g, unknown or other
tcagacagtatatacacgaccggtgctcgatttagagctcacgtattgggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaattgtctcctggtatcaacatcatccaggtaaacncccccaaatcatcatctatgagcctataagacggccctgaggggtttctaatcgtcttccactgcctccaagtccggacacgacggcctccctgacaatctctggctccgagctgagacgnggctgattatattgtgntcagatgttcgcgnatcacttatgtcttacggaaagtcgggaaccaaggtcaaccgtctaaggtcacgcccaaggccccaacccatcgtccacttccg

SEQ ID NO: 408098 - DNA, 594 bp, Homo sapiens
  misc_feature: GZ8MTXP02H2LSN.44.28.C06.1.454.CMB.2.raw
  modified_base (174)..(174): a, c, t, g, unknown or other
  modified_base (195)..(195): a, c, t, g, unknown or other
  modified_base (225)..(225): a, c, t, g, unknown or other
  modified_base (235)..(235): a, c, t, g, unknown or other
  modified_base (243)..(243): a, c, t, g, unknown or other
  modified_base (250)..(250): a, c, t, g, unknown or other
  modified_base (474)..(474): a, c, t, g, unknown or other
  modified_base (490)..(490): a, c, t, g, unknown or other
tcagacagtatatacacgaccggtgctcgatttagagctcacgtattgggtttggggggcacaagaggcagcactcaggacaatctccagcatggcctggtctcctctcctcctcactctcctcgctcactgcacagggtcctgggcccactctgtgctgacgcagccgccctnagtgtcgtcggggccccgggnaggagggtcaccatctcctgcacgtgggancagatccaangtcggganagattcngatcgccactggtaaccaacaccttccgaaggaaccacgacccccaaactcctcatctttaggtaacaactagtccggccctacgacggggtcccctaggaccgtattccctcgtggcctaccgaagtccgttcggcctaaccctcaccgtcccctccccgtggacccctatcccacgtcgggccctccgaggcctagaagagtggagggtgtaattattacgngcctagtccagtcganagcacgtctcgtaggtcgggttggtcggtcgggacgggaggaccgaagcgtacgtacccgtccgtggtaccacggacccgaaggtcccgtccgtcccccgtcgg

SEQ ID NO: 408099 - DNA, 552 bp, Homo sapiens
  misc_feature: GZ8MTXP02JK0BY.44.28.C06.1.454.CMB.2.raw
  modified_base (190)..(190): a, c, t, g, unknown or other
  modified_base (224)..(224): a, c, t, g, unknown or other
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaattgtctcctggtatcaacatcatccaggtaaacgcccccaaactcatcatctatgaggcctataagacggccctgaggggtttctaatcgcttccactgcctacagtccggcacacgcctccctcgacaactctctgggctccaggctgaggacgaggctagtattattattgtgctcagtatgttcgtcgcatcacttatcgtcttacgggaacggtcgggaaccaaacggtccaaccggttccgtaaaggtccaacgccccgaaacggacccctaaccccaacgtcgtaccacctttcccg

SEQ ID NO: 408100 - DNA, 560 bp, Homo sapiens
  misc_feature: GZ8MTXP02JA2U4.44.28.C06.1.454.CMB.2.raw
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctctggtatcacatcatccaggtaaacgcccccaaactcatcatctatgagctataagacggcctgtacggggtttctaatcgcttccactcgcctccaagtccggcacacggcctccctgacaatctctgggctccgaggctggaggacgaggctgtattattattgtgtctcgagtattgttcgtcgctatctacttatgtcgttacggaaggtcgggaacctaaacgggtcctacccggttacgtacggtccgaacgaacccgaaacggaccccaaaaccccgtctccgtaccactttcccg

SEQ ID NO: 408101 - DNA, 532 bp, Homo sapiens
  misc_feature: GZ8MTXP02ITGXR.44.28.C06.1.454.CMB.2.raw
  modified_base (311)..(311): a, c, t, g, unknown or other
  modified_base (418)..(418): a, c, t, g, unknown or other
  modified_base (515)..(515): a, c, t, g, unknown or other
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaacttgtctcctggtatcaacatcatccaggtaaacgcccccaaatcatcatctatgagcctanaagagccctgagggtttctaatcgcttccactgcctaccaagtccggacacacgcctccctgactaatctctggctccgagctgagacgagctgattattattgttnctacagtattgtcgcgcattctacttatgtcgttcggaagtcgggaccaaaggtccaccgtcgtacgtcacgaacccgaaacggacccaaaccccgntacgtaccactttcccg

SEQ ID NO: 408102 - DNA, 543 bp, Homo sapiens
  misc_feature: GZ8MTXP02HLPP5.44.28.C06.1.454.CMB.2.raw
  modified_base (325)..(325): a, c, t, g, unknown or other
  modified_base (482)..(482): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagccctccctccgtgtctggttctcctggacagtcgatcaccatctcctgcactgggtccagcaatgacattgggagatataaccttgtctcctggtatcaacaacatccaggcaaacgcccccaaactcattacttttgacgtccagtgagcggccgtnaggtgttacctaatcgcttctctcggctccaagtctcggccacacggccctcccgtgtcgatctcgtgggccgtccggcctgacggcggagctgactattactgcggctactatttacaactctagagtacgttgggtgttcgggaggaggggtacncgtacctcgtacccgttccgtaggtcgacgacccgtaaggccttcggccccctcggtaccc

SEQ ID NO: 408103 - DNA, 592 bp, Homo sapiens
  misc_feature: GZ8MTXP02JQAZA.44.28.C06.1.454.CMB.2.raw
  modified_base (224)..(224): a, c, t, g, unknown or other
  modified_base (236)..(236): a, c, t, g, unknown or other
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaactttgtctcctggtatcaacatcatccagtaaacgcccccaaatcatcatctatgagcctaataagaggccctgagggtttctaatcgtcttccactgccctaccaagtcccggacaccgaccgggccctcccctagaaccaaacttcctctcggggcctccgagggctggagacggaggctagtattattagttgttgctacagtattggttcgtacgtcatctaacttattggttcttacggggaaagttcggggaaacctaaacggggttccaacccggttccgtaacggtccaccgaacccgaaacggaccccaaccccgtactcgtaccactttcccg

SEQ ID NO: 408104 - DNA, 510 bp, Homo sapiens
  misc_feature: GZ8MTXP02FPV19.44.28.C06.1.454.CMB.2.raw
  modified_base (192)..(192): a, c, t, g, unknown or other
  modified_base (440)..(440): a, c, t, g, unknown or other
  modified_base (457)..(457): a, c, t, g, unknown or other
tcagacagtatatacacgaccggtgctcgatttagagctcacgtattgggtttgggggcacaagaggcagcactcaggacaatctccagcatggcctggtctcctctcctcctcactctcctcgctcactgcacagggtcctgggcccactctgtgctgacgcagccgccctcagtgtctggggccccgggnagagggtcaccatctcctgcactgggagcagatccaacatcggggacagattctgatgtccactggtaccaacaccttccaggaacagcccccaaactcctcatctttggaacaactatcggccctcgacggggtccctgaccgtatcctctgctccaagtctggcacctcagccctccctggccatcactggctccaggctgaagatggaggtgattattactgcctagtcctatgacagcagcctnagtggtggtcgttcggnggaggaccgaagctagacccgtctgggtcacgcccaaggctccgcccccgtcg

SEQ ID NO: 408105 - DNA, 502 bp, Homo sapiens
  misc_feature: GZ8MTXP02FGYTZ.44.28.C06.1.454.CMB.2.raw
  modified_base (493)..(493): a, c, t, g, unknown or other
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattctagtcttaactttgtctcctggtatcaacatcatccaggtaaacgcccccaaactcatcatctatgaggcctataagaggccctgaggggtttcaatcgcttccactgcctcaagtccggacacaccggcctcctgacaatctctgggctccgagctgagacgaggctgattatattgttgctcagattgttcgtcgcatcacttatgtcttcggaagtggacaaggtcacgtctagcacgccaagccaacccnctcgcactc

SEQ ID NO: 408106 - DNA, 577 bp, Homo sapiens
  misc_feature: GZ8MTXP02JU95G.44.28.C06.1.454.CMB.2.raw
  modified_base (299)..(299): a, c, t, g, unknown or other
  modified_base (339)..(339): a, c, t, g, unknown or other
  modified_base (360)..(360): a, c, t, g, unknown or other
  modified_base (420)..(420): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgtttgaccgtgtctctggaccagcagaccccagaaacacgacccccaatcattatttangcgtcaatcgttcgccctttcggtcgtcctgagcgcttcncctgggtccagtctggcaacncgcctcctgaccatctctcgggcctccgaggctggacggacgaggctgattattactgcngctcataacgtacaaaggtgggaaaccttacttttaacgtagtttacggacgtcgaacggggaacccaaggtcgtacgacccggttaccgtacggtaccgacgtacccgaaagggtccctaccggccccccgttggtacccaccgttctttccccgg

SEQ ID NO: 408107 - DNA, 652 bp, Homo sapiens
  misc_feature: GZ8MTXP02GPK61.44.28.C06.1.454.CMB.2.raw
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgtttgaccgtgtctcctggtaccagcacgaccccagaaacacgacccccaaatcatttattatgcgtcaatgttccgccctttcggtgtccctgacgtcgtcttctccgtgggtccaagtctggaccaacgccggtccctcccgtacgaccatcctcgtcgggccctccgaggcctgggacggacgaggctaggtattaatctgaccagtcctactaatactaacgtaaggtacgggtaaaccttacgttttacgtaacgttccgggacgtacggaacggggaacctaaacggccgttacggaaaccccggttaccgtaacggggttaccaaccgggtacccccgaaaacgggtcccgttacccggtacccccccgttcggggtacccctaacgttcccttttaacccccgg

SEQ ID NO: 408108 - DNA, 609 bp, Homo sapiens
  misc_feature: GZ8MTXP02GUOQA.44.28.C06.1.454.CMB.2.raw
  modified_base (190)..(190): a, c, t, g, unknown or other
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcgtaatattcttagtcttaactttgtctcctggtatcaacatcatccaggtaaacgcccccaaactcatcatctatgaggcctaataagacggccctcgtacggggtttactaagtcgctttccactcgtcctcaacgtccggacaccgaccggcctcctagaccaactctcgtgggcctccgaggctggacggacgacggctgtattattagttgttgtctcgagtatggttcgtcgctatctactttatcgttcgttacgggtaacggtacgggtaaccgaaacgggttcctaacccggttccgtacggttccaaccggaaccccgaaaccgggacccccaaacccccgtacgttaccggtaccctaaccgtttccccg

SEQ ID NO: 408109 - DNA, 552 bp, Homo sapiens
  misc_feature: GZ8MTXP02H0HNB.44.28.C06.1.454.CMB.2.raw
  modified_base (224)..(224): a, c, t, g, unknown or other
  modified_base (320)..(320): a, c, t, g, unknown or other
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaggtaaagcccccaaatcatcatctatgagctataagagccctnaggggtttcaatcgcttccactcgcctcaagtccggcacacgtcctccctgacatctctggctccgagctgaggacgaggctagatttattattgttgctacagtattggtcgttcgcattcaactttatgtcgtttacgggaagtcgggaaacctacggtaccaacccggtttccgaacggttccaacgccccgaaacggccccaaaccccgactcgtactaaccttcccg

SEQ ID NO: 408110 - DNA, 596 bp, Homo sapiens
  misc_feature: GZ8MTXP02HJBW8.44.28.C06.1.454.CMB.2.raw
  modified_base (403)..(403): a, c, t, g, unknown or other
  modified_base (454)..(454): a, c, t, g, unknown or other
tcagacagtatatacacgaccggtgctcgatttagagctcacgtattgggtttggggatctcaggaggcagctctctcggaatatctccaccatggcctgggctctgctcctcctcaccctcctcactcagggcacaggatcctgggctcagtctgccctggctcagcctccctcgtgtccggtctcctggacagtcagtcacatctcctgcactggaaccaacagtcgacgtcggtcgtttgaccgtgtctccgtggtaccagcacgaccccagaaaccacgacccccaatctatttattatgcgtacaagttcgttccgcccttccggtcgtccctgacgtcgtccttcgtccgtcgggtacctaacgtctggaccaacgccggtccctccctgaaccctntccgtcgtcgggcctacgaggtctaggacggacgagtctagtattatacgngactatctactatacgtaacgaacgtacgtaacttacgttacgtacgtccggacgacgaacggtaaccagtccgtacgtaccgtacgtacgaccaccgaccgaacgtccgtacccgtcccgtcgtaccctacgttcctcccg

SEQ ID NO: 408111 - DNA, 718 bp, Homo sapiens
  misc_feature: GZ8MTXP02GDCI6.44.28.C06.1.454.CMB.2.raw
  modified_base (191)..(191): a, c, t, g, unknown or other
tcagacagtatatacacgaccggtgctcgatttagagctcacgtattgggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggacgccagcggtaatattcttagttcttaactttgtcttcctggtatcaacaacatccaggcaaaacgcccccaaatcattacttttgactccagtgacgcggccgtcgtaggttgtttactaactcgtactttctccgtcggtaccttaccgtaaacgttccgtacgggaccctaccgtacccgggtcccccttcccgttcgttaccgtaacttccgttcgtcggggtccctcccgggcccgttaggacgggtaccggaggtccttacggtaacctttaacgttaccgtcggaccggttctacttaaactttaaccaacgttccgttagaacgttacggtttggggttcggtttacggggacgggtaacgggtacttaccgaaccgttacggtacccgttccggttaaacggtccgaaccggacccgtaacggtcctccccggtcccccgttcggtaccctaccgtttcccttcccgttaccccctttaaccccg

SEQ ID NO: 408112 - DNA, 585 bp, Homo sapiens
  misc_feature: GZ8MTXP02INA9L.44.28.C06.1.454.CMB.2.raw
  modified_base (189)..(189): a, c, t, g, unknown or other
  modified_base (223)..(223): a, c, t, g, unknown or other
  modified_base (409)..(409): a, c, t, g, unknown or other
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcggtcaccatctcctgcactgganccagcggttaattattcttagtcttaactttgtctcctggtatcaacatcatccaggtaaacgcccccaaactcatcatctatgagcctataagacgccctcgtaggggtttctaatcgacttccactgcctccaacgtccgcacacggccctccctgacaatctcgtggctccaggctgagacgnggctagtattattacgttgttgccttatagtagttggtttccgtcgcctatcgtaacctttagttgttccgttacgggaacgttacggggaacctaacgggttcccaaccgttccgtacggttccaacgaaccccgaaaacggcccctaaacccccactacggtccacctttcccg

SEQ ID NO: 408113 - DNA, 724 bp, Homo sapiens
  misc_feature: GZ8MTXP02IMU7G.44.28.C06.1.454.CMB.2.raw
  modified_base (228)..(228): a, c, t, g, unknown or other
tcagacagtatatacacgaccggtgctcgatttagagctcacgtattggggtttggggggggtcacaagaggcagcgctctcgggacgtctccaccatggcctgggctctgctgctcctcactctcctcacccaggacacagggtcctgggcccagtctgccctgactcagcctgcctccgtgtctaggtcgcctggacagtcggtcaccatctcctgcacgtggacnccaggcggttaattattcttagtctttaactttgtctcctggtatcaacatcatccaagtaaaccgacccccaaactcatcattactatagacggctaataacggacggtcccttacgtaggggttttactaagtcgtactttccactcgtccctaccgtaacggtcccggaccaccgtccgggtccccttacccgtacgaacctaactccgttccgtcggggtacctcccggtaaggcgttaggggaacgggacggaaacgggtcgttaggttaatttagtttacgtttggtttccgtacttacgtagttagtttcggttaccgtcgtactacttacttactttagttacgttcgttacggggtaaacggtcggggtaaaccgtaacgggttacctaacccggttccgttaaacggttcccgaaaccggaaccccgaaaccgggtaaccccctaaacccccgtacgttaccggttaccctaacccgtttccccgg

SEQ ID NO: 408114 - DNA, 589 bp, Homo sapiens
  misc_feature: GZ8MTXP02HIKPZ.44.28.C06.1.454.CMB.2.raw
  modified_base (192)..(192): a, c, t, g, unknown or other
  modified_base (471)..(471): a, c, t, g, unknown or other
tcagacagtatatacacgaccggtgctcgatttagagctcacgtattggggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggacgccaggcgtaatattcttagtcttaacttgtctcctggtatcaacatcatccaaggtaaaccacccccaaatcatcatactatgaggcctaagtaagacggccctagtagggtttactaagtcgtcttccactcgccctacaagtcccggacacgaccggccctaccctgaaccaactcctcgtgggcctaccgaggccgtaggaggacgaggtctagtatttagttattggtctctacgaagtnttcgttcgtccgatatctacttatcgttacgtcggtaaggtcggaacctaacggtccaccgtaccgtaggtccagaaccccgaacggaccccaaacccgtcgtcgtacctacttcccg

SEQ ID NO: 408115 - DNA, 770 bp, Homo sapiens
  misc_feature: GZ8MTXP02JQOIH.44.28.C06.1.454.CMB.2.raw
  modified_base (755)..(755): a, c, t, g, unknown or other
tcagacagtatatacacgaccggtgctcgatttagagctcacgtattggggtttgggggatctcaggaggcagctctctcggaatatctccaccatggccgtgggctctgctcctcctccaccctcctcactcgagggcacaggactccgtgggctcagtctcgcccgtggctcacgccctccgtccggtcggtccgggtctccgtggacagtcagtccaccatctcctcgaccacgtacggaaaccaacgtaggtacggtaccggttcgggtttcggtttcggaccggttcgttccgttaccgtacggtaaccacggaccgaaccgaaccccgaaacggaaaacccacccggaaaccccccaaacttaccttaacgtttaactttacgttcggtacggtacttaacgtcggttacccgtcccgtttacccggtccgtcccgtaggacgtcgtcctttcgtccggttcggtacctaggtcgtcggaaccaaccgtcccggtacccttcccgtacgtacccacgttccgtcggtccgggtccctacggtacgggtcgtacgggggaaccgggaccggtacgggtaccgttagttaacgtttaacgttacggcgacggacttacgtactattaacggaacgttaaggtacgaaacttactttacgtacgttccggacgacggaccggtacacgtccgtaccggtaccgttacgacgtacgaaccgaccggaagcccggtcctaccccgtcggtaccnccgttccgttccccg

SEQ ID NO: 408116 - DNA, 636 bp, Homo sapiens
  misc_feature: GZ8MTXP02HEU2U.44.28.C06.1.454.CMB.2.raw
  modified_base (191)..(191): a, c, t, g, unknown or other
  modified_base (227)..(227): a, c, t, g, unknown or other
  modified_base (255)..(255): a, c, t, g, unknown or other
  modified_base (269)..(269): a, c, t, g, unknown or other
  modified_base (306)..(306): a, c, t, g, unknown or other
tcagacagtatatacacgaccggtgctcgatttagagctcacgtattggggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcacgtggacnccagcggtaatattcttagtcttacttntctctgtatacaanatcataccaaggtaaccacccctaaatcatcatctangagctagagcgtcctgtaggttcatcgtctaccactcgcctacgagtcccgacaccgtaccgcctaccctagaccgtaactccgtacgtacgggtcctccggtaagcgtacgggaacgggtaccgaggtacttaggtaatttagtttagttcgtacgtacttacgtagttcgttcggtttaccgacgtactactttactacgtttagttcggttcgttaaacgggtacggtaaccggacgtaaccggttccgtaccgttacggtaaccgtcgaaacccgtaaccgtaaccggtacccccaaccgtcgtaccggtaccctacgtttccccg

SEQ ID NO: 408117 - DNA, 641 bp, Homo sapiens
  misc_feature: GZ8MTXP02H44BG.44.28.C06.1.454.CMB.2.raw
  modified_base (189)..(189): a, c, t, g, unknown or other
  modified_base (284)..(284): a, c, t, g, unknown or other
  modified_base (412)..(412): a, c, t, g, unknown or other
tcagacagtatatacacgaccggtgctcgatttagagctcacgtattgggtttgggggggtcacaagaggcagcgctctcgggacgtctccaccatggcctgggctctgctgctcctcactctcctcacccaggacacagggtcctgggcccagtctgccctgactcagcctgcctccgtgtctggtcncctggacagtcgtcaccatctctgcactggacgccagcgtaattattcttagtcttaactttgtcttcctgtatcaacatcatcaaggtaaaccnccccaaactcatcatctatagacggtacctaagtaacgacgtcctacggtagggtttactaacgtcgtcttccactcgacctacgacgtaccgacacgacgtcctacctagactactctcgtcggccncgaggctaggacgtacgacggtactagtaactttagttagtttgttcgtacttacgagttagtgtttccgtactctacttactaactttacgttcgttacggttaacgggtaacgggtacgggtaaaccgtacggttcccgtaaccgtttaccgtacggtccgaaacccggtaacccgaaacccggaaacccctaaccccgtacgttaccgttactaacccgtttcccg

SEQ ID NO: 408118 - DNA, 679 bp, Homo sapiens
  misc_feature: GZ8MTXP02JZBLI.44.28.C06.1.454.CMB.2.raw
tcagacagtatatacacgaccggtgctcgatttagagctcacgtattgggtttggggatctcaggaggcagctctctcggaatatctccaccatggcctgggctctgctcctcctccaccctcctcactcagggcacaggatcctgggctcagtctgccctggctcacgccctccctccgtcggtccgggtctcctggacagtcagtcaccatctcctgcactcggaaccaacagtgacggttcggttcgtttgaccgtgtcctcgcggtaccagcacgacccaagaaaccaccgacccccaaatcaatttacttagtgtcgtactaagtcgttccgtccccttccgggtcgtccctagcgtccgtcctttcgtccggtcgggtacctaacggtccgtacgggtaccaaccgtcccggtcccttccccgtacgaccctacttcccgtcggtccgggtacctcccggtaggtcgtacgggacgggtaccgagggtcctaggttatttaacttcgagacgtacgctactatactaacgtaaggtacggtaaacttacgtttaacttacggtccggcgtacggaacgggtaaccaaggcctaccggtaccggtaccgtaggtcccacggtacccgaacggtccccgtaccgtcccccgtcgtacctaccgtttccctccccg

SEQ ID NO: 408119 - DNA, 625 bp, Homo sapiens
  misc_feature: GZ8MTXP02IK13P.44.28.C06.1.454.CMB.2.raw
  modified_base (213)..(213): a, c, t, g, unknown or other
  modified_base (243)..(243): a, c, t, g, unknown or other
tcagacagtatatacacgaccggtgctcgatttagagctcacgtattgggtttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcgcctggacagtcggtcacatcncctgcactggccagcaatgactgttggganatataaccttgtactcctggtatcaaacaactacaccaaggcaaaacgaccccccaaactcacgttacttttgagtccagtgacgcggccgtgaggttgtttactaagtctccgttctctggctcaagtctggccacaccggcctccctgcgtactctcgtcggtacgcccggtccgtggacggacgaggtctgtactacttacgtcgcggtaccttctatttaacctaacgtccttaggtaacgtacggtttgggtcgggtttccgggacgggtacgggggtacctacccggtacgtacggtaaacccggttccgtaacggtcgaaacgccccgtaaggtcccgtaccgtcccccgtccggtaccgtactcgtttcccccg

SEQ ID NO: 408120 - DNA, 483 bp, Homo sapiens
  misc_feature: GZ8MTXP01EQ41Z.38.11.A11.1.454.CMB.2.raw
  modified_base (213)..(213): a, c, t, g, unknown or other
  modified_base (225)..(225): a, c, t, g, unknown or other
  modified_base (346)..(346): a, c, t, g, unknown or other
  modified_base (368)..(368): a, c, t, g, unknown or other
  modified_base (370)..(370): a, c, t, g, unknown or other
  modified_base (373)..(373): a, c, t, g, unknown or other
  modified_base (376)..(376): a, c, t, g, unknown or other
  modified_base (379)..(380): a, c, t, g, unknown or other
  modified_base (390)..(390): a, c, t, g, unknown or other
  modified_base (395)..(395): a, c, t, g, unknown or other
  modified_base (435)..(435): a, c, t, g, unknown or other
  modified_base (459)..(459): a, c, t, g, unknown or other
  modified_base (464)..(464): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggnacggtattaacnctggttgctggtatcagcagaaaccagggaaacgcccctatgtccctaatctttgatgcatccactttgacaaactcggggtcccatctaggttcagcgcccagtggatctgggaacagtntttcactctcacatcgacactnanctnagntcnntattatactnacaanatataatactaccgcacctcgacaaggactacgactgganaattaaaccgaatgttggactgcncatcntcttcattcctccgctaac

SEQ ID NO: 408121 - DNA, 570 bp, Homo sapiens
  misc_feature: GZ8MTXP01CT5F4.38.11.A11.1.454.CMB.2.raw
tcagtcgatcacgtcacgaccggtgctcgatttagctacgactgcagggggacccagtcaggacacagcatggacatgagggtcctcgctcagctcctggggctcctgctgatctgtttcccaggtgacagatgtgacatccagatgacccagtctccatcctcactgtctgcatctgtaggagacagatcaccatcacttggcgggcggggcacggtattaacacctggttggcctggtatcgagcaagaaaccagggaaacgcccctatcgtaccctaatctttgatgcatccatttgacaaacgtcgggtcccatctaggtcagcgcccaggtgatcgtgggaacagtaacttcaactctacaaccataccgaacaacctgaaacgcctagaagacttactagtactaaattttataactagaaccaaactaaattaacttaaacttaaccttaaccccggtactacccgttacggaccgaaacgggactacgaactgggaaactaattaaacgaactggttacggtactgacaccatctagttccttacacttccttcccgctaac

SEQ ID NO: 408122 - DNA, 688 bp, Homo sapiens
  misc_feature: GZ8MTXP01DM8ID.38.11.A11.1.454.CMB.2.raw
tcagtcgatcacgtcacgaccggtgctcgatttagctacgactgcaggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcggggcacggtattaacacctggttggcctggtatcgagacgaaacgaaaccggaaggaaccgtccctaagtccgtacctaattcttagatcgactactcccttacgtttcgaaccgtaacggttccgggtaccctagttacggttacggttacgacggccgtacccgtaggtaggacttcgggtaggaaacctagtttcttacctaccttcctaccaacctataccgaaacctaaccgtagaaccgtcgtaaggtaaattactttacgacgttaaactttaaattttaactacgtaccgtaaaccctaaaacttaaatttaaacttaaacctttaaccccggtttaccccggtacttacccggttaccggaaccggtaaaacgggaccaacggtacggtaaggtaacgttaaaacttaaaccgagttggacgtactcgaaccttcttattcgtacttcctactcttccctcccgcttaac

SEQ ID NO: 408123 - DNA, 628 bp, Homo sapiens
  misc_feature: GZ8MTXP01AGFTN.38.11.A11.1.454.CMB.2.raw
  modified_base (223)..(223): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgcgggcgggcacggtataacnctggttgctggtatcagcagaaaccagggaacgcccctatgtccctaatctttgatgcatccactttgacaaacgtgggtcccatctaggtcagcgcccagtgatcgtgggaacagtctttcactctccaccatacgaacaacctgaacgcctagaagtattctagtactaaattttacttactacgaccctaaactaaacgttaacttaaactttaaccgtttaacccccgggttacctaaccccgtttaccgggaacccgtaaaacggggtaaccaaccggtaaccgttagggaacggtaaacttaaaacggttaaccgttaggttacgggtacttacggaccgttaaccttacttaaccgttcgttaacctttcctacttccctttccccgaaccttaaccg

SEQ ID NO: 408124 - DNA, 505 bp, Homo sapiens
  misc_feature: GZ8MTXP01AQ2EC.38.11.A11.1.454.CMB.2.raw
  modified_base (268)..(268): a, c, t, g, unknown or other
  modified_base (346)..(346): a, c, t, g, unknown or other
  modified_base (355)..(355): a, c, t, g, unknown or other
  modified_base (363)..(363): a, c, t, g, unknown or other
  modified_base (377)..(377): a, c, t, g, unknown or other
  modified_base (379)..(379): a, c, t, g, unknown or other
  modified_base (382)..(382): a, c, t, g, unknown or other
  modified_base (386)..(386): a, c, t, g, unknown or other
  modified_base (399)..(399): a, c, t, g, unknown or other
  modified_base (406)..(406): a, c, t, g, unknown or other
  modified_base (425)..(425): a, c, t, g, unknown or other
  modified_base (475)..(475): a, c, t, g, unknown or other
  modified_base (488)..(488): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcgggcggggcacggtattaacaccgttggttcggcctggtatcagcaagaaaccagggaacncccctatcgtccctaatcttgatgcatccatttgactaaacgtcgggtcccatcgtaggtcagcgcccagtggatcgnggaacagtnttcactcncacatcacactgancnganttcntactaattatacnacctaanaatataactactaccgtcncgtcgacgaaggcacgacgtggagtaacttaaacgactggttcgctcgcnccatctgtccttnacttccttcccgctaac

SEQ ID NO: 408125 - DNA, 667 bp, Homo sapiens
  misc_feature: GZ8MTXP01DM5V1.38.11.A11.1.454.CMB.2.raw
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacacctgggttggcctggtatcagacaagaaaccagggaaacgcccctatcgtccctaatctttgatgcatccactttgactaaacgtcggggtcccatcttaggttcagccgccccaggtaggatccgtggggaaacctagtaatttcacttcctaccaccatacgaaccaacctagaacgtcctagaagtattctagtacttaatttacttaactcaacctaaactaaattaaacttaaacttaaccctttaaccccggtacctaacccggtttaccggaaccgaaaacggggtaacctaaccggtaaccgtaagggtaaacgttaaaacgtttaaaacggaaaccgtttcgggttaaggtccgttacggacccgttaacccttaacgttccgtttaacgttcctttacgtaactttccctttcccccggaaccgttaaccg

SEQ ID NO: 408126 - DNA, 528 bp, Homo sapiens
  misc_feature: GZ8MTXP01DA299.38.11.A11.1.454.CMB.2.raw
  modified_base (184)..(184): a, c, t, g, unknown or other
  modified_base (226)..(226): a, c, t, g, unknown or other
  modified_base (352)..(352): a, c, t, g, unknown or other
  modified_base (376)..(376): a, c, t, g, unknown or other
  modified_base (407)..(407): a, c, t, g, unknown or other
  modified_base (489)..(489): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacgttggcgggcgggcacggtattaacncctgggttggcctggtatcagcaagaaaccagggaaacgcccctatcgtccctaatctttgatgcatccactttgcaaacgtgggtcccatctagttcagcgcccaggtggatcgtgggaacagtnttcactctcacatcgaacactganctagaagtatctagtactaatttactactanaccaaataagtaacttaactaccttacccggtctacccgttcgaccgaacgggacacgacgtaggaagtaataaacgactgnggtactgacttcactcgtactcttcattcctccgctaac

SEQ ID NO: 408127 - DNA, 513 bp, Homo sapiens
  misc_feature: GZ8MTXP01EG2LT.38.11.A11.1.454.CMB.2.raw
  modified_base (355)..(355): a, c, t, g, unknown or other
  modified_base (412)..(412): a, c, t, g, unknown or other
  modified_base (490)..(490): a, c, t, g, unknown or other
  modified_base (496)..(496): a, c, t, g, unknown or other
  modified_base (501)..(501): a, c, t, g, unknown or other
  modified_base (513)..(513): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacacctggttggcctggtatcagacaagaaaaccagggaaacgcccctatcgtccctaatctttgatgcatcctactttgactaaacgtggggtcccatctaggtcagcgcccagtgatcgtgggaacagtntttcactctcaccatcgacaactgaagctagaatattctagtactaatttatactanacaaacaataataataacttaaccgtcaccgttcgacaaggacacgacgtagaagtaaattaaacgaatgttgctgcncatctntctcncttcctccgctn

SEQ ID NO: 408128 - DNA, 648 bp, Homo sapiens
  misc_feature: GZ8MTXP01C9TP7.38.11.A11.1.454.CMB.2.raw
  modified_base (184)..(184): a, c, t, g, unknown or other
  modified_base (226)..(226): a, c, t, g, unknown or other
  modified_base (263)..(263): a, c, t, g, unknown or other
  modified_base (347)..(347): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacgttggtcgggcgggcacggtataacncgtggttcgctggtatcagacaagaaaccagggaacnccctatcgtacctaatcttgatgcatcctactttgacgtaacgtcgggtacccagttcttaggtcagccgacccaggtgatcgnggaacagtcttcactctcactatacgactactgacgtctagaagtattactacgtacttaatttactacgtacaacctaaactaattaaacttaacgttaacccttacccggtacctaacccgttacgggaccgtaaacggggtactaaccggtaacgtacgggtaaacgtaaacgtttaaaaccggacgttacgggttacggtaccgtaacggttacccgttaaccgttaactttcccggttcgtttaaccctttacccggtaacctttccccgtttaaccccggttaaccttaacccgg

SEQ ID NO: 408129 - DNA, 509 bp, Homo sapiens
  misc_feature: GZ8MTXP01BN71B.38.11.A11.1.454.CMB.2.raw
  modified_base (184)..(184): a, c, t, g, unknown or other
  modified_base (349)..(349): a, c, t, g, unknown or other
  modified_base (402)..(402): a, c, t, g, unknown or other
  modified_base (461)..(461): a, c, t, g, unknown or other
  modified_base (483)..(483): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacttggtcgggcgggcacggtattaacacctggttggcctggtatcagcaagaaaccagggaaacgcccctaatgtccctaatctttgatgcatccactttgcaaacgtgggtcccatctaggttcagcgcccagtggatcgtggaacagnttcactctcaccatcgacactgaagctgaagattctgtactaatttattactnaccaaataataataacttaccttacccggtcaccgttcgaccaaggacacgactggaanaattaaacgatgttggctcgcnccatctgtcttcacttcctccgctaa

SEQ ID NO: 408130 - DNA, 576 bp, Homo sapiens
  misc_feature: GZ8MTXP01C8VWG.38.11.A11.1.454.CMB.2.raw
  modified_base (183)..(183): a, c, t, g, unknown or other
  modified_base (272)..(272): a, c, t, g, unknown or other
  modified_base (339)..(339): a, c, t, g, unknown or other
  modified_base (363)..(363): a, c, t, g, unknown or other
  modified_base (391)..(391): a, c, t, g, unknown or other
  modified_base (423)..(423): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttccaggtgacagatgtgacatccagatgacccagtctccatcctcactgtctgcatctgtagganacagagtcaccatcacgttggtcgggcggggcaacggtattaaccgccgttgggttggcctggtatcagacaagaaaccgagggaaacnccccgtatcgtaccctaatctttgatgcatccactttgacaaacgtgggtcccagtctaggtcagcncccgagtgatcgtgggaactagtntttcactctcacatcgaacacctgaacncctagaatatctagtactaaatttatacgtanacctaaaactaaattaacttaaaactaccttaacccggtactaacccgttccggaccgtaaagggacctaacgactaggaaagtaacttaaaacgactagttcggtactcgacaccattctacgttcttactacttccctttcccgcttaacg

SEQ ID NO: 408131 - DNA, 520 bp, Homo sapiens
  misc_feature: GZ8MTXP01D9NLL.38.11.A11.1.454.CMB.2.raw
  modified_base (258)..(258): a, c, t, g, unknown or other
  modified_base (359)..(359): a, c, t, g, unknown or other
  modified_base (518)..(518): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagatcacatcacttgccggcagtcagggcattagctagttattagctggtatcagacaaaaacagggaaacncccctaaagctacctgatctatgctgcctcactttgactaaagtgggtacccagtcaaggttccagcggcagtggaactcgtgggacagtatttcacttcncaccatcagcagcctgacagcctagaagtatttgacttaacttagttaactgtaactaaacgtatacttaaattagttactctctaacgtttcggacggaagggtacccaaagggtcgaagtactaacaaacgttcttgtaaggctgccacatccgttntc

SEQ ID NO: 408132 - DNA, 592 bp, Homo sapiens
  misc_feature: GZ8MTXP01EUK5I.38.11.A11.1.454.CMB.2.raw
  modified_base (184)..(184): a, c, t, g, unknown or other
  modified_base (361)..(361): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacgttggtcggggcggggcacggtattaacaccgtgggttggcctggtatcgagacaagaaaccgagggaaacgcccctatcgtaccctaatcttgatgcatcctactttgactaaacgtcgggtcccatctaggtcagcgcccaggtgatcgtggaacagtnttcactctcaccatcgaacactgaacgctagaagtattctagtacttaatttactacgtacaacctaaactaaattaacttaacgttaacccgttacccggtacctacccggttaccggaccgaaacgggacctaacggtaacgtacggaagtaaacttaaaccgagtcggttacggctacgacttaccttacttcgttacgttcttcacttcccgtcccgttccgtaacg

SEQ ID NO: 408133 - DNA, 617 bp, Homo sapiens
  misc_feature: GZ8MTXP01AJKSZ.38.11.A11.1.454.CMB.2.raw
  modified_base (265)..(265): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacaccgtggttggcctggtatcagcaagaaaccagggaaacncccctatgtccctaatctttgatgcatccactttgacaaactgggtcccatctaggtcagcgcccagtgatcgtggaacagtaatttcactctcaccatcgaacaacctgaagcctagaagtattactagtacctaaatttacttactacgacctaaacaaacttaactaaacttaccttaaccccgggttacctaacccgtttccggaacccgtaaacgggaccgaaccggtaaccgttagggaaagtaaacgttaaaacggaaaccgttggttacgggtcctacggacccttaccttaacttccgttcgttaacctttaccactttccccgtttccccgcccgttaaccg

SEQ ID NO: 408134 - DNA, 635 bp, Homo sapiens
  misc_feature: GZ8MTXP01AMM73.38.11.A11.1.454.CMB.2.raw
  modified_base (274)..(274): a, c, t, g, unknown or other
  modified_base (617)..(617): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcggggcggggcacggttattaaccgaccgttgggttggcctggtatcagcaagaaaccgagggaaacncccctatcgtaccctaattctttgatgctactccctactttgacctaaacgtcgggtaccctagtcgttaggtcagccgccctaggtggtactcggtgggaactagttcttccacttctacaccatccgaaaccaactagacgtccgtagaagtactacgtagtacttaaatttacttaactcaacctaaactaatttaaacgtaaacctttacccgtaaccccggttacctaacccgttaccggacccgtaaacgggaccctaacggtaaccgtaggaacgtaaacgttaaacgttacgtggttccggtactcgaccttacccttattccgttcttcttccnttcccctcccgctaaccg

SEQ ID NO: 408135 - DNA, 564 bp, Homo sapiens
  misc_feature: GZ8MTXP01EY7R1.38.11.A11.1.454.CMB.2.raw
  modified_base (184)..(184): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacttggtcgggcgggcacggtattacactggtgcctggtatcagcagaaaccaggaagccctatgtccctaatcttgatgcatccactttgctaaacgtcgggggtccctatctagttcagcgccccagtggatctgggaactagctttcactctcaccgatcgacacctgaacgcctagaagattactgtactaatttatactagaccaaacaataacttaaactaaccgttaccccggtactaacccgttacggacccgaaaggggaccaacgacgtaggaacgtaagttaaaacgaaacgtggttacgggtctaggaccgaccttattccgtgttaaccttcacttcccttcccgcgtaaccg

SEQ ID NO: 408136 - DNA, 613 bp, Homo sapiens
  misc_feature: GZ8MTXP01DQ3U4.38.11.A11.1.454.CMB.2.raw
  modified_base (184)..(184): a, c, t, g, unknown or other
  modified_base (268)..(268): a, c, t, g, unknown or other
  modified_base (366)..(366): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacgttggtcggggcgggcacggtattaacaccgtggttcggcctggtatcagacaagaaaccgaggaacnccctatcgtaccctaatcttgatgctatcctactttgactaaacgtcgggtacccagttcgtaggttcagccgacccaggtgatcgtaggaactagtntttcactctacaccatacgaacactagaacgtcgtagaacgtattactagtacttaaatttacttactagtaacctaaactaagttaacttaaacgtttaacccgttaccccggttactacccgttacgggaaccgtaaacgggacctaacgtacgtaggtaaacgtaaacgttaaacgacgtggttacgtacgtacgaccgttaccttattccttacgtccttacactttcccttcccgcttaacg

SEQ ID NO: 408137 - DNA, 566 bp, Homo sapiens
  misc_feature: GZ8MTXP01DO0Z8.38.11.A11.1.454.CMB.2.raw
  modified_base (373)..(373): a, c, t, g, unknown or other
tcagtcgatcacgtcacgaccggtgctcgatttagctacgactgcaggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggtattaacacctgggttggcctggtatcagcaagaaaccagggaaagccctatgtccctaatcttgatgcatccactttgcaaactgggtcccatctaggtcagcgcccagtggatctgggaacagtaattcaactctcaccatcgacaactgaanctagaagattctagtactaatttatactagaaccaaacaaagttaataaacttacctttaacccggtacctaacccgtttaccggaacctaaacggggaccaacggtaacctagggaagtaaactttaaaacgaaactggttaggactcgacttaccaattctacgttcttctattccctttcccgcctaacg

SEQ ID NO: 408138 - DNA, 567 bp, Homo sapiens
  misc_feature: GZ8MTXP01BADKL.38.11.A11.1.454.CMB.2.raw
  modified_base (184)..(184): a, c, t, g, unknown or other
  modified_base (270)..(270): a, c, t, g, unknown or other
  modified_base (387)..(387): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagatcaccatcacgttggtcggggcgggctacggtattaacgacctgggttcggcctggtatcagacaagaaaccgagggaacnccctatcgtacctaatcttgatgctatcctattcgactaacgtcgggtacccatcgtaggttcagccgccaggtgtatcgaggacagtcttcactctacacactcgacaactgaacnctagtaagtattactagtactaatttatacgtacaacctaaataattaacttaaacttacccgttaccgtacctacccgttacggacctaaagggactaacggtacgtaggaagtaaacttaaacgagtagttcggactacgcttacgttctcgtctcttcacttccctccgaacctaag

SEQ ID NO: 408139 - DNA, 688 bp, Homo sapiens
  misc_feature: GZ8MTXP01AVKKL.38.11.A11.1.454.CMB.2.raw
  modified_base (184)..(184): a, c, t, g, unknown or other
  modified_base (226)..(226): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacttggtcgggcgggcacggtattaacnccgtggttggcctggtatcagcaagaaaccgagggaaacgccctatcgtaccctaatctttgatcgcatcctactttgactaaacgtcgggtccctagtctaggtcagccgcccgaggtggatcgtagggaactagtaatttcaccttctccaacctagtaccgaaactaacccgtagaacgtaccctaggaaacgtacttaccgtagtaaccttaattttaacttactacgtaacctaaaactaaagtttaaacttaaacttaacccgttaaccccgggttacctaacccgtttacccggaacccgtaaacggggaacctaaccggtaaccgtagggtaaacgtaaacgttaaaaccggacgttacgggttacggtaccgttacggacccgttaccgttacttaacccttcggtttaaccttacccgtaccgttccccttaacccgttaaccccgttaacg

SEQ ID NO: 408140 - DNA, 621 bp, Homo sapiens
  misc_feature: GZ8MTXP01DW69U.38.11.A11.1.454.CMB.2.raw
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagatcaccatcacgttggtcgggcgggcacggtattaacaccgttgggtggcctggtatcagcaagaaaccgagggaaacgcccctatcgtaccctaatcttgatgcatccatttgactaacgtcgggtcccagtctagtcagccgcccaggtgatcgtagggaactagtctttcactctcactactacgaacaacctgaacgtaccgtagaagtattactagacttaatttactacgtacactaaactaattaaactaacttaccgttaacccggtactaacccgttccggaaccgtaaacggacctaacgtacgtagggaaacgtaaacgttaaaacgttaccgttaggttcggtaaccttcggaacccttacttacgtttaacgtacgtttccgttaacctcctttacccttcccccggttaacgttaaccg

SEQ ID NO: 408141 - DNA, 606 bp, Homo sapiens
  misc_feature: GZ8MTXP01AHE5A.38.11.A11.1.454.CMB.2.raw
  modified_base (184)..(184): a, c, t, g, unknown or other
  modified_base (559)..(559): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagatcaccatcacgttggcggggcggggcacggtattaacgaccgtgggttggcctggtatcagcaagaaaccgagggaacgccctatcgtaccctaatcttgatgctactccactttgactaacgtcgggtccagtctaggtcagcgccaggtgatcgtggaacagtcttcactctacaccatacgacaacctgaacgaccgtagaagtattacgtacgtacttaactttacttactacgtaacctaaactaaatttaacttaaaccttaacccgttacccccggttacctacccgtttaccggacccgtaaacggggtaacctacggtaaccgtaggaacgtaaacttaaacggttacgtcggttgccgtnaccgacttacgttctacttccttactacttcccttcccgccgtaacg

SEQ ID NO: 408142 - DNA, 579 bp, Homo sapiens
  misc_feature: GZ8MTXP01ETDGE.38.11.A11.1.454.CMB.2.raw
  modified_base (355)..(355): a, c, t, g, unknown or other
  modified_base (366)..(366): a, c, t, g, unknown or other
  modified_base (375)..(375): a, c, t, g, unknown or other
  modified_base (405)..(405): a, c, t, g, unknown or other
  modified_base (574)..(574): a, c, t, g, unknown or other
tcagtcgatcacgtcacgaccggtgctcgatttagctacgactgcaggggggacccagtcaggacacagcatggacatgagggtcctcgctcagctcctggggctcctgctgctctgtttcccaggtgacagatgtgacatccagatcgacccagtctccatcctcactgtctgcatcgtggtaaggagacagtttacgcacctatctacgttggtcggggcgggactaacggttaattaacgaccgttgggttcggcctggtactcgagacaagaaaccgagggaaactccctatcgtaccctaattcttgatgacatcctattgactaacgtcgggtaccatcgtagtcagcnccagtgatcgnggaacagtnttcactctacactatacgaactactgaacnctagaatattacagtacttaaatttactacacaactaaactaaagttacttaaacttacccgttaccgtactaccgttacggaacaaacgggactaacgtacgtaggaactaaattaaacgagtcgttgactgaccacttactcgtacttctactacttcccttcccgntaacg

SEQ ID NO: 408143 - DNA, 645 bp, Homo sapiens
  misc_feature: GZ8MTXP01BOF4E.38.11.A11.1.454.CMB.2.raw
  modified_base (184)..(184): a, c, t, g, unknown or other
  modified_base (268)..(268): a, c, t, g, unknown or other
  modified_base (346)..(346): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacgttggtcggggcgggcacggtattaacgaccgtgggttggcctggtatcagcaagaaaccagggaacnccctatcgtaccctaatcttgatgctatcctatttgactaaacgtcgggtccagtcgtaggtcagcgccagtgatcgnggaactagtaattcacctctaccaacctataccgaaccaacctagaacgtcctaggaatacttaccgtagtacttaaatttacttaacctacgtaaactaaacctaaagttaacttaaaccttaacccgttaaccccggtacctaaccccgttacgggaacccgtaaacggggaacctaaccgggtaacgtagggaaacgtaaacgttaaaacggaccgttaggttacgggtaccttacgaccttaccgttaattccgtgttcccttactaccgttccccttaaccccgttccttaacg

SEQ ID NO: 408144 - DNA, 602 bp, Homo sapiens
  misc_feature: GZ8MTXP01AMG47.38.11.A11.1.454.CMB.2.raw
  modified_base (265)..(265): a, c, t, g, unknown or other
  modified_base (354)..(354): a, c, t, g, unknown or other
  modified_base (401)..(401): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagatcaccatcacttggtcggggcggggcacggtattaacaccttgggttggcctggtatcagcagaaaccagggaacnccctatcgtccctaatcttgatgcatccatttgactaaacgtgggtccccatctaggttcagcgcccaggtggatcgtagggaacagtntttcactctcaccgatccgaacaacctgaagcctagaagtattctanacttaaatttattaccagtaccctaaactaaattaactaaacgttacccttaaccccgggtcctaccgttaccggaccgtaaacggggacctaccggaacgttagggaagtaaacgttaaacgaacgtggttcggacttacgccgttacccttattccgttcgttcctttaccacgttcccgtttccccgaacccttaacg

SEQ ID NO: 408145 - DNA, 652 bp, Homo sapiens
  misc_feature: GZ8MTXP01A3OBE.38.11.A11.1.454.CMB.2.raw
  modified_base (184)..(184): a, c, t, g, unknown or other
  modified_base (229)..(229): a, c, t, g, unknown or other
  modified_base (271)..(271): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagatcaccatctacgttggtcggggcgggcacggtattaaccnccgttgggttcgcctggtatcagacaagaaaccgagggaacnccctatcgtacctaatcttagatcgacactcctactttacgaccgtaaacgtcggggtaccctagttaccgttaggttacacggtccgtaccccgaggttaggacgtacggtaggggtaaacctagttctttccacctctaccaacctataccgaactaacccgtagaaacgtccgtaagtaacgtattacctataacttaaatttactactacgtaacctaaactaacttaaacgtaaaccttacccgttaccccgtaccgtaacccgttccggaaccgaaacgggacaacgtacgtaaggaagtaaactaaacgacgtggttcggacttcgaccttacttacgttctacttccttactccttcccgtaacccgctaacg

SEQ ID NO: 408146 - DNA, 584 bp, Homo sapiens
  misc_feature: GZ8MTXP01BG265.38.11.A11.1.454.CMB.2.raw
  modified_base (269)..(269): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcgggcggggcacggtattaacaccgtggttcggcctggtatcgagcaagaaaccgagggaacnccctatcgtaccctaatctttgatcgactatccaactttgacctaaactgtcggtacccattcgtaggttcacggtcccgccgaggtggtatcgtaagggactgtacttcactcacacataccgacaaccgtgaacgcctagaatattctagtacttaacttatactacgaacctaaacgtaaattaacttaacttaccgttaacccgtcctaccgttaccgaaccgtaagggaaccacgtacgtagaaacgtaacgttaaacgaccgttgtagcgttgccttacgtaatctcgtctcttacttccgttcccgtc

SEQ ID NO: 408147 - DNA, 704 bp, Homo sapiens
  misc_feature: GZ8MTXP01A0QPQ.38.11.A11.1.454.CMB.2.raw
  modified_base (274)..(274): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagatcaccatcacgttggtcggggcgggctacggtattaaccgccgttgggttcggcctggtatcgagacaaagaaaccgagggaacnccctagtcgtaccctaatcttgatcgctactcctacgtttgaccgtaaacgtcggggtaccctagttcgttaggtcacggtccgtacccctaggtcggagttccggtaggggtaaaccaggttctttcccaaccttccctaccaacccgtacgtaccgaaaccctaaaccgttaggaaccgtacccgtaaggaaacttactttacgtacgtaaccttaaattttaactaactactaactaaactaattaacttaaacgttacccttaaccggtacctaaccgttaccggaaccgtaaacgggacctaacgggtaacgttacgggaaacgtaaacgtttaaaacggaccgttaggttacggtaccgtacgaccgttaccgttacgttcttacgttcctttaccactttccccgttccccgaacgtttaacg

SEQ ID NO: 408148 - DNA, 597 bp, Homo sapiens
  misc_feature: GZ8MTXP01E3BR7.38.11.A11.1.454.CMB.2.raw
  modified_base (227)..(227): a, c, t, g, unknown or other
  modified_base (243)..(243): a, c, t, g, unknown or other
  modified_base (264)..(264): a, c, t, g, unknown or other
  modified_base (398)..(398): a, c, t, g, unknown or other
  modified_base (403)..(403): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatccagttggtcgggcggggcacggtataacnccgtggtgcctggtancagcaagaaaccagggaaacncccctatcgtaccctaatctttgatgctatcctatttgacctaaacgtcgggtacccagtctaggttcagccgcccaggtggatcgtgggaacagtctttcactctacacatcgaacactagaacgctagaatnttacngactaatttattactacgacctaaataacttaactaaacttacccgtttaaccccggacctaacccgttaccgggaacccaaacggggacccaacggtaacgtacgggaaagtaaacgttaaaacggttacgtggttacgggactcgaccttaccttattcctagttccttacacttcccttccccgcgtaacg

SEQ ID NO: 408149 - DNA, 976 bp, Homo sapiens
  misc_feature: GZ8MTXP01DY488.38.11.A11.1.454.CMB.2.raw
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagatcaccatctacgttggtccggggcggggactaacgggttaacttaaccgacccgttggggttcggacccgttagggtatccgaagaccgaaaggaaaaccccgaaggggaaaaccgtccccccttaaagttaccggttacccccttaaaatttccttttaggaaactttcggtaccctaaacgtttaccccctaaaccgttttttacggaaacccgttaaaaaccggtttcccggggggttaacccccctaaaggttttcccgtttaaaacgggggtttcccaaacgggtaccccggacccccgtaagggtttacggggtaaacgtttcccggttaggggggtaaaaaaccctaagggtttaaccttttaccctaaacccttcccgttaacccaaacccctaacgtttaaccggaaaaccctaaaaccccgttaggaaaaccggtacccttaaggaaaacgttaacgttttacctaaggttaacctttaaaactttttaacttaaacccgtaacgtaaaccctaaaaacctttaaaagttaaaacttttaaaacccgtttaaaccccgtttaacccccggggttaaccttaaaccccggtttacccgggaaacccggaaacgggggttaaacccaaaccgggtaaacgttaagggtaaacgtaaaacgttttaaaaacccggaaacgtttagggttaccggtaacgttaccgaccgttaaccccttaattccgtttacgtttaaccgtaccttcccgttacccgttaaccccgttaacgtttaaccg

SEQ ID NO: 408150 - DNA, 617 bp, Homo sapiens
  misc_feature: GZ8MTXP01EQPJ9.38.11.A11.1.454.CMB.2.raw
  modified_base (272)..(272): a, c, t, g, unknown or other
tcagtcgatcacgtcacgaccggtgctcgatttagctacgactgcaggggggacccagtcaggacacagcatggacatgagggtcctcgctcagctcctggggctcctgctgctctgtttcccaggtgacagatgtgacatccagatgacccagtctccatcctcactgtctgcatctgtagagacagagtcacatcacgttggcgggcgggactacggtattaacgaccgttgggttcggcctggtatcgagacaagaaaccgagggaacnccctatcgtacctaatcttgatgctatcctattagactaaacgtcgggtaccctatcgtagtcagcgccgaggtgatcgaggaacagtctttcacttctaccaacctatacgaactaacctagaacgtcctagaagtattacgtagtacttaaatttattactacgaacctaaactaaattaacttaaacgttaacccttacccggtactaacccgttacggaaccgaaacgggactaacggtaacgtaacggtaagtaaacttaaacggaacgttgggttacgtaccgtacgaccttacttacgttctcgttaacttcctacttcccgttcccgaacttaaccg

SEQ ID NO: 408151 - DNA, 617 bp, Homo sapiens
  misc_feature: GZ8MTXP01APXTA.38.11.A11.1.454.CMB.2.raw
  modified_base (342)..(342): a, c, t, g, unknown or other
  modified_base (359)..(359): a, c, t, g, unknown or other
  modified_base (376)..(376): a, c, t, g, unknown or other
  modified_base (386)..(386): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcacggtattaacacctggttaggcctggtactcagcaagaaaccagggaaacgccctatcgtccctaatctttgatgcatccactttgcaaacgtcgggtcccatcgtaggtcacggcgcccagtgatgnggaacagtcttcactcncaccatacacactgaancctagaagtnttactgacttaatttattacagtaccctaaataaagttaacttaaacgttaaccttaccccgggttactaaccccgttacggaacccgtaaaacggggactaaaccggaacctacgggtaaagaaacgttaaaaccgttacgtacggttggaccgtttacggacccttaaccttaattcccggttctttaacccttactaaccgtttacccgttccccgaaccctttaacg

SEQ ID NO: 408152 - DNA, 588 bp, Homo sapiens
  misc_feature: GZ8MTXP01BDB1K.38.11.A11.1.454.CMB.2.raw
  modified_base (264)..(264): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcacatcacgttggtcggggcgggcacggtattaacgaccgtggttcgcctggtatcagcagaaacagggaacnccctatcgtcctaatcttgatgctatccatttgacaacgtcgggtcccagtctagttcagcgcccagtgatcgtaggacagtctttcactctcacactcgaactacctagaacgccgtagaacgtattactagtactaatttacttactacgaacctaactaattacgttaacttaccgttaccgtactaccgttcgacgtaacggactacgtacgtacggaagtaacgtttaaaacgaacgttcggttacggtaccgttacgaccgttaccttacttccgttacgttcctttactaccgtttcccttaaccccgctttaaccg

SEQ ID NO: 408153 - DNA, 790 bp, Homo sapiens
  misc_feature: GZ8MTXP01DUHXM.38.11.A11.1.454.CMB.2.raw
  modified_base (270)..(270): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcggggcggggcaacgggtattaacacctgggttggcctggtatcagcaagaaaccagggaaacncccctatcgtaccctaatctttgatgcatccgtaactttgacctaaaacgttcgggggtacccctaagttcgttaacgggttcaaacggccgtacccccgaagggtttcggaaagttcccggttagggggaaaaaccctaagggttaacttttacccaaaccttcccttaccaaacccctaagttacccggaaacctaaacccgttgaaaacggtccctaaggtaaaactatttaccgtagtaaaccttaaattttaaacttaaccgttacgaaacccctaaaagttaaaacgtttaaactttaaaaccgtttaaaccccgtttaaccccgggtacctaaaccccgtttaccggggaaccgtaaaacgggggaacctaaaccggtaaccgttaacgggaaagtaaacgtttaaaaaccgggaaacttacggttgggaccttacggacccgttaacccgttaactttcgtaacgtttcctttaccctaacttccccgtttaacccccggaacgttaaccgg

SEQ ID NO: 408154 - DNA, 628 bp, Homo sapiens
  misc_feature: GZ8MTXP01DSUPM.38.11.A11.1.454.CMB.2.raw
  modified_base (266)..(266): a, c, t, g, unknown or other
  modified_base (428)..(428): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcgggcggggcacggtacttaacacctgggttggcctggtatcagacagaaacagggaacncccctatcgtccctaatcttgatgcatcctactttgactaaacgtcggggtacccagttctaggttcagccgcccaggtggatcgtagggaacagtcttcactctcacatacgaacaacctagaacgcctagaacgtattactagtactaatttactactanaacctaaactaattaagtaaacttaccttaacccggtactaccccgttacggaccgtaaaacgggccaaacggtaccgtaagggtaacgaaaacgtttaaaacggttaaacttgggttacggtaaccgttcgaaccgttacccttaagttccgttacgttctttacccgtaactttccctttcccccggttaactaaccg

SEQ ID NO: 408155 - DNA, 781 bp, Homo sapiens
  misc_feature: GZ8MTXP01C5QDK.38.11.A11.1.454.CMB.2.raw
  modified_base (267)..(267): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatcgacccagtcctccatcctcactgtctgctatcgtggtaggagacagagtccaaccatcgtacgttggtccggggcggggactaacgggtattaaccgccgttgggttcggccgtaggtanacgaagacgaaacggaaaccgaaggtaaaccgacccctaagttccgttaccccttaagttctttaggaactcgtacctaacttccctaagtttacgacgtaaaccggttcgggggttaccccagttaccgtagggttacgacggtcccgtacccgtagggtagtacgtccggtaagggaaacttaacggttctttaccacccttcctaaaccacccgtaacgtacccgtaaacctaaccgttacggaaccgtacgtaagaaagttacttacgtagtaactttaaactttaacgtactaacgtaactaaacttaaattaaccttaaacgttaccccgttaacccggtacttaaccccggttaaccggaacgaaacgggtaaccgtacggtaacgttaaacggggaaacgttaaacgttaaaacggagtacgggttcggtaaacttaccgaaccgttaccttcggttaacgttctttaacccgttcgtaccttaccccggttcccgttaactaacg

SEQ ID NO: 408156 - DNA, 639 bp, Homo sapiens
  misc_feature: GZ8MTXP01AX3YR.38.11.A11.1.454.CMB.2.raw
  modified_base (383)..(383): a, c, t, g, unknown or other
  modified_base (431)..(431): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcggggcgggacacggttaattaacgaccgttgggttcggcctggtatcgagacaagaaaccgagggaaacctcccctagtccgtaccctaagttctttagatcgactacgttccctacgtttgacctaacggtcgggtaccctagtcgttacgtcacgcgccctaggtgacgttcgnggaacagtcttcactcacactactacgaacactgaacgtctagaagtnttacgacgtacttaatttacttactacgaacctaaactaagttaacttaaacgttacccgttacccgtacctaccgttccggaaccgtaaacgggacctaacggtacgttacgggaagtaaacgtttaaacgacgttggacgtaccgtacgccttaacttcgttaacttcgtaaccttacctacttccccgttcccgttaacttaacg

SEQ ID NO: 408157 - DNA, 641 bp, Homo sapiens
  misc_feature: GZ8MTXP01BJNKQ.38.11.A11.1.454.CMB.2.raw
  modified_base (261)..(261): a, c, t, g, unknown or other
  modified_base (616)..(616): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagatcaccatcacgttggtcgggcgggcacggtataacactggttgcctggtatcagcaagaaaccagggaaacncccctatcgtccctaatcttgatgctatcctactttagactaaacgtcggggtaccctaagtcgtacggttcacggcgtaccccgaaggttggaacttcgtacggggtaacctaaggtaattttccaacttcctacaacccgtaatcccggaaactaaacccgttggaaacgtcctaggaaattacttactcgtaacttaaatttacttactagtaccaaactaaaggttaactaaacttaacccttaccggtacctaacccgttcggaacccaaaggggtacctaaccgaacgttaacggggaactaaacgttaaaccgaacgtggttacggacttacgacttacgacttcgtntccttcacttccttaacccgctaag

SEQ ID NO: 408158 - DNA, 728 bp, Homo sapiens
  misc_feature: GZ8MTXP01BWNMC.38.11.A11.1.454.CMB.2.raw
  modified_base (185)..(185): a, c, t, g, unknown or other
  modified_base (228)..(228): a, c, t, g, unknown or other
  modified_base (248)..(248): a, c, t, g, unknown or other
  modified_base (271)..(271): a, c, t, g, unknown or other
  modified_base (295)..(295): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatcgtgtagganacagagtccaccatcacgttggcggggcgggcacggtataacncgtgggttcggcctggtacncagacaacgaaaccgagggaacnccctagtcgtacctatcttgatcnctactcctacttacgaccgtaacgtcgggtccctagtcgtacggttcacgccgcccgtaggtcggtactcggtagggtaaacctaggttctttaccgaccttcctaccaaccgtacgtacccgaaacctaaccgtagaaccgtcgtaagaacgttacttacgtagtaactttaactttaacttaccgtaactaaccctaaacttaacgttaaactttaaaccgttaaccccgttaaccccggttaccgttaaccccggttaaccggggaacccgtaaaccggggtaaccgtaaccggtaacggttaacgggaaacgttaaacgttaaaccggttacggttaacgggttcgtaccgtaccgttaccttaccgttacctttcggttaccgtttccgttacccttaccgttccccgttccgttaacccgtttaacg

SEQ ID NO: 408159 - DNA, 781 bp, Homo sapiens
  misc_feature: GZ8MTXP01ARQ9I.38.11.A11.1.454.CMB.2.raw
  modified_base (404)..(404): a, c, t, g, unknown or other
  modified_base (532)..(532): a, c, t, g, unknown or other
tcagtcgatcacgtcacgaccggtgctcgatttagctacgactgcaggggggacccagtcaggacacagcatggacatgagggtcctcgctcagctcctggggctcctgctgctctgtttcccaggtgacagatgtgacatccagatcgacccagtctccatcctcactgtctgcatcgtgtaggagacagacgtcaccatcgtacgttggtccggggcggggactacgggttattaaccgaccgttgggttcggccgtaggtactcgaacgacgaaacgaaaccgaacgggaaacctcccctagtaccgttacccctaaattccgtttagacttcgacctactaccccttagtttacggaccgtaaacggttccggggtaccctagttaccgttaggttaccncggtaccgtccccgtaggtcggtaacgttcggtacggggtaaacttaacggttctttcccaacccgttctacccaaccgtacgttacccgaaaccgtaacctacggaacgtaccgtaggtaaacgttnttacgtacgttaaactttaaacttttacttaaccgttaaccaacttaaactaaacgtttaaacttaaccgttaaccttaccccggtaccttaccgttaccgggaacctaaacggggacctaacggtaacgtaacgggtaaacgttaaacgttaaacgacggttacggttcggtaccgtacggttaccttcccgttatttccgtccgttaacttaccgtaccgttccccttaaccccggaacttaacccg

SEQ ID NO: 408160 - DNA, 710 bp, Homo sapiens
  misc_feature: GZ8MTXP01EL0KC.38.11.A11.1.454.CMB.2.raw
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatcgtgtaggagacagacgtcaccatctacgttggtcgggcgggactaacggtattaacgaccgttgggttcggcctggtactcgaagacaacgaaaccgagggaaacctccctaatcgtaccctaattcttagatcgactactacctacttcgactaacggtcgggtaccctagtcgttacgtacacgtccgacccgaggtcggtaacgtccgtacgggaaaaccttagttaactttacccgaccttacctaccaaccgtaacgtacccgaaactaacccgtagaaacgtcctagtaagtacttaccgtataacttaatttaacttacgttaacgaaactaaacttaaacgttaactttaaaccgttaacccgtttaaccccggtacctacccgttacccgggaaccgtaaacggggtaccctaacgggtaacgtacgggaaacgttaaacgtaaaccgttacgtgggttacgacgtaccaccgttacttcgttaaccttcgtaaccttccgtacttccccgtccttaaccgtaag

SEQ ID NO: 408161 - DNA, 571 bp, Homo sapiens
  misc_feature: GZ8MTXP02H81P2.38.11.A11.1.454.CMB.2.raw
  modified_base (184)..(184): a, c, t, g, unknown or other
  modified_base (376)..(376): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacttggtcgggcggggcacggtataacacctggttggcctggtatcagcaagaaaccagggaaacgcccctatgtaccctaatctttgatgcatccactttgacaaactgtcgtcccatctaggtcagccgcagtgatcgtggactgtactttcactctacaccatccacactgaacnctagaagtacttctagtactaatttactactacgaaccctaaataaattaattaaactaccgttaacccgtactaaccgttcggaaccgaagggaacctacgacgtaggaaacgtaaacgtttaaacgaaactggtacggtactacgacctaaccgtaacgttcttacgttcttactaccttcccttacccgacc

SEQ ID NO: 408162 - DNA, 544 bp, Homo sapiens
  misc_feature: GZ8MTXP02H3X9R.38.11.A11.1.454.CMB.2.raw
  modified_base (346)..(346): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgcgggcggggcacggtattaacacctggttggcctggtatcagcagaaaccagggaaagcccctatgtccctaatctttgatgcatccatttgacaaacgtgggtacccatctaaggttcagcgcccagtggatcgtggacagntttcactcctcaccataccgacaaaccctgaacgcctagaagatttctagactaaatttattactagacctaaactaaataattaaagttaccttaacccgggtctaaccgttccggaccaaaggggacacgaactggaagtaacttaaaacgactgtacggctacgctaccatcctgtacttcactccttccgctac

SEQ ID NO: 408163 - DNA, 504 bp, Homo sapiens
  misc_feature: GZ8MTXP02F9ODE.38.11.A11.1.454.CMB.2.raw
  modified_base (342)..(342): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcacggtattaacacctggttggcctggtatcagcagaaaccagggaaagcccctatgtccctaatctttgatgcatccactttgcaaactggggtcccatctaggtcagcgcccagtgatctgggacagnttcactctcaccatcgacaacctgaaacgcctagaagattctgtactaatttattactgaccaaacaaataataatacttacccggtacaccttcgacaagggacacgactggagattaaaacgaactgtggctgacaccatctgtcttcatcttccgctac

SEQ ID NO: 408164 - DNA, 519 bp, Homo sapiens
  misc_feature: GZ8MTXP02JI618.38.11.A11.1.454.CMB.2.raw
  modified_base (341)..(341): a, c, t, g, unknown or other
  modified_base (404)..(404): a, c, t, g, unknown or other
tcagtcgatcacgtcacgaccggtgctcgatttagctacgactgcaggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcacggtattaacacctggttggcctggtatcagcagaaaccagggaagcccctatgtccctaatctttgatgcatccatttgacaaactgggtcccatctaggttcagcgcccagtggatctgggacagntttcactctcaccatcgacaaacctgaaacgccctagaagtattctagactaatttactactnaccaaacaaataataatacttaccggtacaccttcgacaaggacacgactagagtactaaacgactagtggctacgacaaccatcgtactcttacacttccttacccgactaacg

SEQ ID NO: 408165 - DNA, 498 bp, Homo sapiens
  misc_feature: GZ8MTXP02J2CNG.38.11.A11.1.454.CMB.2.raw
  modified_base (226)..(226): a, c, t, g, unknown or other
  modified_base (346)..(346): a, c, t, g, unknown or other
  modified_base (456)..(456): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacncctggttgcctggtatcagcagaaaccagggaaagcccctatgtcccctaatctttgatgcatccactttgcaaactggggtcccatctaggttcagcgccccagtggatctgggacagntttcactctcaccatcgacaacctgaagcctagaagattctgctaatttattactgaccaacaatataatacttacccggtcaccttcggaccaagggacacgactgganattaaacgactgtagctgcacatctgtctcatcttccgctac

SEQ ID NO: 408166 - DNA, 502 bp, Homo sapiens
  misc_feature: GZ8MTXP02H6PL2.38.11.A11.1.454.CMB.2.raw
  modified_base (346)..(346): a, c, t, g, unknown or other
  modified_base (459)..(459): a, c, t, g, unknown or other
  modified_base (471)..(471): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggtattaacacctggttggcctggtatcagcagaaaccagggaaacgcccctatgtccctaatctttgatgcatccactttgcaaactggggtcccatctagttcagcgcccagtggatctgggacagntttcactctcaccatcgacaacctgaagcctagaagattactgactaatttattactgacaaactaatataatacttacccggtcaccttcggactaaggacacgactggaanataaacgactgngctcgcacatctagtctcatcctccgactac

SEQ ID NO: 408167 - DNA, 645 bp, Homo sapiens
  misc_feature: GZ8MTXP02GAI0G.38.11.A11.1.454.CMB.2.raw
  modified_base (226)..(226): a, c, t, g, unknown or other
  modified_base (347)..(347): a, c, t, g, unknown or other
  modified_base (381)..(381): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacncctgggttgcctggtatcagcaagaaaccagggaaacgcccctatcgtccctaatctttgatgcatccattgcaaacgtgggtcccatctagtcagcgcccagtgatcgtagggactagtntttcactctaccaccatccgaacaacctagaacncctagaagtattctacgtactaaatttactactacgtacctaaactaaattaacttaaaacttaacccgtttaaccccgggttacctaaccccgtttaccgggacccgtaaaacgggggtaccctaacggaaccgttagggtaaacgtaaaacgtttaaaaccggaaaccgttagggtacgggtaccttacggaaccctaacccgtaaattccttacggttaccttttaccgaacgtttccccttacccccggtaccttaaacg

SEQ ID NO: 408168 - DNA, 522 bp, Homo sapiens
  misc_feature: GZ8MTXP02HGXG5.38.11.A11.1.454.CMB.2.raw
  modified_base (356)..(356): a, c, t, g, unknown or other
  modified_base (394)..(394): a, c, t, g, unknown or other
  modified_base (400)..(400): a, c, t, g, unknown or other
  modified_base (416)..(416): a, c, t, g, unknown or other
  modified_base (505)..(505): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggtattaacaccgtggttggcctggtatcagcaagaaaccagggaaacgcccctatcgtaccctaatctttgatgcatccatttgacaaaacgtcggggtcccaatctaggttcagcgcccagtggatctgggacagtntttcactctcaccatcgacaaacctgaacgcctagaanattcanactaaattattactanaccaaactaaataacttaaatacttaacccggtacaccgttacgacaaaggacacgactagaagtataaaacgatgagctgcacatctntctcactctcccactac

SEQ ID NO: 408169 - DNA, 515 bp, Homo sapiens
  misc_feature: GZ8MTXP02JUHM7.38.11.A11.1.454.CMB.2.raw
  modified_base (356)..(356): a, c, t, g, unknown or other
  modified_base (413)..(413): a, c, t, g, unknown or other
  modified_base (461)..(461): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacacctggttgcctggtatcagcagaaaccagggaaagcccctatcgtccctaatctttgatgctatcctactttgctaaacgtcggggtcccatctaggttcagcgcccagtgatctgggacagtattaacnctcaccatcgacaactgaagcctagaagtattctagactaatttatactgaccaaanactaatactactaccgtcaccttcgaccgtaaggactacgactagganacgttaaaacgactgtacgctgacactatctgtcttcactcctccgcctatacg

SEQ ID NO: 408170 - DNA, 676 bp, Homo sapiens
  misc_feature: GZ8MTXP02JD7C4.38.11.A11.1.454.CMB.2.raw
  modified_base (185)..(185): a, c, t, g, unknown or other
  modified_base (273)..(273): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtcctccatcctcactgtctgcatctgtagganacagatcaccatcacgttggtcgggcgggactacggtacttaacaccgttgggttggcctggtatcgagacaagaaaccgagggaacncccctatcgtaccctaattcgtttgatcgtctactcctacgtttcgactaaacggttcgggtaccctagttcgtacggtcacgccgtacccgtagtggactcggtaggactagtctttccactcctaccacctactaccgaacctaaccgtagaaacgtccctaggtaacgttattaccgtacgtaactttaactttaacttactacgtaaaaccctaaacttaaatttaacttaaacccgttacccgttaaccccggttacctaccccgggttaccggaaacccggtaaacgggacctaacggtaacgtacggtaaacgtaaaacggttaaaacgacggttacggtacggtctacgacctactacgttctcgttacttctactttcccgtacccgtactacg

SEQ ID NO: 408171 - DNA, 553 bp, Homo sapiens
  misc_feature: GZ8MTXP02IO3U8.38.11.A11.1.454.CMB.2.raw
  modified_base (261)..(261): a, c, t, g, unknown or other
  modified_base (322)..(322): a, c, t, g, unknown or other
  modified_base (340)..(340): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcgggcacggtattaacacctggttggcctggtatcagcagaaaccagggaacncccctatcgtacctaatctttgatgcatccatttgacaaacgtgggtccatctagtcagcnccagtgatcgtggacagntttcactctcaccatcgacactgacgctagagattactgactaatttatactacgtaccaaactaaattaacttaaataacctttacccggtacctaccgttaccggaccaaagggaccaacggacgtaggaaacgtaacgttaaaacgaacgtacgtacggactacgaccaacctactcgtacgttcttacacttcccttacccgtactacg

SEQ ID NO: 408172 - DNA, 606 bp, Homo sapiens
  misc_feature: GZ8MTXP02HSCIK.38.11.A11.1.454.CMB.2.raw
  modified_base (349)..(349): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggttattaacgaccttggttggcctggtatcagcaagaaaccagggaaacgcccctatgtccctaatctttgatgcatccatttgcaaacgtgggtcccatctagtcagcgcccagtgatcgtgggacagtntttcaactctcctaaccatacgaacaacctgaaacgcctagaagaattctagtactaaatttactactagacctaaactaaattaattaaaattaacccttaacccggtactaacccgttaccggaacctaaaggggacaaaccgtacgtaaggaaacgtaaacgttaaaaacgtacgtacgttaggaccttacggacctaaccctattaaccgttcgtttaccttactacctttccccgtacccgtaccttaaccg

SEQ ID NO: 408173 - DNA, 577 bp, Homo sapiens
  misc_feature: GZ8MTXP02HFMLW.38.11.A11.1.454.CMB.2.raw
  modified_base (227)..(227): a, c, t, g, unknown or other
  modified_base (347)..(347): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggtattaacncctggttggcctggtatcagcagaaaccagggaaacgcccctatgtccctaatctttgatgcatccatttgacaaacgtgggtcccatctaggtcagtcgcccagtgatcgtggacagtnttcactctcacctatccgacaactgaacgcctagaagtattctagtactaatttattactgtaccaaactaaataacttaacttaccttacccggtactaacccgttcggaccgtaaagggacctaacggtactacgggaagtaaacgttaaaacggtaaactggtacggtacgtcgaacctacctaattccgtcgttccttactaacttcccgttccccgtacttaacg

SEQ ID NO: 408174 - DNA, 583 bp, Homo sapiens
  misc_feature: GZ8MTXP02JUJJR.38.11.A11.1.454.CMB.2.raw
  modified_base (268)..(268): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcgggcggggcacggtattaacaccgtggttggcctggtatcagcaagaaaccgagggaaacnccctatcgtacctaatctttgatgctatcctatttgacgtaaacgtcgggtaccatcgtagtcagcgccagtgatcgtggacagtcttcactctacacatcaacacgtgaacgcctagaatcttactagtacttaatttactactactaccaaactaaatactaaacttaccgttacccggtactaccgttacggaccgaaacgggacacgtacgtaggaaacgtacgttaaaacgacgttacggtacgtacgtacgacctaaccgtacttaaccgttacgttcttacctactttccccgttacccgactttacg

SEQ ID NO: 408175 - DNA, 647 bp, Homo sapiens
  misc_feature: GZ8MTXP02H4HEN.38.11.A11.1.454.CMB.2.raw
  modified_base (184)..(184): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacttggcgggcggggcacggtataacaccgttggttggcctggtatcagcaagaaaccagggaaacgccctatcgtaccctaatctttagatgcatccatttgactaaacgtgggtccctagtctaaggttcagcgcccagtggatcgtgggacagtcttcactctcacctagtacgaactaacctgaaacgtcccgtagaaagtactttactagtacttaaattttaacttactacgacctaaaactaaattaaacttaaacgttaacccttaacccgggttacctaacccgttaccggaccgtaaaacggggaccaaccggtaacgtacggaaacgtaaacgttaaaaccggaacgttacgtacgggtaccgttacgacctaaccgtactttaaccgttacgtttacctttacctaactttaccccggtttccccgtacccttaacg

SEQ ID NO: 408176 - DNA, 537 bp, Homo sapiens
  misc_feature: GZ8MTXP02F34UH.38.11.A11.1.454.CMB.2.raw
  modified_base (374)..(374): a, c, t, g, unknown or other
  modified_base (387)..(387): a, c, t, g, unknown or other
  modified_base (514)..(514): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggtattaacactggttggctggtatcagcagaaaccagggaagcccctatcgtccctaatctttgatgcatcctactttgacaaactggggtcccatctaggtcagcgcccagtggatcgtgggacagtattcactctcaccatcgacaacctgaancctagaagattcngtactaatttatactgaccaaactaaataataaataccctttaaccggtaccaaccgttcggacctaaagggactacgactaggaagtaacttaaaacgaactcgtaggactacgactaccatcgtntacttacacttccttcccgctac

SEQ ID NO: 408177 - DNA, 545 bp, Homo sapiens
  misc_feature: GZ8MTXP02J1WSI.38.11.A11.1.454.CMB.2.raw
  modified_base (346)..(346): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacacctggttggcctggtatcagcaagaaaccagggaaacgcccctatcgtccctaatctttgatgcatccactttgcaaacgtgggtccatctaggtcagcgcccagtgatcgtggacagtnttcactctcaccatcgacaacctgaacgcctagaagtacttctagacctaaatttacttactcgacctaaactaaattataacttaccttacccggtacaccgttccggaccgaaagggacctaacgactagggaataacgttaaaacgaactggtacggactacgaccacatctagtcttctactccttacccgctac

SEQ ID NO: 408178 - DNA, 519 bp, Homo sapiens
  misc_feature: GZ8MTXP02I05OG.38.11.A11.1.454.CMB.2.raw
  modified_base (184)..(184): a, c, t, g, unknown or other
  modified_base (336)..(336): a, c, t, g, unknown or other
  modified_base (514)..(514): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacttgtcgggcgggcacggtattaacactggttgcctggtatcagcagaaaccagggaagcccctatgtccctaatctttgatgcatccactttgcaaactgggtcccatctagttcagcgccagtgatctggacagntttcactctcaccatacgacaacctgaagcctagaagattctagtctaaatttattactgaccaaacaaatattaattaccttacccggtacacccgttcgacctaagggacacgactacggagtacttaaacgactagtcggactgacaccatcgtacgttcttacattccttaccncctac

SEQ ID NO: 408179 - DNA, 521 bp, Homo sapiens
  misc_feature: GZ8MTXP02FZNIJ.38.11.A11.1.454.CMB.2.raw
  modified_base (263)..(263): a, c, t, g, unknown or other
  modified_base (347)..(347): a, c, t, g, unknown or other
  modified_base (389)..(389): a, c, t, g, unknown or other
  modified_base (404)..(404): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggcggggcggggcacggtattaacaccgtggttgcctggtatcagcagaaaccagggaacnccctatcgtccctaatctttgatgcatccactttgctaaacgtcgggtcccatctaggtcagcgcccagtgatcgtggacagtnttcactctcaccatcgaacaacctgaacgcctagaatattcngtactaatttatacnacaaacaatataataccttaccgtcaccgttcggacaaggacacgataggaataacttaaaacgacgtgtacggctacgactaccatcgttagtccttacactccttcccgactacg

SEQ ID NO: 408180 - DNA, 513 bp, Homo sapiens
  misc_feature: GZ8MTXP02H8SNL.38.11.A11.1.454.CMB.2.raw
  modified_base (346)..(346): a, c, t, g, unknown or other
  modified_base (373)..(373): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttgtcgggcggggcacggtattaacacctgggttgcctggtatcagcagaaaccagggaaagcccctatgtccctaatctttgatgcatccatttgacaaactggggtcccatctaggttcagcgccccagtgatcgtggacagtnttcactctcacatcgacaacctgaacncctagaagattactagtactaatttattactgaccaaactaatataatactaccggtacaccgttcgacaaggacacgataggaagaataaacgactgtaggctacgcaccatcgtcgtacttctactcttcccgactac

SEQ ID NO: 408181 - DNA, 597 bp, Homo sapiens
  misc_feature: GZ8MTXP02GN4OG.38.11.A11.1.454.CMB.2.raw
  modified_base (184)..(184): a, c, t, g, unknown or other
  modified_base (277)..(277): a, c, t, g, unknown or other
  modified_base (422)..(422): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagatcaccatcacgttggtcggggcggggctacgggtattaaccaccgttgggttcggccgtggtatcagacaagaaaaccgagggaaacncccctatcgtaccctaatctttgatgcactctactttagacctaaacgtcgggtacccagttcgtaggtcaggcgacccgtagtgatcgtagggacagtcttcactctaccacatacgaacaactagaacgctagaagtattacngtactaatttatactacgtaaccaaataaattaacttaactacccgttaacccggtactaacccgttacggaaccgaaacgggaccaacggtacgtaggaaaacgtaaactttaaaacgaacgttcggaggtacctcgacctactattcgtactcttacacttcctacccactac

SEQ ID NO: 408182 - DNA, 562 bp, Homo sapiens
  misc_feature: GZ8MTXP02F2KGP.38.11.A11.1.454.CMB.2.raw
  modified_base (366)..(366): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcggggcggggctacgggtattaacgaccgttgggttcggcctggtatcagcagaaaccagggaaacgcccctatcgtaccctaatctttgatgcatcctactttgactaaacgtcggggtcccattctagttcagtcgcccgagtgatcgtgggacagtnttcactctcacatcgacaacctgaacgctagaagtattcagtactaatttactactcgaacctaaactaaataacttaaacttaccgttaacccggtacctaccgttacggaccaacgggtaacacgaacgtggaactaacttaaacgaacgtcggtagactcgacactactctcgttctcacttcctaccgctac

SEQ ID NO: 408183 - DNA, 574 bp, Homo sapiens
  misc_feature: GZ8MTXP02G3DIX.38.11.A11.1.454.CMB.2.raw
  modified_base (225)..(225): a, c, t, g, unknown or other
  modified_base (259)..(259): a, c, t, g, unknown or other
  modified_base (321)..(321): a, c, t, g, unknown or other
  modified_base (341)..(341): a, c, t, g, unknown or other
  modified_base (400)..(400): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtataacncgtggtgcctgtatcagcagaaaccagggaaacncccctatcgtccctaatctttgatgcatccattgacaacgtcgggtaccatcgtagtcagcncccagtgatcgtggacagtnttcactctacacatcgaacaactgaaacgctagaagtattcatactaatttactactanaaccaaataaactaagtaaacttacccgttaacccgggtacctaacccgttaccggacgaaacgggacaaccgaacgtagggaaactaaagttaaaaccgaagttcggtacggactacgaccctaacctaagtcgttacgttccttactaccttcccgtttacccgacttaacg

SEQ ID NO: 408184 - DNA, 613 bp, Homo sapiens
  misc_feature: GZ8MTXP02JCWMF.38.11.A11.1.454.CMB.2.raw
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacgttggtcgggcgggcacggtattaacaccgtggttggcctggtatcagcaagaaaccgagggaacgcccctatcgtacctaatctttgatgctatcctactttgacgtaaacgtcgggtcctatcgtagtcagccgaccgagtgactcgtggacagtactttcactctacaccagtaccgaacaaccgtgaacgtcctagaacgtattctagtacttaatttactactacgaacctaaactaaataaacttaacgttaacccgttacccggtacctaacccgttaccggaaccgaacgggtaacacggtacgtacggaaactaaaacgttaaaacgaagttcggtaggtactacgacctaacctacgtccttacgttaccttactacctttcccgttaccccgtacttaaccg

SEQ ID NO: 408185 - DNA, 621 bp, Homo sapiens
  misc_feature: GZ8MTXP02IB6EK.38.11.A11.1.454.CMB.2.raw
  modified_base (184)..(184): a, c, t, g, unknown or other
  modified_base (267)..(267): a, c, t, g, unknown or other
  modified_base (374)..(374): a, c, t, g, unknown or other
  modified_base (404)..(404): a, c, t, g, unknown or other
  modified_base (579)..(579): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacgttggtcgggcggggcacggtattaacgaccgttgggtggcctggatcagcaagaaaccgaggaacnccctatcgtaccctaatctttgatgctatcctatttcgacaaacgtgggtcccattcgtagtcagcgcccgagtgatcgtaggacagtctttccactctacaacctntaccgaacaacctagaactccgtagaagtnttctagtaacttaaatttactacgtacaacctaaactaaattaacttaaacttacccgttacccggtacctaaccgttacccggaaccgtaaacgggaccaaaccggtaacgtaacgggaaacgtaaaacgttaaaaccgtaacgtacgtacgggtacctacgacctaaaccgtntaaccttgttaccttaccaaccgtttccctacccgtactacg

SEQ ID NO: 408186 - DNA, 547 bp, Homo sapiens
  misc_feature: GZ8MTXP02JI2UO.38.11.A11.1.454.CMB.2.raw
  modified_base (184)..(184): a, c, t, g, unknown or other
  modified_base (225)..(225): a, c, t, g, unknown or other
  modified_base (262)..(262): a, c, t, g, unknown or other
  modified_base (347)..(347): a, c, t, g, unknown or other
  modified_base (377)..(377): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagatcaccatcacttggtcgggcgggcacggtattaacnccgtggttgcctggtatcagcagaaaccagggaaacncccctatcgtccctaatctttgatgcatccatttgacaaacgtgggtcccattctaggttcagcgcccagtgatcgtggacagtnttcactctacacatacgactaacctgaacncctagagtattctcgacttaatttatactgtaaccaaataataacttaaactaccgttacccggtactacccgttacggaccgtaaacgggacacgacgtacggaataacgttaaaacgaactggtacggactacgacctaccatctcgtacttacactccttccactac

SEQ ID NO: 408187 - DNA, 595 bp, Homo sapiens
  misc_feature: GZ8MTXP02IMUFY.38.11.A11.1.454.CMB.2.raw
  modified_base (260)..(260): a, c, t, g, unknown or other
  modified_base (355)..(355): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacaccgtggttgcctggtatcagcagaaacagggaancccctatcgtcctaatctttgatgactatcctactttgactaaacgtcggggtcccatcgtaggttcagcgcccgagtcgatcgtgggactagtntttcactctacacctatccaacaacctgaacgtcctagaagtacttctacgtactaatttactactgacctaaactaaataacttaaacttacccttaccggtacctacccgttcggaccgtaacgggaacacgtaactagggaactaacgttaaaacgaacgtcggttacggacttacgacctaacctattaaccgttcgttacctttacctaactttcccctttacccgtacttaccg

SEQ ID NO: 408188 - DNA, 581 bp, Homo sapiens
  misc_feature: GZ8MTXP02GSY7H.38.11.A11.1.454.CMB.2.raw
  modified_base (355)..(355): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggtattaacaccgtggttggcctggtatcagcaagaaaccagggaaacgcccctatcgtccctaatctttgatgcatcctatttgactaaacgtggggtacccatctaggtcagtcgcccagtgatcgtgggacagtntttcacttctacaccatacgaacaacctgaaacgcctagaagtattctagtactaaatttatactagacctaaactaaataattaaataccttaacccggtacctaacccgttaccggaccgaaacgggacaacggtacgtaggaagtaaacgtaaaacgaacgttagtacggtactacgaccaacctacgttaacgtctacttactacttccttcccgactaacg

SEQ ID NO: 408189 - DNA, 538 bp, Homo sapiens
  misc_feature: GZ8MTXP02JH9V1.38.11.A11.1.454.CMB.2.raw
  modified_base (282)..(285): a, c, t, g, unknown or other
  modified_base (307)..(307): a, c, t, g, unknown or other
  modified_base (315)..(315): a, c, t, g, unknown or other
  modified_base (322)..(322): a, c, t, g, unknown or other
  modified_base (339)..(339): a, c, t, g, unknown or other
  modified_base (515)..(515): a, c, t, g, unknown or other
  modified_base (534)..(534): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggcgggcggggcacggtattaacaccgtgggttggcctggtatcgagacaacgaacgaggacctcctatcctactatctnnnnctctatcactacggtcggactntcgtgtcncgcacgngtgactgagatatctcnctcaccactacgaccaaccacgtagaccgtacgtagtaacttcgttacacgtaactttaatttaccagtacaaacctaaataaataacttaactacccgttaccgtactaccgtacggaacgaacgacacgtagtagaataaacgtaacgagtcgcgactcgactactacgtcgtntacctactcctccgtaccntacg

SEQ ID NO: 408190 - DNA, 623 bp, Homo sapiens
  misc_feature: GZ8MTXP02HYTU2.38.11.A11.1.454.CMB.2.raw
  modified_base (184)..(184): a, c, t, g, unknown or other
  modified_base (281)..(281): a, c, t, g, unknown or other
  modified_base (382)..(382): a, c, t, g, unknown or other
  modified_base (448)..(448): a, c, t, g, unknown or other
  modified_base (597)..(597): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacttggtcggggcggggcaacgggttattaacgaccgttgggttcggccttggtaatccgagcaaaggaaaccaggggaaacncccctaatcgtacccctaatctttagattgcatcccaatttgactaaacgtggggtacccatctaggttcagccgaccctaggtgactcgtagggacagtntttaccacgttccaccaaactataccgaaacctaaaccgtgaaacgccttagaaacgtattcgtanacttaaatttaactttacgaacaacctaaaataagttaaataaaccgttaacccttacccgggactaaccgttcggaacccaagggactaacggactagggaaataacgttaaaacggaactgtacggactacgacctaaccattcgtntacttacacttccctacccactaacg

SEQ ID NO: 408191 - DNA, 643 bp, Homo sapiens
  misc_feature: GZ8MTXP02GUE9L.38.11.A11.1.454.CMB.2.raw
  modified_base (226)..(226): a, c, t, g, unknown or other
  modified_base (349)..(349): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacncctggttggcctggtatcagcagaaaccagggaaagcccctatcgtccctaatctttgatgcatccactttgacaaactggggtacccatctaggttcagtcgcccagtgatcgtgggacagntttcactctcaccatcgacaacctgaacgcctagaagtactttactcgacttaaatttacttacttcgaacctaaactaaattaacttaaacttacccgtttaaccccgggttacctaaccccgtttaccgggtacccgtaaacggggaacctaaccggtaaccgttaggggaaacgttaaacgttaaaaaccggtaaaccgttaggttacgggtacttacgggaccctaaccgtaacgttccgttcgttaacctttccgtaactttccctttacccccggtaccctttaaccg

SEQ ID NO: 408192 - DNA, 640 bp, Homo sapiens
  misc_feature: GZ8MTXP02FQC2V.38.11.A11.1.454.CMB.2.raw
  modified_base (277)..(277): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagatcaccatctacgttggcggggcgggactaacggttaattaaccgaccgttgggttcggcctggtatcagacaagaaaccgagggaacncccctatcgtacctaatctttgatgcactcctacttgactaaacgtcgggtccagttctaggtcacgcgccctagtgatcgtggacagtcttcactctaccacctataccgaactaacctgaacgtcgtaagaagtattaccgtagtaacttaaattttacttacctacgtaaacctaaactaaattaaacgttaaccttaacccgtttacccggtaccttacccgttacggaaccgaacgggtaaccacgtaacgtaacgtaaacgtaaaacgtaaaaccgtagttacggtacgtactacgaacctaccttaacgttccttacgttaccttaactcctttacccgttaccccactttaaccg

SEQ ID NO: 408193 - DNA, 594 bp, Homo sapiens
  misc_feature: GZ8MTXP02G242J.38.11.A11.1.454.CMB.2.raw
  modified_base (185)..(185): a, c, t, g, unknown or other
  modified_base (273)..(273): a, c, t, g, unknown or other
  modified_base (342)..(342): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtcctccatcctcactgtctgcatctgtagganacagagtcaccatcacgttggcggggcggggctaacggtattaacgaccgttgggttggcctggtatcagcaagaaaccgagggaacnccctatcgtacctaatctttgatgcatcctatttgactaaacgtcgggtaccctattcgtaggtcagcncccgagtgatcgaggacagtattcactctacacatacgacaactagaacgctagaatattctagtactaaatttactactacgtaaccaaactaaataacttaaactaacccgttacccgtacctacccgttacggaaccgtaaacgggacacgaacgtaggaaacgtaaacttaaaaccgagttagtacggtactacggaccaccctaagttccgttacgttccttacctacttcccttcccgtactaacg

SEQ ID NO: 408194 - DNA, 594 bp, Homo sapiens
  misc_feature: GZ8MTXP02HLCVT.38.11.A11.1.454.CMB.2.raw
  modified_base (226)..(226): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacncctggttgcctggtatcagcagaaaccagggaacgcccctatcgtaccctaatctttgatcgcatcctactttgacaaacgtcgggtcccattcgtaggttcagcgcccgagtgatcgtgggacagtcttcactctaccacatacgacaacctgaacgctagaagtattcgtatactaatttactactacgaccaaactaataacttaaacttacccgttacccggtacctacccgttaccggaccgaaacgggaccaacgtacgtaggaaacgtaaacttaaaacgacgtacggtacggtacttcggacctaacctacttcgttacgttacctttactacctttcccgttaccccgtaccttaaccg

SEQ ID NO: 408195 - DNA, 528 bp, Homo sapiens
  misc_feature: GZ8MTXP02GVK1U.38.11.A11.1.454.CMB.2.raw
  modified_base (379)..(379): a, c, t, g, unknown or other
  modified_base (387)..(387): a, c, t, g, unknown or other
  modified_base (392)..(392): a, c, t, g, unknown or other
  modified_base (409)..(409): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcgggcacggtattaacacctggttgcctggtatcagcagaaaccagggaaagcccctatgtccctaatctttgatgcatccatttgcaaacgtgggtcccatcgtaggtcagcgccccagtggatctgggacagctttcactctacacctatccgaacaaacctgaaacncctagaanattcngtactaaatttatactnaccaaacaataataataccttaccggtcaccgttcggacccaagggacacgactagaagtaattaaacggaatggtggctcgacacctaagtctcgtactttcacgtccttcccactaa

SEQ ID NO: 408196 - DNA, 609 bp, Homo sapiens
  misc_feature: GZ8MTXP02GVEYI.38.11.A11.1.454.CMB.2.raw
  modified_base (345)..(345): a, c, t, g, unknown or other
  modified_base (354)..(354): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcaccatcacttggtcgggcggggcacggtattaacaccgtgggttcggcctggtatcagcaagaaaccagggaaacgcccctatcgtaccctaatctttgatgcatctattgacaaactcggggtaccatctaggtcagcgcccagtggatcgngggacagtnttcactctcacagtcacaactgaacgacctagaagtattctagtactaaatttatacttagaacctaaactaaataacttaaactaccgtttaaccccgggtcaaccccgtttacggacccgaaaagggaccaacgaaaccggttagggaaacgtaaacgttaaaaacccgagttacggtacgggtactacggtaccaacctaacttaacgttcgttacttacctaacgtttccctacccccggtactttaaccg

SEQ ID NO: 408197 - DNA, 530 bp, Homo sapiens
  misc_feature: GZ8MTXP02FLEYG.38.11.A11.1.454.CMB.2.raw
  modified_base (225)..(225): a, c, t, g, unknown or other
  modified_base (259)..(259): a, c, t, g, unknown or other
  modified_base (416)..(416): a, c, t, g, unknown or other
  modified_base (511)..(511): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagatcaccatcacttgtcgggcggggcacggtattaacnctggttgcctggtatcagcagaaaccagggaacncccctatcgtaccctaatctttgatgcatcctactttgacaaacgtgggtcccagttctaggtcagcgcccagtgatcgtgggacagtattcactctacaccatacgacaactgaacgcctagaagtattcagtactaaatttatactgaaccaaanaaattataaacttaccttaacccggtacaaccgttcggaccaaacggacacgactaggaactaacgtaaacgactaggtcgctcgacacatcgtntactcactcctccgactac

SEQ ID NO: 408198 - DNA, 644 bp, Homo sapiens
  misc_feature: GZ8MTXP02IL8WU.38.11.A11.1.454.CMB.2.raw
  modified_base (227)..(227): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagatcaccatcacgttggtcgggcggggcacggtattaacnccgtggttgcctggtatcagcagaaaccgagggaaacgcccctatcgtccctaatctttgatgctatccctactttgactaaaccgttcggggtaccctagtccgttacggttcaacggtccgacccctaggtggacttcggtaggggtaaccaggttacttttccaaccttccttaccaacccctagtaccgaacctaaacccgtagaaacgtccctagaaagtacttactacgtaaccttaaattttaactaactacgtaacctaaactaaattaaacttaaacttaaccgtttacccgggtacctacccgttacggaccgaaacggggtacaacgtacgtaggaacgtaaagttaaacgacgtggtacgctacgacctaccatcgttctaccttcaacttccttacccgactac

SEQ ID NO: 408199 - DNA, 585 bp, Homo sapiens
  misc_feature: GZ8MTXP02GK1NK.38.11.A11.1.454.CMB.2.raw
  modified_base (265)..(265): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagatcaccatcacgttggtcgggcggggcacggtattaacaccgtggttgcctggtatcagcaagaaaccagggaaacncccctatcgtaccctaatctttgatgctactcctactttgacaaacgtcggggtacccagttacgtaggttcaggcgccccgaggtgatcgtgggaactagtactttcactctaccacataccgacaaccgtgaaactctagaagtattctagtaacttaaactttattaactacaacctaaacaaattaactaaacgttaccttaccccggtactacccgttacggaaccgaacggaacacgtacgtaggaactaagttaaaacgaactggtacgactacgacctactatcgtactacttctactccttacccgctacg

SEQ ID NO: 408200 - DNA, 626 bp, Homo sapiens
  misc_feature: GZ8MTXP02G8UYL.38.11.A11.1.454.CMB.2.raw
  modified_base (184)..(184): a, c, t, g, unknown or other
  modified_base (267)..(267): a, c, t, g, unknown or other
  modified_base (363)..(363): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagagtcaccatcacttggtcgggcggggcacggtattaacaccgttgggttcgccgtggtatcagcagaaaccagggaacncccctatcgtacccctaatcctttgatcgctatcctactttgactaaacgtcggggtacccagtctagttcacgcgcccagtgatcgtggacagtnttcactctcaccatacacaactagaacgacctagaacgtattactacgacttaaatttacgttactacacctaaactaaactaattaaacttacccgttacccggtacctaaccgtttaccggaaccgtaaacggggaactaaccgaccgtaaggtaacgtaaaacttaaaacgaacgtacggtacggtaacgtcgaaccctaacctaacgttcctacgtttaccttactaaccgtttccccttaccccggtaccttaacccg

SEQ ID NO: 408201 - DNA, 589 bp, Homo sapiens
  misc_feature: GZ8MTXP02FZB0E.38.11.A11.1.454.CMB.2.raw
  modified_base (225)..(225): a, c, t, g, unknown or other
  modified_base (261)..(261): a, c, t, g, unknown or other
  modified_base (371)..(371): a, c, t, g, unknown or other
  modified_base (375)..(375): a, c, t, g, unknown or other
  modified_base (394)..(394): a, c, t, g, unknown or other
  modified_base (402)..(402): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagagtcacatcacgttggcgggcgggcacggtactaacncgtggttcgctggtatcagcaagaaacgagggaacnccctatcgtacctaatctttgatcgactacttcctacgtttacgactaaacggtcgggtacctagttcgtaggtcacggcgacccgtaggtgactcgaggacagtcttcnctcncacatcgaactactagacncctagatnttcagtacttaatttactacgataccaaataataacttaactaccgttacccgtctacccgttacggacgaacgggtaacacgtaacgtaggaaacgttaaacgttaaaacgtacgtacgggtacgtctacggtaccacttacttcgttacttaccttccgtaacttcccgttacccgactttaacg

SEQ ID NO: 408202 - DNA, 677 bp, Homo sapiens
  misc_feature: GZ8MTXP02GQUU9.38.11.A11.1.454.CMB.2.raw
  modified_base (184)..(184): a, c, t, g, unknown or other
  modified_base (278)..(278): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtagganacagatcaccatcacgttggtcggggcggggctaacgggtaattaaccgaccgttggggttcgccgtggtatcagcaagaaaccgagggaaacncccctatcgtaccctaatctttgatcgactactcctaactttgaccgtaaacgttcggggtacccctagttccgttaaggttcacgtccgaccccgtaggtcgatcgtaggactagtactttcactctaccaaccgtataccgaaacaaccgtgaaacgtcctaagaagtattacgagtaacttaatttaacttactactaacctaaataaactaacttaaacttaaccgttaacccgtacctaacccgttacgaaccgtaaacgggaccaacggtaacgtacggaaaagtaaaacgttaaaacccggtaagtttacggacggtaccttacgacccgtaactacgttaaccgttacgtttacgttacctaacctttccctacccccggtactttaaccg

SEQ ID NO: 408203 - DNA, 607 bp, Homo sapiens
  misc_feature: GZ8MTXP02IEQSI.38.11.A11.1.454.CMB.2.raw
  modified_base (187)..(187): a, c, t, g, unknown or other
  modified_base (225)..(225): a, c, t, g, unknown or other
  modified_base (240)..(241): a, c, t, g, unknown or other
  modified_base (258)..(258): a, c, t, g, unknown or other
  modified_base (278)..(278): a, c, t, g, unknown or other
  modified_base (327)..(327): a, c, t, g, unknown or other
tcagtcgatcacgtcacgaccggtgctcgatttagctacgactgcgagggggacccagtcaggacacagcatggacatgagggtcctcgctcagctccgtggggctcctgctgctctgtttcccaggtgacagatgtgacatccagatgacccagtctccatcctcactgtctgcatctggtagganacagatcaccatcattggcggggcgggcacggtatacncgtggtcggctgtannagcagaaacagggaacnccctatcgtacctatctttnatgcatcctatttgactaacgtcgggtaccctatctaggttcaggggcncccgagtgatcgtaggactagtcttcactcctaccaccactcgaaccactagaacactagagtattctacgtacttaatttacttacacgtaaacctaaactaaattaaacttaactttaacccgtttacccggtacccttacccggttacggtaacccgtaaacggggtaccaaaccgggtacgtaacggtaacgtaaacgttaaaacgtaacgtacgtcggacgttacgacctaacctacgtcttcgttactttacactttcccttacccgtactaac

SEQ ID NO: 408204 - DNA, 582 bp, Homo sapiens
  misc_feature: GZ8MTXP02GU4XG.38.11.A11.1.454.CMB.2.raw
  modified_base (233)..(233): a, c, t, g, unknown or other
  modified_base (272)..(272): a, c, t, g, unknown or other
  modified_base (359)..(359): a, c, t, g, unknown or other
  modified_base (374)..(374): a, c, t, g, unknown or other
  modified_base (553)..(553): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctgtaggagacagacgtcaccatcacgttggtcggggcggggcaacggttattaaccnccgtgggttgcctggtatcagcaagaaaccgagggaacnccctatcgtacctaatctttgatgcatccatttgactaacgtcgggtacccattcgtagttcagcgccgagtcgatcgtggacagtnttcactctcacctanactacaaacccgtgaaacgtcctaagtaagactttcagtacttaaattttactacgtacaaccctaaataaacttaacttaaacttacccgttaacccggtctaacccgttaggaaccgtaaggaccaccgagtacggtaacgtaaacgtaaaccgagtggtacggctacgacacgtancgttctcttactactccttccccgatacc

SEQ ID NO: 408205 - DNA, 584 bp, Homo sapiens
  misc_feature: GZ8MTXP02IGUEP.38.11.A11.1.454.CMB.2.raw
  modified_base (280)..(280): a, c, t, g, unknown or other
  modified_base (384)..(384): a, c, t, g, unknown or other
tcagtcgatcacgtcacgaccggtgctcgatttagctacgactgcagggggacccagtcaggacacagcatggacatgagggtcctcgctcagctcctggggctcctgctgctctgtttcccaggtgacagatgtgacatccagatgacccagtctccatcctcactgtctgcatctggtaggagacagacgtcaccatcacgttggtcgggcgggctacggttattaacgtccgttgggtcggccttaggtactcgagacaacggaaaccgagggaacncccctatcgtacctaatcttagatgcatcctattgactaacgtcgggtaccatcgtagtcacgcgacccgagtcgactcgtggactagtcttcactctacactntacaactactagaactcgtagtacgtacttcgtactacttaatttactacgtacaacctaaataacttaatttaaacctaccgttaccgtactaccgttacggaccgaagggacacgacgtaggaactaacgtaaacgacgtagtacggactcgacctactactcgttctaccttacgtaccttccgtaccgtactaacg
